(12) United States Patent
Williams et al.

(10) Patent No.: US 6,964,868 B1
(45) Date of Patent: Nov. 15, 2005

(54) HUMAN GENES AND GENE EXPRESSION PRODUCTS II

(75) Inventors: Lewis T. Williams, Tiburon, CA (US); Jaime Escobedo, Alamo, CA (US); Michael A. Innis, Moraga, CA (US); Pablo Dominguez Garcia, San Francisco, CA (US); Julie Sudduth-Klinger, Kensington, CA (US); Christoph Reinhard, Alameda, CA (US); Klaus Giese, Berlin (DE); Filippo Randazzo, San Francisco, CA (US); Giulia C. Kennedy, San Francisco, CA (US); David Pot, San Francisco, CA (US); Altaf Kassam, Oakland, CA (US); George Lamson, Moraga, CA (US); Radoje Drmanac, Palo Alto, CA (US); Radomir Crkvenjakov, Sunnyvale, CA (US); Mark Dickson, Hollister, CA (US); Snezana Drmanac, Palo Alto, CA (US); Ivan Labat, San Francisco, CA (US); Dena Leshkowitz, Sunnyvale, CA (US); David Kita, Foster City, CA (US); Veronica Garcia, Sunnyvale, CA (US); Lee William Jones, San Jose, CA (US); Birgit Stache-Crain, Sunnyvale, CA (US)

(73) Assignee: Nuvelo, Inc., Sunnyvale, CA (US)

( * ) Notice: Subject to any disclaimer, the term of this patent is extended or adjusted under 35 U.S.C. 154(b) by 356 days.

(21) Appl. No.: 09/297,648

(22) PCT Filed: Jan. 28, 1999

(86) PCT No.: PCT/US99/01619
§ 371 (c)(1),
(2), (4) Date: Mar. 10, 2000

(87) PCT Pub. No.: WO99/38972
PCT Pub. Date: Aug. 5, 1999

Related U.S. Application Data
(60) Provisional application No. 60/072,910, filed on Jan. 28, 1998, provisional application No. 60/075,954, filed on Feb. 24, 1998, provisional application No. 60/080,114, filed on Mar. 31, 1998, provisional application No. 60/080,515, filed on Apr. 3, 1998, provisional application No. 60/080,666, filed on Apr. 3, 1998, provisional application No. 60/105,234, filed on Oct. 21, 1998, and provisional application No. 60/105,877, filed on Oct. 27, 1998.

(51) Int. Cl.$^7$ ............... C12N 5/10; C12N 15/63; C12N 1/21; C12N 15/12
(52) U.S. Cl. ............ 435/325; 435/320.1; 435/252.3; 536/23.5
(58) Field of Search ............... 435/325, 320.1, 435/252.3, 69.1, 6; 536/23.5, 350

(56) References Cited
PUBLICATIONS

Yang et al. Protein–peptide interactions analyzed with the yeast two–hybrid system. Nucleic Acids Research vol. 23, pp. 1152–1156, 1995.*
Marra et al., GenBank Accession No. AA444267, Aug. 4, 1997.*
Hillier et al., GenBank Accession No. W94391, Oct. 17, 1996.*
Hillier et al., GenBank Accession No. H43467, Jul. 31, 1995.*
Marra et al. GenBank Accession No. W66607, Jun. 14, 1996.*
Marra et al. GenBank Accession No. AA114761, Nov. 15, 1996.*
Hu et al. GenBank Accession No. HSU36478, Dec. 13, 1995.*
Raether et al., GenBank Accession No. HSU14990, Oct. 8, 1994.*
Acker et al. GenBank Accession No. HSRNAP14K, Jun. 8, 1995.*
Lester et al. GenBank Accession No. RRU48288, Aug. 23, 1996.*
Temeles et al. GenBank Accession No. U01137, Aug. 23, 1994.*
Carmeci et al. (1997), "Identification of a Gene (GPR30) with Homology to the G–Protein–Coupled Receptor Superfamily Associated with Estrogen Receptor Expression in Breast Cancer," *Genomics*, vol. 45:607–617.
Yeatman et al. (May 1996), "Identification of Genetic Alterations Associated with the Process of Human Experimental Colon Cancer Liver Metastasis in the Nude Mouse," *Clinical and Expreimental Metastasis*, vol. 14:246–252.
Yeatmen et al. (1995), "Identifcation of a Differentially–Expressed Message Associated with Colon Cancer Liver Metastasis Using an Improved Method of Differential Display," *Nucleic Acids Research*, vol. 23(19):4007–4008.
Baldi et al. (1996) "Differential Expression of the Retinoblastoma Gene Family Members pRb/p105, p107, and pRb2/p130 in Lung Cancer." *Clin Cancer Res.*, vol. 2(7):1239–45.
Okamura et al. (1991) "Endogenous Basic Fibroblast Growth Factor–dependant Induction of Collagenase and Interleukin–6 in Tumor Necrosis Factor–treated Human Microvascular Endothelial Cells." *The Journal of Biological Chemistry*, vol. 266(29): 19162–19165.

(Continued)

Primary Examiner—John S. Brusca
(74) Attorney, Agent, or Firm—James S. Keddie; Carol L. Francis; Bozicevic, Field & Francis LLP

(57) ABSTRACT

This invention relates to novel human polynucleotides and variants thereof, their encoded polypeptides and variants thereof, to genes corresponding to these polynucleotides and to proteins expressed by the genes. The invention also relates to diagnostic and therapeutic agents employing such novel human polynucleotides, their corresponding genes or gene products, e.g., these genes and proteins, including probes, antisense constructs, and antibodies.

9 Claims, No Drawings

OTHER PUBLICATIONS

Radinsky et al. (1995) "Level and Function of Epidermal Growth Factor Receptor Predict the Metastatic Potential of Human Colon Carcinoma Cells." *Clincal Cancer Research*, vol. 1: 19–31.
Genbank Accession No. AA114761, deposited Nov. 15, 1996.
Genbank Accession No. AA444267, deposited Aug. 4, 1997.
Genbank Accession No. H43467, deposited Jul. 31, 1995.
Genbank Accession No. U01137, deposited Aug. 23, 1994.
Genbank Accession No. U14990, deposited Oct. 8, 1994.
Genbank Accession No. U36478, deposited Dec. 13, 1995.
Genbank Accession No. W66607, deposited Jun. 14, 1996.
Genbank Accession No. W94391, deposited Oct. 17, 1996.
Genbank Accession No. AF038957, deposited Jul. 20, 1998.
Genbank Accession No. AF039029, deposited Nov. 4, 1998.
Genbank Accession No. AF047695, deposited Jun. 2, 1998.
Genbank Accession No. AF068116, deposited Jun. 10, 1998.
Genbank Accession No. AF068117, deposited Jun. 10, 1998.
Genbank Accession No. AF116910, deposited May 11, 1999.
Genbank Accession No. AF176555, deposited Nov. 10, 1999.
Genbank Accession No. AF189011, deposited Feb. 6, 2001.
Genbank Accession No. AK001121, deposited Feb. 22, 2000.
Genbank Accession No. AK002717, deposited Feb. 8, 2001.
Genbank Accession No. AK012674, deposited Feb. 8, 2001.
Genbank Accession No. AK013151, deposited Feb. 8, 2001.
Genbank Accession No. AK014691, deposited Feb. 8, 2001.
Genbank Accession No. AK018516, deposited Feb. 8, 2001.
Genbank Accession No. AK022518, deposited Sep. 29, 2000.
Genbank Accession No. AK026563, deposited Sep. 29, 2000.
Genbank Accession No. BC003582, deposited Apr. 18, 2001.
Genbank Accession No. BC004203, deposited Apr. 18, 2001.
Genbank Accession No. BC005392, deposited Apr. 18, 2001.
Genbank Accession No. BC005874, deposited Apr. 18, 2001.
Genbank Accession No. NM_004846, deposited Nov. 1, 2000.
Genbank Accession No. NM_005701, deposited Jan. 11, 2001.
Genbank Accession No. NM_012773, deposited Nov. 1, 2000.
Genbank Accession No. NM_013235, deposited Feb. 3, 2001.
Genbank Accession No. NM_016248, deposited Nov. 2, 2000.
Genbank Accession No. NM_022183, deposited Dec. 6, 2000.
Genbank Accession No. NM_023314, deposited Apr. 14, 2001.
Genbank Accession No. U48288, deposited Aug. 23, 1996.
Genbank Accession No. XM_002264, deposited Apr. 16, 2001.
Genbank Accession No. XM_003725, deposited Apr. 16, 2001.
Genbank Accession No. XM_007118, deposited Apr. 16, 2001.
Genbank Accession No. Z27113, deposited Jun. 8, 1995.
Genbank Accession No. Z46372, deposited Oct. 27, 1994.

* cited by examiner

HUMAN GENES AND GENE EXPRESSION PRODUCTS II

CROSS-REFERENCES TO RELATED APPLICATIONS

This application is the National Phase under 35 U.S.C. § 371 of International Application No. PCT/US99/01619, filed Jan. 28, 1999, which International Application was published by the International Bureau in English on Aug. 5, 1999, which International Application claims the benefit of U.S. provisional patent application Ser. No. 60/072,910, filed Jan. 28, 1998; U.S. provisional patent application Ser. No. 60/075,954, filed Feb. 24, 1998; U.S. provisional patent application Ser. No. 60/080,114, filed Mar. 31, 1998; U.S. provisional patent application Ser. No. 60/080,515, filed Apr. 3, 1998; U.S. provisional patent application Ser. No. 60/080,666, filed Apr. 3, 1998; U.S. provisional patent application Ser. No. 60/105,234, filed Oct. 21, 1998; and of U.S. provisional patent application Ser. No. 60/105,877, filed Oct. 27, 1998, each of which applications are incorporated herein by reference.

FIELD OF THE INVENTION

The present invention relates to novel polynucleotides, particularly to novel polynucleotides of human origin that are expressed in a selected cell type, are differentially expressed in one cell type relative to another cell type (e.g., in cancerous cells, or in cells of a specific tissue origin) and/or share homology to polynucleotides encoding a gene product having an identified functional domain and/or activity.

BACKGROUND OF THE INVENTION

Identification of novel polynucleotides, particularly those that encode an expressed gene product is important in the advancement of drug discovery, diagnostic technologies, and the understanding of the progression and nature of complex diseases such as cancer. Identification of genes expressed in different cell types isolated from sources that differ in disease state or stage, developmental stage, exposure to various environmental factors, the tissue of origin, the species from which the tissue was isolated, and the like is key to identifying the genetic factors that are responsible for the phenotypes associated with these various differences This invention provides novel human polynucleotides, the polypeptides encoded by these polynucleotides, and the genes and proteins corresponding to these novel polynucleotides.

SUMMARY OF THE INVENTION

This invention relates to novel human polynucleotides and variants thereof, their encoded polypeptides and variants thereof, to genes corresponding to these polynucleotides and to proteins expressed by the genes. The invention also relates to diagnostic and therapeutic agents employing such novel human polynucleotides, their corresponding genes or gene products, e.g., these genes and proteins, including probes, antisense constructs, and antibodies. The polynucleotides of the invention correspond to a polynucleotide comprising the sequence information of at least one of SEQ ID NOS: 1–3544, 3546–4510, 4512–4725, 4727–4748, and 4750–5252, which for convenience sake is referred to herein as "SEQ ID NOS:1–5252."

Accordingly, in one embodiment, the present invention features a library of polynucleotides, the library comprising the sequence information of at least one of "SEQ ID NOS:1–5252". In related aspects, the invention features a library provided on a nucleic acid array, or in a computer-readable format.

In one embodiment, the library is comprises a differentially expressed polynucleotide comprising a sequence selected from one of the differentially expressed polynucleotides disclosed herein. In specific related embodiments, the library comprises: 1) a polynucleotide that is differentially expressed in a human breast cancer cell, where the polynucleotide comprises a sequence selected from the group consisting of SEQ ID NOS:15, 36, 44, 45, 89, 146, 154, 159, 165, 172, 174, 183, 203, 261, 364, 366, 387, 419, 420, 496, 503, 510, 512, 529, 552, 560, 564, 570, 590, 606, 644, 646, 693, 707, 711, 726, 746, 754, 756, 875, 902, 921, 942, 990, 1095, 1104, 1122, 1131, 1142, 1170, 1184, 1205, 1286, 1289, 1354, 1387, 1435, 1535, 1751, 1764, 1777, 1795, 1860, 1869, 1882, 1890, 1915, 1933, 1934, 1979, 1980, 2007, 2023, 2040, 2059, 2223, 2245, 2300, 2325, 2409, 2462, 2488, 2486, and 2492; 2) a polynucleotide differentially expressed in a human colon cancer cell, where the polynucleotide comprises a sequence selected from the group consisting of SEQ ID NOS: 33, 65, 228, 250, 252, 253, 280, 282, 355, 370, 387, 443, 460, 491, 545, 560, 581, 603, 680, 693, 703, 704, 716, 726, 746, 752, 753, 1095, 1104, 1205, 1241, 1264, 1354, 1387, 1401, 1442, 1514, 1734, 1742, 1780, 1851, 1899, 1915, 1954, 2024, 2066, 2262, and 2325; 3) a polynucleotide differentially expressed in a human lung cancer cell, where the polynucleotide comprises a sequence selected from the group consisting of SEQ ID NOS:10, 54, 65, 171, 174, 203, 252, 253, 254, 285, 419, 420, 466, 491, 525, 526, 552, 571, 574, 590, 693, 700, 726, 742, 746, 861, 922, 990, 1088, 1288, 1355, 1417, 1422, 1444, 1454, 1570, 1597, 1979, 2007, 2024, 2034, 2038, 2126, and 2245; 4) a polynucleotide differentially expressed in growth factor-treated human microvascular endothelial cells (HMEC) relative to untreated HMEC, where the polynucleotide comprises a sequence selected from the group consisting of SEQ ID NOS:648, 1899, and 648; or 5) polynucleotides that are differentially expressed across multiple libraries, where the polynucleotide comprises a sequence selected from the group consisting of SEQ ID NOS: 65, 174, 203, 252, 253, 387, 419, 420, 491, 552, 560, 581, 590, 648, 693, 726, 746, 990, 1095, 1124, 1205, 1354, 1387, 1780, 1899, 1915, 1979, 2007, 2024, 2245, and 2325.

In another aspect, the invention features an isolated polynucleotide comprising a nucleotide sequence having at least 90% sequence identity to an identifying sequence of "SEQ ID NOS:1–5252" or a degenerate variant thereof. In related aspects, the invention features recombinant host cells and vectors comprising the polynucleotides of the invention, as well as isolated polypeptides encoded by the polynucleotides of the invention and antibodies that specifically bind such polypeptides.

In one embodiment, the invention features an isolated polynucleotide comprising a sequence encoding a polypeptide of a protein family or having a functional domain selected from the group consisting of: 4 transmembrane segments integral membrane proteins, 7 transmembrane receptors (rhodopsin family or secretin family), eukaryotic aspartyl proteases, ATPases associated with various cellular activities (AAA), Bcl-2, cyclins, DEAD box protein family, DEAD/H helicase protein family, MAP kinase protein family, novel 3'5'-cyclic nucleotide phosphodiesterases, protein kinases, ras protein family, G-protein alpha subunit, phorbol esters/diacylglycerol binding proteins, protein kinase, trypsin, protein tyrosine phosphatase, wnt family of developmental signaling proteins, WW/rsp5/WWP domain containing proteins, Ank repeat, basic region plus leucine zipper domain, bromodomain, eukaryotic thiol (cysteine) protease active site, EF-hand, ETS domain, type II fibronectin collagen binding domain, thioredoxin, homeobox domain, TNFR/NGFR family cysteine-rich region, WD domain/G-beta repeats, zinc finger (C2H2 type), zinc finger (CCHC class), and zinc finger (C3HC4 type). In a specific related embodiment, the invention features a polynucleotide comprising a sequence of one of the SEQ ID NOS: listed in Table 3 or Table 20.

In another aspect, the invention features a method of detecting differentially expressed genes correlated with a cancerous state of a mammalian cell, where the method comprises the step of detecting at least one differentially expressed gene product in a test sample derived from a cell suspected of being cancerous, where the gene product is encoded by a gene corresponding to a sequence of at least one of the differentially expressed polynucleotides disclosed herein. Detection of the differentially expressed gene product is correlated with a cancerous state of the cell from which the test sample was derived. In one embodiment, the detecting is by hybridization of the test sample to a reference array, wherein the reference array comprises an identifying sequence of at least one of the differentially expressed polynucleotides disclosed herein.

In one embodiment of the method of the invention, the cell is a breast tissue derived cell, and the differentially expressed gene product is encoded by a gene corresponding to a sequence of at least one of SEQ ID NOS:15, 36, 44, 45, 89, 146, 154, 159, 165, 172, 174, 183, 203, 261, 364, 366, 387, 419, 420, 496, 503, 510, 512, 529, 552, 560, 564, 570, 590, 606, 644, 646, 693, 707, 711, 726, 746, 754, 756, 875, 902, 921, 942, 990, 1095, 1104, 1122, 1131, 1142, 1170, 1184, 1205, 1286, 1289, 1354, 1387, 1435, 1535, 1751, 1764, 1777, 1795, 1860, 1869, 1882, 1890, 1915, 1933, 1934, 1979, 1980, 2007, 2023, 2040, 2059, 2223, 2245, 2300, 2325, 2409, 2462, 2486 2488, and 2492.

In another embodiment of the method of the invention, the cell is a colon tissue derived cell, and differentially expressed gene product is encoded by a gene corresponding to a sequence of at least one of SEQ ID NOS: 65, 228, 252, 253, 280, 355, 491, 581, 603, 680, 693, 716, 726, 746, 752, 753, 1241, 1264, 1401, 1442, 1514, 1851, 1915, 2024, 2066, 33, 250, 282, 370, 387, 443, 460, 545, 560, 703, 704, 1095, 1104, 1205, 1354, 1387, 1734, 1742, 1780, 1899, 1954, 2262, and 2325.

In yet another embodiment of the method of the invention, the cell is a lung tissue derived cell, and differentially expressed gene product is encoded by a gene corresponding to a sequence of at least one of SEQ ID NOS:10, 54, 65, 171, 174, 203, 252, 253, 254, 285, 419, 420, 466, 491, 525, 526, 552, 571, 574, 590, 693, 700, 726, 742, 746, 861, 922, 990, 1088, 1288, 1355, 1417, 1422, 1444, 1454, 1570, 1597, 1979, 2007, 2024, 2034, 2038, 2126, and 2245.

In another embodiment, the cell is any of a lung, breast, or colon cell and the differentially expressed gene product is encoded by a gene corresponding to a sequence of at least one of SEQ ID NOS:648 and 1899.

In still another embodiment, the cell is any of a breast, colon, or lung cell and the differentially expressed gene product is encoded by a gene corresponding to a sequence of at least one of SEQ ID NOS: 65, 174, 203, 252, 253, 387, 419, 420, 491, 552, 560, 581, 590, 648, 693, 726, 746, 990, 1095, 1124, 1205, 1354, 1387, 1780, 1899, 1915, 1979, 2007, 2024, 2245, and 2325.

Other aspects and embodiments of the invention will be readily apparent to the ordinarily skilled artisan upon reading the description provided herein.

DETAILED DESCRIPTION OF THE INVENTION

The invention relates to polynucleotides comprising the disclosed nucleotide sequences, to full length cDNA, mRNA and genes corresponding to these sequences, and to polypeptides and proteins encoded by these polynucleotides and genes.

Also included are polynucleotides that encode polypeptides and proteins encoded by the polynucleotides of the Sequence Listing. The various polynucleotides that can encode these polypeptides and proteins differ because of the degeneracy of the genetic code, in that most amino acids are encoded by more than one triplet codon. The identity of such codons is well-known in this art, and this information can be used for the construction of the polynucleotides within the scope of the invention.

Polynucleotides encoding polypeptides and proteins that are variants of the polypeptides and proteins encoded by the polynucleotides and related cDNA and genes are also within the scope of the invention. The variants differ from wild type protein in having one or more amino acid substitutions that either enhance, add, or diminish a biological activity of the wild type protein. Once the amino acid change is selected, a polynucleotide encoding that variant is constructed according to the invention.

The following detailed description describes the polynucleotide compositions encompassed by the invention, methods for obtaining cDNA or genomic DNA encoding a full-length gene product, expression of these polynucleotides and genes, identification of structural motifs of the polynucleotides and genes, identification of the function of a gene product encoded by a gene corresponding to a polynucleotide of the invention, use of the provided polynucleotides as probes and in mapping and in tissue profiling, use of the corresponding polypeptides and other gene products to raise antibodies, and use of the polynucleotides and their encoded gene products for therapeutic and diagnostic purposes.

I. Polynucleotide Compositions

The scope of the invention with respect to polynucleotide compositions includes, but is not necessarily limited to, polynucleotides having a sequence set forth in any one of "SEQ ID NOS:1–5252"; polynucleotides obtained from the biological materials described herein or other biological sources (particularly human sources) by hybridization under stringent conditions (particularly conditions of high stringency); genes corresponding to the provided polynucleotides; variants of the provided polynucleotides and their corresponding genes, particularly those variants that retain a biological activity of the encoded gene product (e.g., a biological activity ascribed to a gene product corresponding to the provided polynucleotides as a result of the assignment of the gene product to a protein family(ies) and/or identification of a functional domain present in the gene product). Other nucleic acid compositions contemplated by and within the scope of the present invention will be readily apparent to one of ordinary skill in the art when provided with the disclosure here.

The invention features polynucleotides that are expressed in cells of human tissue, specifically human colon, breast, and/or lung tissue. Novel nucleic acid compositions of the invention of particular interest comprise a sequence set forth in any one of "SEQ ID NOS:1–5252" or an identifying sequence thereof. An "identifying sequence" is a contiguous sequence of residues at least about 10 nt to about 20 nt in length, usually at least about 50 nt to about 100 nt in length, that uniquely identifies a polynucleotide sequence, e.g., exhibits less than 90%, usually less than about 80% to about 85% sequence identity to any contiguous nucleotide sequence of more than about 20 nt. Thus, the subject novel nucleic acid compositions include full length cDNAs or mRNAs that encompass an identifying sequence of contiguous nucleotides from any one of "SEQ ID NOS:1–5252."

The polynucleotides of the invention also include polynucleotides having sequence similarity or sequence identity. Nucleic acids having sequence similarity are detected by hybridization under low stringency conditions, for example, at 50° C. and 10×SSC (0.9 M saline/0.09 M sodium citrate) arid remain bound when subjected to washing at 55° C. in 1×SSC. Sequence identity can be determined by hybridization under stringent conditions, for example, at 50° C. or higher and 0.1×SSC (9 mM saline/0.9 mM sodium citrate). Hybridization methods and conditions are well known in the art, see, e.g., U.S. Pat. No. 5,707,829. Nucleic acids that are substantially identical to the provided polynucleotide sequences, e.g. allelic variants, genetically altered versions of the gene, etc., bind to the provided polynucleotide sequences ("SEQ ID NOS:1–5252") under stringent hybridization conditions. By using probes, particularly labeled probes of DNA sequences, one can isolate homologous or related genes. The source of homologous genes can be any species, e.g. primate species, particularly human; rodents, such as rats and mice; canines, felines, bovines, ovines, equines, yeast, nematodes, etc.

Preferably, hybridization is performed using at least 15 contiguous nucleotides of at least one of "SEQ ID NOS:1–5252." That is, when at least 15 contiguous nucleotides of one of the disclosed SEQ ID NOs. is used as a probe, the probe will preferentially hybridize with a gene or mRNA (of the biological material) comprising the complementary sequence, allowing the identification and retrieval of the nucleic acids of the biological material that uniquely hybridize to the selected probe. Probes from more than one SEQ ID NO. will hybridize with the same gene or mRNA if the cDNA from which they were derived corresponds to one mRNA. Probes of more than 15 nucleotides can be used, but 15 nucleotides represents enough sequence for unique identification.

The polynucleotides of the invention also include naturally occurring variants of the nucleotide sequences (e.g., degenerate variants, allelic variants, etc.). Variants of the polynucleotides of the invention are identified by hybridization of putative variants with nucleotide sequences disclosed herein, preferably by hybridization under stringent conditions. For example, by using appropriate wash conditions, variants of the polynucleotides of the invention can be identified where the allelic variant exhibits at most about 25–30% base pair mismatches relative to the selected polynucleotide probe. In general, allelic variants contain 15–25% base pair mismatches, and can contain as little as even 5–15%, or 2–5%, or 1–2% base pair mismatches, as well as a single base-pair mismatch.

The invention also encompasses homologs corresponding to the polynucleotides of "SEQ ID NOS:1–5252", where the source of homologous genes can be any mammalian species, e.g., primate species, particularly human; rodents, such as rats; canines, felines, bovines, ovines, equines, yeast, nematodes, etc. Between mammalian species, e.g., human and mouse, homologs have substantial sequence similarity, e.g., at least 75% sequence identity, usually at least 90%, more usually at least 95% between nucleotide sequences. Sequence similarity is calculated based on a reference sequence, which may be a subset of a larger sequence, such as a conserved motif, coding region, flanking region, etc. A reference sequence will usually be at least about 18 contiguous nt long, more usually at least about 30 nt long, and may extend to the complete sequence that is being compared. Algorithms for sequence analysis are known in the art, such as BLAST, described in Altschul et al., *J. Mol. Biol.* (1990) 215:403–10.

In general, variants of the invention have a sequence identity greater than at least about 65%, preferably at least about 75%, more preferably at least about 85%, and can be greater than at least about 90% or more as determined by the Smith-Waterman homology search algorithm as implemented in MPSRCH program (Oxford Molecular). For the purposes of this invention, a preferred method of calculating percent identity is the Smith-Waterman algorithm, using the following. Global DNA sequence identity must be greater than 65% as determined by the Smith-Waterman homology search algorithm as implemented in MPSRCH program (Oxford Molecular) using an affine gap search with the following search parameters: gap open penalty, 12; and gap extension penalty, 1.

The subject nucleic acids can be cDNAs or genomic DNAs, as well as fragments thereof, particularly fragments that encode a biologically active gene product and/or are useful in the methods disclosed herein (e.g., in diagnosis, as a unique identifier of a differentially expressed gene of interest, etc.). The term "cDNA" as used herein is intended to include all nucleic acids that share the arrangement of sequence elements found in native mature mRNA species, where sequence elements are exons and 3' and 5' non-coding regions. Normally mRNA species have contiguous exons, with the intervening introns, when present, being removed by nuclear RNA splicing, to create a continuous open reading frame encoding a polypeptide of the invention.

A genomic sequence of interest comprises the nucleic acid present between the initiation codon and the stop codon, as defined in the listed sequences, including all of the introns that are normally present in a native chromosome. It can further include the 3' and 5' untranslated regions found in the mature mRNA. It can further include specific transcriptional and translational regulatory sequences, such as promoters, enhancers, etc., including about 1 kb, but possibly more, of flanking genomic DNA at either the 5' and 3' end of the transcribed region. The genomic DNA can be isolated as a fragment of 100 kbp or smaller; and substantially free of flanking chromosomal sequence. The genomic DNA flanking the coding region, either 3' and 5', or internal regulatory sequences as sometimes found in introns, contains sequences required for proper tissue, stage-specific, or disease-state specific expression.

The nucleic acid compositions of the subject invention can encode all or a part of the subject polypeptides. Double or single stranded fragments can be obtained from the DNA sequence by chemically synthesizing oligonucleotides in accordance with conventional methods, by restriction enzyme digestion, by PCR amplification, etc. Isolated polynucleotides and polynucleotide fragments of the invention comprise at least about 10, about 15, about 20, about 35, about 50, about 100, about 150 to about 200, about 250 to about 300, or about 350 contiguous nucleotides selected from the polynucleotide sequences as shown in "SEQ ID NOS:1–5252." For the most part, fragments will be of at least 15 nt, usually at least 18 nt or 25 nt, and up to at least about 50 contiguous nt in length or more. In a preferred embodiment, the polynucleotide molecules comprise a contiguous sequence of at least twelve nucleotides selected from the group consisting of the polynucleotides shown in "SEQ ID NOS:1–5252."

Probes specific to the polynucleotides of the invention can be generated using the polynucleotide sequences disclosed in "SEQ ID NOS:1–5252." The probes are preferably at least about 12, 15, 16, 18, 20, 22, 24, or 25 nucleotide fragment of a corresponding contiguous sequence of "SEQ ID NOS:1–5252", and can be less than 2, 1, 0.5, 0.1, or 0.05 kb in length. The probes can be synthesized chemically or can be generated from longer polynucleotides using restriction enzymes. The probes can be labeled, for example, with a radioactive, biotinylated, or fluorescent tag. Preferably, probes are designed based upon an identifying sequence of a polynucleotide of one of "SEQ ID NOS:1–5252." More preferably, probes are designed based on a contiguous sequence of one of the subject polynucleotides that remain unmasked following application of a masking program for masking low complexity (e.g., XBLAST) to the sequence., i.e., one would select an unmasked region, as indicated by the polynucleotides outside the poly-n stretches of the masked sequence produced by the masking program.

The polynucleotides of the subject invention are isolated and obtained in substantial purity, generally as other than an intact chromosome. Usually, the polynucleotides, either as DNA or RNA, will be obtained substantially free of other naturally-occurring nucleic acid sequences, generally being at least about 50%, usually at least about 90% pure and are typically "recombinant", e.g., flanked by one or more nucleotides with which it is not normally associated on a naturally occurring chromosome.

The polynucleotides of the invention can be provided as a linear molecule or within a circular molecule. They can be provided within autonomously replicating molecules (vectors) or within molecules without replication sequences. They can be regulated by their own or by other regulatory sequences, as is known in the art. The polynucleotides of the invention can be introduced into suitable host cells using a variety of techniques which are available in the art, such as transferrin polycation-mediated DNA transfer, transfection with naked or encapsulated nucleic acids, liposome-mediated DNA transfer, intracellular transportation of DNA-coated latex beads, protoplast fusion, viral infection, electroporation, gene gun, calcium phosphate-mediated transfection, and the like.

The subject nucleic acid compositions can be used to, for example, produce polypeptides, as probes for the detection of mRNA of the invention in biological samples (e.g., extracts of human cells) to generate additional copies of the polynucleotides, to generate ribozymes or antisense oligonucleotides, and as single stranded DNA probes or as triple-strand forming oligonucleotides. The probes described herein can be used to, for example, determine the presence or absence of the polynucleotide sequences as shown in "SEQ ID NOS:1–5252" or variants thereof in a sample. These and other uses are described in more detail below.

Use of Polynucleotides to Obtain Full-length cDNA and Full-Length Human Gene and Promoter Region Full-length cDNA molecules comprising the disclosed polynucleotides are obtained as follows. A polynucleotide having a sequence of one of "SEQ ID NOS:1–5252", or a portion thereof comprising at least 12, 15, 18, or 20 nucleotides, is used as a hybridization probe to detect hybridizing members of a cDNA library using probe design methods, cloning methods, and clone selection techniques such as those described in U.S. Pat. No. 5,654,173. Libraries of cDNA are made from selected tissues, such as normal or tumor tissue, or from tissues of a mammal treated with, for example, a pharmaceutical agent. Preferably, the tissue is the same as the tissue from which the polynucleotides of the invention were isolated, as both the polynucleotides described herein and the cDNA represent expressed genes. Most preferably, the cDNA library is made from the biological material described herein in the Examples. Alternatively, many cDNA libraries are available commercially. (Sambrook et al., *Molecular Cloning: A Laboratory Manual, 2nd Ed.*, (1989) Cold Spring Harbor Press, Cold Spring Harbor, N.Y.). The choice of cell type for library construction can be made after the identity of the protein encoded by the gene corresponding to the polynucleotide of the invention is known. This will indicate which tissue and cell types are likely to express the related gene, and thus represent a suitable source for the mRNA for generating the cDNA. Where the provided polynucleotides are isolated from cDNA libraries, the libraries are prepared from mRNA of human colon cells, more preferably, human colon cancer cells, even more preferably, from a highly metastatic colon cell, Km12L4-A.

Techniques for producing and probing nucleic acid sequence libraries are described, for example, in Sambrook et al., *Molecular Cloning: A Laboratory Manual, 2nd Ed.*, (1989) Cold Spring Harbor Press, Cold Spring Harbor, N.Y. The cDNA can be prepared by using primers based on sequence from "SEQ ID NOS:1–5252." In one embodiment, the cDNA library can be made from only poly-adenylated mRNA. Thus, poly-T primers can be used to prepare cDNA from the mRNA.

Members of the library that are larger than the provided polynucleotides, and preferably that encompass the complete coding sequence of the native message, are obtained. In order to confirm that the entire cDNA has been obtained, RNA protection experiments are performed as follows. Hybridization of a full-length cDNA to an mRNA will protect the RNA from RNase degradation. If the cDNA is not full length, then the portions of the mRNA that are not hybridized will be subject to RNase degradation. This is assayed, as is known in the art, by changes in electrophoretic mobility on polyacrylamide gels, or by detection of released monoribonucleotides. Sambrook et al., *Molecular Cloning: A Laboratory Manual, 2nd Ed.*, (1989) Cold Spring Harbor Press, Cold Spring Harbor, N.Y. In order to obtain additional sequences 5' to the end of a partial cDNA, 5' RACE (*PCR Protocols: A Guide to Methods and Applications*, (1990) Academic Press, Inc.) is performed.

Genomic DNA is isolated using the provided polynucleotides in a manner similar to the isolation of full-length cDNAs. Briefly, the provided polynucleotides, or portions thereof, are used as probes to libraries of genomic DNA. Preferably, the library is obtained from the cell type that was used to generate the polynucleotides of the invention, but this is not essential. Most preferably, the genomic DNA is obtained from the biological material described herein in the Examples. Such libraries can be in vectors suitable for carrying large segments of a genome, such as P1 or YAC, as described in detail in Sambrook et al., 9.4–9.30. In addition, genomic sequences can be isolated from human BAC libraries, which are commercially available from Research Genetics, Inc., Huntville, Ala., USA, for example. In order to obtain additional 5' or 3' sequences, chromosome walking is performed, as described in Sambrook et al., such that adjacent and overlapping fragments of genomic DNA are isolated. These are mapped and pieced together, as is known in the art, using restriction digestion enzymes and DNA ligase.

Using the polynucleotide sequences of the invention, corresponding full-length genes can be isolated using both classical and PCR methods to construct and probe cDNA libraries. Using either method, Northern blots, preferably, are performed on a number of cell types to determine which cell lines express the gene of interest at the highest level. Classical methods of constructing cDNA libraries are taught in Sambrook et al., supra. With these methods, cDNA can be produced from mRNA and inserted into viral or expression vectors. Typically, libraries of mRNA comprising poly(A) tails can be produced with poly(T) primers. Similarly, cDNA libraries can be produced using the instant sequences as primers;

PCR methods are used to amplify the members of a cDNA library that comprise the desired insert. In this case, the desired insert will contain sequence from the full length cDNA that corresponds to the instant polynucleotides. Such PCR methods include gene trapping and RACE methods. Gene trapping entails inserting a member of a cDNA library into a vector. The vector then is denatured to produce single stranded molecules. Next, a substrate-bound probe, such a biotinylated oligo, is used to trap cDNA inserts of interest. Biotinylated probes can be linked to an avidin-bound solid substrate. PCR methods can be used to amplify the trapped cDNA. To trap sequences corresponding to the full length genes, the labeled probe sequence is based on the polynucleotide sequences of the invention. Random primers or primers specific to the library vector can be used to amplify the trapped cDNA. Such gene trapping techniques are described in Gruber et al., WO 95/04745 and Gruber et al., U.S. Pat. No. 5,500,356. Kits are commercially available to perform gene trapping experiments from, for example, Life Technologies, Gaithersburg, Md., USA.

"Rapid amplification of cDNA ends," or RACE, is a PCR method of amplifying cDNAs from a number of different RNAs. The cDNAs are ligated to an oligonucleotide linker, and amplified by PCR using two primers. One primer is based on sequence from the instant polynucleotides, for which full length sequence is desired, and a second primer comprises sequence that hybridizes to the oligonucleotide linker to amplify the cDNA. A description of this methods is reported in WO 97/19110. In preferred embodiments of RACE, a common primer is designed to anneal to an arbitrary adaptor sequence ligated to cDNA ends (Apte and Siebert, *Biotechniques* (1993) 15:890–893; Edwards et al., *Nuc. Acids Res.* (1991) 19:5227–5232). When a single gene-specific RACE primer is paired with the common primer, preferential amplification of sequences between the single gene specific primer and the common primer occurs. Commercial cDNA pools modified for use in RACE are available.

Another PCR-based method generates full-length cDNA library with anchored ends without needing specific knowledge of the cDNA sequence. This method is described in WO 96/40998.

The promoter region of a gene generally is located 5' to the initiation site for RNA polymerase II. Hundreds of promoter regions contain the "TATA" box, a sequence such as TATTA or TATAA, which is sensitive to mutations. The promoter region can be obtained by performing 5' RACE using a primer from the coding region of the gene. Alternatively, the cDNA can be used as a probe for the genomic sequence, and the region 5' to the coding region is identified by "walking up." If the gene is highly expressed or differentially expressed, the promoter from the gene can be of use in a regulatory construct for a heterologous gene.

Once the full-length cDNA or gene is obtained, DNA encoding variants can be prepared by site-directed mutagenesis, described in detail in Sambrook et al., 15.3–15.63. The choice of codon or nucleotide to be replaced can be based on disclosure herein on optional changes in amino acids to achieve altered protein structure and/or function.

As an alternative method to obtaining DNA or RNA from a biological material, nucleic acid comprising nucleotides having the sequence of one or more polynucleotides of the invention can be synthesized. Thus, the invention encompasses nucleic acid molecules ranging in length from 15 nucleotides (corresponding to at least 15 contiguous nucleotides of one of "SEQ ID NOS:1–5252") up to a maximum length suitable for one or more biological manipulations, including replication and expression, of the nucleic acid molecule. The invention includes but is not limited to (a) nucleic acid having the size of a full gene, and comprising at least one of "SEQ ID NOS:1–5252;"; (b) the nucleic acid of (a) also comprising at least one additional gene, operably linked to permit expression of a fusion protein; (c) an expression vector comprising (a) or (b); (d) a plasmid comprising (a) or (b); and (e) a recombinant viral particle comprising (a) or (b). Once provided with the polynucleotides disclosed herein, construction or preparation of (a)–(e) are well within the skill in the art.

The sequence of a nucleic acid comprising at least 15 contiguous nucleotides of at least any one of "SEQ ID NOS:1–5252,", preferably the entire sequence of at least any one of "SEQ ID NOS:1–5252," is not limited and can be any sequence of A, T, G, and/or C (for DNA) and A, U, G, and/or C (for RNA) or modified bases thereof, including inosine and pseudouridine. The choice of sequence will depend on the desired function and can be dictated by coding regions desired, the intron-like regions desired, and the regulatory regions desired. Where the entire sequence of any one of "SEQ ID NOS:1–5252" is within the nucleic acid, the nucleic acid obtained is referred to herein as a polynucleotide comprising the sequence of any one of "SEQ ID NOS:1–5252."

II. Expression of Polypeptide Encoded by Full-length cDNA or Full-length Gene

The provided polynucleotide (e.g., a polynucleotide having a sequence of one of "SEQ ID NOS:1–5252"), the corresponding cDNA, or the full-length gene is used to express a partial or complete gene product. Constructs of polynucleotides having sequences of "SEQ ID NOS:1–5252" can be generated synthetically. Alternatively, single-step assembly of a gene and entire plasmid from large numbers of oligodeoxyribonucleotides is described by, e.g., Stemmer et al., *Gene (Amsterdam)* (1995) 164(1):49–53. In this method, assembly PCR (the synthesis of long DNA sequences from large numbers of oligodeoxyribonucleotides (oligos)) is described. The method is derived from DNA shuffling (Stemmer, *Nature* (1994) 370:389–391), and does not rely on DNA ligase, but instead relies on DNA polymerase to build increasingly longer DNA fragments during the assembly process.

Appropriate polynucleotide constructs are purified using standard recombinant DNA techniques as described in, for example, Sambrook et al., *Molecular Cloning: A Laboratory Manual*, 2nd Ed., (1989) Cold Spring Harbor Press, Cold Spring Harbor, N.Y., and under current regulations described in United States Dept. of HHS, National Institute of Health (NIH) Guidelines for Recombinant DNA Research. The gene product encoded by a polynucleotide of the invention is expressed in any expression system, including, for example, bacterial, yeast, insect, amphibian and mammalian systems. Suitable vectors and host cells are described in U.S. Pat. No. 5,654,173.

Bacteria. Expression systems in bacteria include those described in Chang et al., *Nature* (1978) 275:615; Goeddel et al., *Nature* (1979) 281:544; Goeddel et al., *Nucleic Acids Res.* (1980) 8:4057; EP 0 036,776; U.S. Pat. No. 4,551,433; DeBoer et al., *Proc. Nat. Acad. Sci. (USA)* (1983) 80:21–25; and Siebenlist et al., *Cell* (1980) 20:269.

Yeast. Expression systems in yeast include those described in Hinnen et al., *Proc. Natl. Acad. Sci. (USA)* (1978) 75:1929; Ito et al., *J. Bacteriol.* (1983) 153:163; Kurtz et al., *Mol Cell. Biol.* (1986) 6:142; Kunze et al., *J. Basic Microbiol.* (1985) 25:141; Gleeson et al., *J. Gen. Microbiol.* (1986) 132:3459; Roggenkamp et al., *Mol Gen. Genet.* (1986) 202:302; Das et al., *J. Bacteriol.* (1984) 158:1165; De Louveacourt et al., *J. Bacteriol.* (1983) 154:737; Van den Berg et al., *Bio/Technology* (1990) 8:135; Kunze et al., *J. Basic Microbiol.* (1985) 25:141; Cregg et al., *Mol. Cell. Biol.* (1985) 5:3376; U.S. Pat. Nos. 4,837,148 and 4,929,555; Beach and Nurse, *Nature* (1981) 300:706; Davidow et al., *Curr. Genet.* (1985) 10:380; Gaillardin et al., *Curr. Genet.* (1985) 10:49; Ballance et al., *Biochem. Biophys. Res. Commun.* (1983) 112:284–289; Tilburn et al., *Gene* (1983) 26:205–221; Yelton et al., *Proc. Natl. Acad. Sci. (USA)* (1984) 81:1470–1474; Kelly and Hynes, *EMBO J.* (1985) 4:475479; EP 0 244,234; and WO 91/00357.

Insect Cells. Expression of heterologous genes in insects is accomplished as described in U.S. Pat. No. 4,745,051; Friesen et al., "The Regulation of Baculovirus Gene Expression", in: *The Molecular Biology Of Baculoviruses* (1986) (W. Doerfler, ed.); EP 0 127,839; EP 0 155,476; and Vlak et al., *J. Gen. Virol.* (1988) 69:765–776; Miller et al., *Ann. Rev. Microbiol.* (1988) 42:177; Carbonell et al., *Gene* (1988) 73:409; Maeda et al., *Nature* (1985) 315:592–594; Lebacq-Verheyden et al., *Mol. Cell. Biol.* (1988) 8:3129; Smith et al., *Proc. Natl. Acad. Sci. (USA)* (1985) 82:8844; Miyajima et al., *Gene* (1987) 58:273; and Martin et al., *DNA* (1988) 7:99. Numerous baculoviral strains and variants and corresponding permissive insect host cells from hosts are described in Luckow et al., *Bio/Technology* (1988) 6:47–55, Miller et al., *Generic Engineering* (1986) 8:277–279, and Maeda et al., *Nature* (1985) 315:592–594.

Mammalian Cells. Mammalian expression is accomplished as described in Dijkema et al., *EMBO J.* (1985) 4:761, Gorman et al., *Proc. Nat. Acad. Sci. (USA)* (1982) 79:6777, Boshart et al., *Cell* (1985) 41:521 and U.S. Pat. No. 4,399,216. Other features of mammalian expression are facilitated as described in Ham and Wallace, *Meth. Enz.* (1979) 58:44, Barnes and Sato, *Anal. Biochem.* (1980) 102:255, U.S. Pat. Nos. 4,767,704, 4,657,866, 4,927,762, 4,560,655, WO 90/103430, WO 87/00195, and U.S. Pat. No. RE 30,985.

Polynucleotide molecules comprising a polynucleotide sequence provided herein propagated by placing the molecule in a vector. Viral and non-viral vectors are used, including plasmids. The choice of plasmid will depend on the type of cell in which propagation is desired and the purpose of propagation. Certain vectors are useful for amplifying and making large amounts of the desired DNA sequence. Other vectors are suitable for expression in cells in culture. Still other vectors are suitable for transfer and expression in cells in a whole animal or person. The choice of appropriate vector is well within the skill of the art. Many such vectors are available commercially. The partial or full-length polynucleotide is inserted into a vector typically by means of DNA ligase attachment to a cleaved restriction enzyme site in the vector. Alternatively, the desired nucleotide sequence can be inserted by homologous recombination in vivo. Typically this is accomplished by attaching regions of homology to the vector on the flanks of the desired nucleotide sequence. Regions of homology are added by ligation of oligonucleotides, or by polymerase chain reaction using primers comprising both the region of homology and a portion of the desired nucleotide sequence, for example.

The polynucleotides set forth in "SEQ ID NOS:1–5252" or their corresponding full-length polynucleotides are linked to regulatory sequences as appropriate to obtain the desired expression properties. These can include promoters (attached either at the 5' end of the sense strand or at the 3' end of the antisense strand), enhancers, terminators, operators, repressors, and inducers. The promoters can be regulated or constitutive. In some situations it may be desirable to use conditionally active promoters, such as tissue-specific or developmental stage-specific promoters. These are linked to the desired nucleotide sequence using the techniques described above for linkage to vectors. Any techniques known in the art can be used.

When any of the above host cells, or other appropriate host cells or organisms, are used to replicate and/or express the polynucleotides or nucleic acids of the invention, the resulting replicated nucleic acid, RNA, expressed protein or polypeptide, is within the scope of the invention as a product of the host cell or organism. The product is recovered by any appropriate means known in the art.

Once the gene corresponding to a selected polynucleotide is identified, its expression can be regulated in the cell to which the gene is native. For example, an endogenous gene of a cell can be regulated by an exogenous regulatory sequence as disclosed in U.S. Pat. No. 5,641,670.

III. Identification of Functional and Structural Motifs of Novel Genes

A. Screening Polynucleotide Sequences and Amino Acid Sequences Against Publicly Available Databases Translations of the nucleotide sequence of the provided polynucleotides, cDNAs or full genes can be aligned with individual known sequences. Similarity with individual sequences can be used to determine the activity of the polypeptides encoded by the polynucleotides of the invention. For example, sequences that show similarity with a chemokine sequence can exhibit chemokine activities. Also, sequences exhibiting similarity with more than one individual sequence can exhibit activities that are characteristic of either or both individual sequences.

The full length sequences and fragments of the polynucleotide sequences of the nearest neighbors can be used as probes and primers to identify and isolate the full length sequence corresponding to provided polynucleotides. The nearest neighbors can indicate a tissue or cell type to be used to construct a library for the full-length sequences corresponding to the provided polynucleotides.

Typically, a selected polynucleotide is translated in all six frames to determine the best alignment with the individual sequences. The sequences disclosed herein in the Sequence Listing are in a 5' to 3' orientation and translation in three frames can be sufficient (with a few specific exceptions as described in the Examples). These amino acid sequences are referred to, generally, as query sequences, which will be aligned with the individual sequences. Databases with individual sequences are described in "Computer Methods for Macromolecular Sequence Analysis" *Methods in Enzymology* (1996) 266, Doolittle, Academic Press, Inc., a division of Harcourt Brace & Co., San Diego, Calif., USA. Databases include Genbank, EMBL, and DNA Database of Japan (DDBJ).

Query and individual sequences can be aligned using the methods and computer programs described above, and include BLAST, available over the world wide web at http://ww.ncbi.nlm.nih.gov/BLAST/. Another alignment algorithm is Fasta, available in the Genetics Computing Group (GCG) package, Madison, Wis., USA, a wholly owned subsidiary of Oxford Molecular Group, Inc. Other techniques for alignment are described in Doolittle, supra. Preferably, an alignment program that permits gaps in the sequence is utilized to align the sequences. The Smith-Waterman is one type of algorithm that permits gaps in sequence alignments. See *Meth Mol. Biol.* (1997) 70: 173–187. Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to identify sequences that are distantly related matches, and is especially tolerant of small gaps and nucleotide sequence errors. Amino acid sequences encoded by the provided polynucleotides can be used to search both protein and DNA databases.

Results of individual and query sequence alignments can be divided into three categories, high similarity, weak similarity, and no similarity. Individual alignment results ranging from high similarity to weak similarity provide a basis for determining polypeptide activity and/or structure. Parameters for categorizing individual results include: percentage of the alignment region length where the strongest alignment is found, percent sequence identity, and p value.

The percentage of the alignment region length is calculated by counting the number of residues of the individual sequence found in the region of strongest alignment, e.g., contiguous region of the individual sequence that contains the greatest number of residues that are identical to the residues of the corresponding region of the aligned query sequence. This number is divided by the total residue length of the query sequence to calculate a percentage. For example, a query sequence of 20 amino acid residues might be aligned with a 20 amino acid region of an individual sequence. The individual sequence might be identical to amino acid residues 5, 9–15, and 17–19 of the query sequence. The region of strongest alignment is thus the region stretching from residue 9–19, an 11 amino acid, stretch. The percentage of the alignment region length is: 11 (length of the region of strongest alignment) divided by (query sequence length) 20 or 55%.

Percent sequence identity is calculated by counting the number of amino acid matches between the query and individual sequence and dividing total number of matches by the number of residues of the individual sequences found in the region of strongest alignment. Thus, the percent identity in the example above would be 10 matches divided by 11 amino acids, or approximately, 90.9%.

P value is the probability that the alignment was produced by chance. For a single alignment, the p value can be calculated according to Karlin et al., *Proc. Natl. Acad Sci.* (1990) 87:2264 and Karlin et al., *Proc. Natl. Acad Sci.* (1993) 90. The p value of multiple alignments using the same query sequence can be calculated using an heuristic approach described in Altschul et al., *Nat. Genet.* (1994) 6:119. Alignment programs such as BLAST program can calculate the p value.

Another factor to consider for determining identity or similarity is the location of the similarity or identity. Strong local alignment can indicate similarity even if the length of alignment is short. Sequence identity scattered throughout the length of the query sequence also can indicate a similarity between the query and profile sequences. The boundaries of the region where the sequences align can be determined according to Doolittle. supra; BLAST or FAST programs; or by determining the area where sequence identity is highest.

High Similarity. In general, in alignment results considered to be of high similarity, the percent of the alignment region length is typically at least about 55% of total length query sequence; more typically, at least, about 58%; even more typically; at least about 60% of the total residue length of the query sequence. Usually, percent length of the alignment region can be as much as about 62%; more usually, as much as about 64%; even more usually, as much as about 66%. Further, for high similarity, the region of alignment, typically, exhibits at least about 75% of sequence identity; more typically, at least about 78%; even more typically; at least about 80% sequence identity. Usually, percent sequence identity can be as much as about 82%; more usually, as much as about 84%; even more usually, as much as about 86%.

The p value is used in conjunction with these methods. If high similarity is found, the query sequence is considered to have high similarity with a profile sequence when the p value is less than or equal to about $10^{-2}$; more usually; less than or equal to about $10^{-3}$; even more usually; less than or equal to about $10^{-4}$. More typically, the p value is no more than about $10^{-5}$; more typically; no more than or equal to about $10^{-10}$; even more typically; no more than or equal to about $10^{-15}$ for the query sequence to be considered high similarity.

Weak Similarity. In general, where alignment results considered to be of weak similarity, there is no minimum percent length of the alignment region nor minimum length of alignment. A better showing of weak similarity is considered when the region of alignment is, typically, at least about 15 amino acid residues in length; more typically, at least about 20; even more typically; at least about 25 amino acid residues in length. Usually, length of the alignment region can be as much as about 30 amino acid residues; more usually, as much as about 40; even more usually, as much as about 60 amino acid residues. Further, for weak similarity, the region of alignment, typically, exhibits at least about 35% of sequence identity; more typically, at least about 40%; even more typically; at least about 45% sequence identity. Usually, percent sequence identity can be as much as about 50%; more usually, as much as about 55%; even more usually, as much as about 60%.

If low similarity is found, the query sequence is considered to have weak similarity with a profile sequence when the p value is usually less than or equal to about $10^{-2}$; more usually; less than or equal to about $10^{-3}$; even more usually; less than or equal to about $10^{-4}$. More typically, the p value is no more than about $10^{-5}$; more usually; no more than or equal to about $10^{-10}$; even more usually; no more than or equal to about $10^{-15}$ for the query sequence to be considered weak similarity.

Similarity Determined by Sequence Identity Alone. Sequence identity alone can be used to determine similarity of a query sequence to an individual sequence and can indicate the activity of the sequence. Such an alignment, preferably, permits gaps to align sequences. Typically, the query sequence is related to the profile sequence if the sequence identity over the entire query sequence is at least about 15%; more typically, at least about 20%; even more typically, at least about 25%; even more typically, at least about 50%. Sequence identity alone as a measure of similarity is most useful when the query sequence is usually, at least 80 residues in length; more usually, 90 residues; even more usually, at least 95 amino acid residues in length. More typically, similarity can be concluded based on sequence identity alone when the query sequence is preferably 100 residues in length; more preferably, 120 residues in length; even more preferably, 150 amino acid residues in length.

Determining Activity from Alignments with Profile and Multiple Aligned Sequences. Translations of the provided polynucleotides can be aligned with amino acid profiles that define either protein families or common motifs. Also, translations of the provided polynucleotides can be aligned to multiple sequence alignments (MSA) comprising the polypeptide sequences of members of protein families or motifs. Similarity or identity with profile sequences or MSAs can be used to determine the activity of the gene products (e.g., polypeptides) encoded by the provided polynucleotides or corresponding cDNA or genes. For example, sequences that show an identity or similarity with a chemokine profile or MSA can exhibit chemokine activities.

Profiles can designed manually by (1) creating an MSA, which is an alignment of the amino acid sequence of members that belong to the family and (2) constructing a statistical representation of the alignment. Such methods are described, for example, in Birney et al., *Nucl. Acid Res.* (1996) 24(14): 2730–2739. MSAs of some protein families and motifs are publicly available. For example, http://genome.wustl.edu/Pfam/ includes MSAs of 547 different families and motifs. These MSAs are described also in Sonnhammer et al., *Proteins* (1997) 28: 405–420. Other sources over the world wide web include the site at http://www.embl-heidelberg.de/argos/ali/ali.html; alternatively, a message can be sent to ALI@EMBL-HEIDELBERG.DE for the information. A brief description of these MSAs is reported in Pascarella et al., *Prot. Eng.* (1996) 9(3):249–251. Techniques for building profiles from MSAs are described in Sonnhammer et al., supra; Birney et al., supra; and "Computer Methods for Macromolecular Sequence Analysis," *Methods in Enzymology* (1996) 266, Doolittle, Academic Press, Inc., a division of Harcourt Brace & Co., San Diego, Calif., USA.

Similarity between a query sequence and a protein family or motif can be determined by (a) comparing the query sequence against the profile and/or (b) aligning the query sequence with the members of the family or motif. Typically, a program such as Search wise is used to compare the query sequence to the statistical representation of the multiple alignment, also known as a profile. The program is described in Birney et al., supra. Other techniques to compare the sequence and profile are described in Sonnhammer et al., supra and Doolittle, supra.

Next, methods described by Feng et al., *J. Mol. Evol.* (1987) 25:351 and Higgins et al., *CABIOS* (1989) 5:151 can be used align the query sequence with the members of a family or motif, also known as a MSA. Computer programs, such as PILEUP, can be used. See Feng et al., infra. In general, the following factors are used to determine if a similarity between a query sequence and a profile or MSA exists: (1) number of conserved residues found in the query sequence, (2) percentage of conserved residues found in the query sequence, (3) number of frameshifts, and (4) spacing between conserved residues.

Some alignment programs that both translate and align sequences can make any number of frameshifts when translating the nucleotide sequence to produce the best alignment. The fewer frameshifts needed to produce an alignment, the stronger the similarity or identity between the query and profile or MSAs. For example, a weak similarity resulting from no frameshifts can be a better indication of activity or structure of a query sequence, than a strong similarity resulting from two frameshifts. Preferably, three or fewer frameshifts are found in an alignment; more preferably two or fewer frameshifts; even more preferably, one or fewer frameshifts; even more preferably, no frameshifts are found in an alignment of query and profile or MSAs.

Conserved residues are those amino acids found at a particular position in all or some of the family or motif members. For example, most chemokines contain four conserved cysteines. Alternatively, a position is considered conserved if only a certain class of amino acids is found in a particular position in all or some of the family members. For example, the N-terminal position can contain a positively charged amino acid, such as lysine, arginine, or histidine.

Typically, a residue of a polypeptide is conserved when a class of amino acids or a single amino acid is found at a particular position in at least about 40% of all class members; more typically, at least about 50%; even more typically, at least about 60% of the members. Usually, a residue is conserved when a class or single amino acid is found in at least about 70% of the members of a family or motif; more usually, at least about 80%; even more usually, at least about 90%; even more usually, at least about 95%.

A residue is considered conserved when three unrelated amino acids are found at a particular position in the some or all of the members; more usually, two unrelated amino acids. These residues are conserved when the unrelated amino acids are found at particular positions in at least about 40% of all class member; more typically, at least about 50%; even more typically, at least about 60% of the members. Usually, a residue is conserved when a class or single amino acid is found in at least about 70% of the members of a family or motif; more usually, at least about 80%; even more usually, at least about 90%; even more usually, at least about 95%.

A query sequence has similarity to a profile or MSA when the query sequence comprises at least about 25% of the conserved residues of the profile or MSA; more usually, at least about 30%; even more usually; at least about 40%. Typically, the query sequence has a stronger similarity to a profile sequence or MSA when the query sequence comprises at least about 45% of the conserved residues of the profile or MSA; more typically, at least about 50%; even more typically; at least about 55%.

B. Screening Polynucleotide and Amino Acid Sequences Against Protein Profiles

The identify and function of the gene that correlates to a polynucleotide described herein can be determined by screening the polynucleotides or their corresponding amino acid sequences against profiles of protein families. Such profiles focus on common structural motifs among proteins of each family. Publicly available profiles are described above in Section IVA. Additional or alternative profiles are described below.

In comparing a novel polynucleotide with known sequences, several alignment tools are available. Examples include PileUp, which creates a multiple sequence alignment, and is described in Feng et al., *J. Mol. Evol.* (1987) 25:351. Another method, GAP, uses the alignment method of Needleman et al., *J. Mol. Biol.* (1970) 48:443. GAP is best suited for global alignment of sequences. A third method, BestFit, functions by inserting gaps to maximize the number of matches using the local homology algorithm of Smith et al., *Adv. Appl. Math.* (1981) 2:482.

C. Identification of Secreted & Membrane-bound Polypeptides

Both secreted and membrane-bound polypeptides of the present invention are of particular interest. For example, levels of secreted polypeptides can be assayed in body fluids that are convenient, such as blood, urine, prostatic fluid and semen. Membrane-bound polypeptides are useful for constructing vaccine antigens or inducing an immune response. Such antigens would comprise all or part of the extracellular region of the membrane-bound polypeptides. Because both secreted and membrane-bound polypeptides comprise a fragment of contiguous hydrophobic amino acids, hydrophobicity predicting algorithms can be used to identify such polypeptides.

A signal sequence is usually encoded by both secreted and membrane-bound polypeptide genes to direct a polypeptide to the surface of the cell. The signal sequence usually comprises a stretch of hydrophobic residues. Such signal sequences can fold into helical structures. Membrane-bound polypeptides typically comprise at least one transmembrane region that possesses a stretch of hydrophobic amino acids that can transverse the membrane. Some transmembrane regions also exhibit a helical structure. Hydrophobic fragments within a polypeptide can be identified by using computer algorithms. Such algorithms include Hopp & Woods, *Proc. Natl. Acad Sci. USA* (1981) 78:3824–3828; Kyte & Doolittle, *J. Mol. Biol.* (1982) 157: 105–132; and RAOAR algorithm, Degli Esposti et al., *Eur. J. Biochem.* (1990) 190: 207–219.

Another method of identifying secreted and membrane-bound polypeptides is to translate the polynucleotides of the invention in all six frames and determine if at least 8 contiguous hydrophobic amino acids are present. Those translated polypeptides with at least 8; more typically, 10; even more typically, 12 contiguous hydrophobic amino acids are considered to be either a putative secreted or membrane bound polypeptide. Hydrophobic amino acids include alanine, glycine, histidine, isoleucine, leucine, lysine, methionine, phenylalanine, proline, threonine, tryptophan, tyrosine, and valine.

IV. Identification of the Function of an Expression Product of a Full-length Gene Corresponding to a Polynucleotide Ribozymes, antisense constructs, and dominant negative mutants can be used to determine function of the expression product of a gene corresponding to a polynucleotide provided herein. These methods and compositions are particularly useful where the provided novel polynucleotide exhibits no significant or substantial homology to a sequence encoding a gene of known function. Antisense molecules and ribozymes can be constructed from synthetic polynucleotides. Typically, the phosphoramidite method of oligonucleotide synthesis is used. See Beaucage et al., *Tet. Lett.* (1981) 22:1859 and U.S. Pat. No. 4,668,777. Automated devices for synthesis are available to create oligonucleotides using this chemistry. Examples of such devices include Biosearch 8600, Models 392 and 394 by Applied Biosystems, a division of Perkin-Elmer Corp., Foster City, Calif., USA; and Expedite by Perceptive Biosystems, Framingham, Mass., USA. Synthetic RNA, phosphate analog oligonucleotides, and chemically derivatized oligonucleotides can also be produced, and can be covalently attached to other molecules. RNA oligonucleotides can be synthesized, for example, using RNA phosphoramidites. This method can be performed on an automated synthesizer, such as Applied Biosystems, Models 392 and 394, Foster City, Calif., USA. See Applied Biosystems User Bulletin 53 and Ogilvie et al., *Pure & Applied Chem.* (1987) 59:325.

Phosphorothioate oligonucleotides can also be synthesized for antisense construction. A sulfurizing reagent, such as tetraethylthiruam disulfide (TETD) in acetonitrile can be used to convert the internucleotide cyanoethyl phosphite to the phosphorothioate triester within 15 minutes at room temperature. TETD replaces the iodine reagent, while all other reagents used for standard phosphoramidite chemistry remain the same. Such a synthesis method can be automated using Models 392 and 394 by Applied Biosystems, for example.

Oligonucleotides of up to 200 nucleotides can be synthesized, more typically, 100 nucleotides, more typically 50 nucleotides; even more typically 30 to 40 nucleotides. These synthetic fragments can be annealed and ligated together to construct larger fragments. See, for example, Sambrook et al., supra.

A. Ribozymes

Trans-cleaving catalytic RNAs (ribozymes) are RNA molecules possessing endoribonuclease activity. Ribozymes are specifically designed for a particular target, and the target message must contain a specific nucleotide sequence. They are engineered to cleave any RNA species site-specifically in the background of cellular RNA. The cleavage event renders the mRNA unstable and prevents protein expression. Importantly, ribozymes can be used to inhibit expression of a gene of unknown function for the purpose of determining its function in an in vitro or in vivo context, by detecting the phenotypic effect.

One commonly used ribozyme motif is the hammerhead, for which the substrate sequence requirements are minimal. Design of the hammerhead ribozyme is disclosed in Usman et al., *Current Opin. Struct. Biol.* (1996) 6:527. Ribozymes can also be prepared and used as described in Long et al., *FASEB J.* (1993) 7:25; Symons, *Ann. Rev. Biochem.* (1992) 61:641; Perrotta et al., *Biochem.* (1992) 31:16; Ojwang et al., *Proc. Natl. Acad. Sci.* (*USA*) (1992) 89:10802; and U.S. Pat. No. 5,254,678. Ribozyme cleavage of HIV-I RNA is described in U.S. Pat. No. 5,144,019; methods of cleaving RNA using ribozymes is described in U.S. Pat. No. 5,116,742; and methods for increasing the specificity of ribozymes are described in U.S. Pat. No. 5,225,337 and Koizumi et al., *Nucleic Acid Res.* (1989) 17:7059. Preparation and use of ribozyme fragments in a hammerhead structure are also described by Koizumi et al., *Nucleic Acids Res.* (1989) 17:7059. Preparation and use of ribozyme fragments in a hairpin structure are described by Chowrira and Burke, *Nucleic Acids Res.* (1992) 20:2835. Ribozymes can also be made by rolling transcription as described in Daubendiek and Kool, *Nat. Biotechnol.* (1997) 15(3):273.

The hybridizing region of the ribozyme can be modified or can be prepared as a branched structure as described in Hom and Urdea, *Nucleic Acids Res.* (1989) 17:6959. The basic structure of the ribozymes can also be chemically altered in ways familiar to those skilled in the art, and chemically synthesized ribozymes can be administered as synthetic oligonucleotide derivatives modified by monomeric units. In a therapeutic context, liposome mediated delivery of ribozymes improves cellular uptake, as described in Birikh et al., *Eur. J. Biochem.* (1997) 245:1.

Using the polynucleotide sequences of the invention and methods known in the art, ribozymes are designed to specifically bind and cut the corresponding mRNA species. Ribozymes thus provide a means to inhibit the expression of any of the proteins encoded by the disclosed polynucleotides or their full-length genes. The full-length gene need not be known in order to design and use specific inhibitory ribozymes. In the case of a polynucleotide or full-length cDNA of unknown function, ribozymes corresponding to that nucleotide sequence can be tested in vitro for efficacy in cleaving the target transcript. Those ribozymes that effect cleavage in vitro are further tested in vivo. The ribozyme can also be used to generate an animal model for a disease, as described in Birikh et al., supra. An effective ribozyme is used to determine the function of the gene of interest by blocking its transcription and detecting a change in the cell. Where the gene is found to be a mediator in a disease, an effective ribozyme is designed and delivered in a gene therapy for blocking transcription and expression of the gene.

Therapeutic and functional genomic applications of ribozymes proceed beginning with knowledge of a portion of the coding sequence of the gene to be inhibited. Thus, for many genes, a partial polynucleotide sequence provides adequate sequence for constructing an effective ribozyme. A target cleavage site is selected in the target sequence, and a ribozyme is constructed based on the 5' and 3' nucleotide sequences that flank the cleavage site. Retroviral vectors are engineered to express monomeric and multimeric hammerhead ribozymes targeting the mRNA of the target coding sequence. These monomeric and multimeric ribozymes are tested in vitro for an ability to cleave the target mRNA. A cell line is stably transduced with the retroviral vectors expressing the ribozymes, and the transduction is confirmed by Northern blot analysis and reverse-transcription polymerase chain reaction (RT-PCR). The cells are screened for inactivation of the target mRNA by such indicators as reduction of expression of disease markers or reduction of the gene product of the target mRNA.

B. Antisense

Antisense nucleic acids are designed to specifically bind to RNA, resulting in the formation of RNA-DNA or RNA-RNA hybrids, with an arrest of DNA replication, reverse transcription or messenger RNA translation. Antisense polynucleotides based on a selected polynucleotide sequence can interfere with expression of the corresponding gene. Antisense polynucleotides are typically generated within the cell by expression from antisense constructs that contain the antisense strand as the transcribed strand. Antisense polynucleotides based on the disclosed polynucleotides will bind and/or interfere with the translation of mRNA comprising a sequence complementary to the antisense polynucleotide. The expression products of control cells and cells treated with the antisense construct are compared to detect the protein product of the gene corresponding to the polynucleotide upon which the antisense construct is based. The protein is isolated and identified using routine biochemical methods.

Given the extensive background literature and clinical experience in antisense therapy, one skilled in the art can use selected polynucleotides of the invention as additional potential therapeutics. The choice of polynucleotide can be narrowed by first testing them for binding to "hot spot" regions of the genome of cancerous cells. If a polynucleotide is identified as binding to a "hot spot", testing the polynucleotide as an antisense compound in the corresponding cancer cells clearly is warranted.

C. Dominant Negative Mutations

As an alternative method for identifying function of the gene corresponding to a polynucleotide disclosed herein, dominant negative mutations are readily generated for corresponding proteins that are active as homomultimers. A mutant polypeptide will interact with wild-type polypeptides (made from the other allele) and form a non-functional multimer. Thus, a mutation is in a substrate-binding domain, a catalytic domain, or a cellular localization domain. Preferably, the mutant polypeptide will be overproduced. Point mutations are made that have such an effect. In addition, fusion of different polypeptides of various lengths to the terminus of a protein can yield dominant negative mutants. General strategies are available for making dominant negative mutants (see, e.g., Herskowitz, *Nature* (1987) 329:219). Such techniques can be used to create loss of function mutations, which are useful for determining protein function.

V. Construction of Polypeptides of the Invention and Variants Thereof

The polypeptides of the invention include those encoded by the disclosed polynucleotides. These polypeptides can also be encoded by nucleic acids that, by virtue of the degeneracy of the genetic code, are not identical in sequence to the disclosed polynucleotides. Thus, the invention includes within its scope a polypeptide encoded by a polynucleotide having the sequence of any one of "SEQ ID NOS:1–5252" or a variant thereof.

In general, the term "polypeptide" as used herein refers to both the full length polypeptide encoded by the recited polynucleotide, the polypeptide encoded by the gene represented by the recited polynucleotide, as well as portions or fragments thereof. "Polypeptides" also includes variants of the naturally occurring proteins, where such variants are homologous or substantially similar to the naturally occurring protein, and can be of an origin of the same or different species as the naturally occurring protein (e.g., human, murine, or some other species that naturally expresses the recited polypeptide, usually a mammalian species). In general, variant polypeptides have a sequence that has at least about 80%, usually at least about 90%, and more usually at least about 98% sequence identity with a differentially expressed polypeptide of the invention, as measured by BLAST using the parameters described above. The variant polypeptides can be naturally or non-naturally glycosylated, i.e., the polypeptide has a glycosylation pattern that differs from the glycosylation pattern found in the corresponding naturally occurring protein.

The invention also encompasses homologs of the disclosed polypeptides (or fragments thereof) where the homologs are isolated from other species, i.e. other animal or plant species, where such homologs, usually mammalian species, e.g. rodents, such as mice, rats; domestic animals, e.g., horse, cow, dog, cat; and humans. By homolog is meant a polypeptide having at least about 35%, usually at least about 40% and more usually at least about 60% amino acid sequence identity a particular differentially expressed protein as identified above, where sequence identity is determined using the BLAST algorithm, with the parameters described supra.

In general, the polypeptides of the subject invention are provided in a non-naturally occurring environment, e.g. are separated from their naturally occurring environment. In certain embodiments, the subject protein is present in a composition that is enriched for the protein as compared to a control. As such, purified polypeptide is provided, where by purified is meant that the protein is present in a composition that is substantially free of non-differentially expressed polypeptides, where by substantially free is meant that less than 90%, usually less than 60% and more usually less than 50% of the composition is made up of non-differentially expressed polypeptides.

Also within the scope of the invention are variants; variants of polypeptides include mutants, fragments, and fusions. Mutants can include amino acid substitutions, additions or deletions. The amino acid substitutions can be conservative amino acid substitutions or substitutions to eliminate non-essential amino acids, such as to alter a glycosylation site, a phosphorylation site or an acetylation site, or to minimize misfolding by substitution or deletion of one or more cysteine residues that are not necessary for function. Conservative amino acid substitutions are those that preserve the general charge, hydrophobicity/hydrophilicity, and/or steric bulk of the amino acid substituted. For example, substitutions between the following groups are conservative: Gly/Ala, Val/Ile/Leu, Asp/Glu, Lys/Arg, Asn/Gln, Ser/Cys, Thr, and Phe/Trp/Tyr.

Variants can be designed so as to retain biological activity of a particular region of the protein (e.g., a functional domain and/or, where the polypeptide is a member of a protein family, a region associated with a consensus sequence). In a non-limiting example, Osawa et al., *Biochem Mol. Int.* (1994) 34:1003, discusses the actin binding region of a protein from several different species. The actin binding regions of the these species are considered homologous based on the fact that they have amino acids that fall within "homologous residue groups." Homologous residues are judged according to the following groups (using single letter amino acid designations): STAG; ILVMF; HRK; DEQN; and FYW. For example, and S, a T, an A or a G can be in a position and the function (in this case actin binding) is retained.

Additional guidance on amino acid substitution is available from studies of protein evolution. Go et al., *Int. J. Peptide Protein Res.* (1980) 15:211, classified amino acid residue sites as interior or exterior depending on their accessibility. More frequent substitution on exterior sites was confirmed to be general in eight sets of homologous protein families regardless of their biological functions and the presence or absence of a prosthetic group. Virtually all types of amino acid residues had higher mutabilities on the exterior than in the interior. No correlation between mutability and polarity was observed of amino acid residues in the interior and exterior, respectively. Amino acid residues were classified into one of three groups depending on their polarity: polar (Arg, Lys, His, Gln, Asn, Asp, and Glu); weak polar (Ala, Pro, Gly, Thr, and Ser), and nonpolar (Cys, Val, Met, Ile, Leu, Phe, Tyr, and Trp). Amino acid replacements during protein evolution were very conservative: 88% and 76% of them in the interior or exterior, respectively, were within the same group of the three. Inter-group replacements are such that weak polar residues are replaced more often by nonpolar residues in the interior and more often by polar residues on the exterior.

Additional guidance for production of polypeptide variants is provided in Querol et al., *Prot. Eng.* (1996) 9:265, which provides general rules for amino acid substitutions to enhance protein thermostability. New glycosylation sites can be introduced as discussed in Olsen and Thomsen, *J. Gen. Microbiol.* (1991) 137:579. An additional disulfide bridge can be introduced, as discussed by Perry and Wetzel, *Science* (1984) 226:555; Pantoliano et al., *Biochemistry* (1987) 26:2077; Matsumura et al., *Nature* (1989) 342:291; Nishikawa et al., *Protein Eng.* (1990) 3:443; Takagi et al., *J. Biol. Chem.* (1990) 265:6874; Clarke et al., *Biochemistry* (1993) 32:4322; and Wakarchuk et al., *Protein Eng.* (1994) 7:1379. Metal binding sites can be introduced, according to Toma et al., *Biochemistry* (1991) 30:97, and Haezerbrouck et al., *Protein Eng.* (1993) 6:643. Substitutions with prolines in loops can be made according to Masul et al., *Appl. Env. Microbiol.* (1994) 60:3579; and Hardy et al., *FEBS Lett.* 317:89.

Cysteine-depleted muteins are considered variants within the scope of the invention. These variants can be constructed according to methods disclosed in U.S. Pat. No. 4,959,314, which discloses substitution of cysteines with other amino acids, and methods for assaying biological activity and effect of the substitution. Such methods are suitable for proteins according to this invention that have cysteine residues suitable for such substitutions, for example to eliminate disulfide bond formation.

Variants also include fragments of the polypeptides disclosed herein, particularly biologically active fragments and/or fragments corresponding to functional domains. Fragments of interest will typically be at least about 10 aa to at least about 15 aa in length, usually at least about 50 aa in length, and can be as long as 300 aa in length or longer, but will usually not exceed about 1000 aa in length, where the fragment will have a stretch of amino acids that is identical to a polypeptide encoded by a polynucleotide having a sequence of any "SEQ ID NOS:1–5252", or a homolog thereof.

The protein variants described herein are encoded by polynucleotides that are within the scope of the invention. The genetic code can be used to select the appropriate codons to construct the corresponding variants.

VI. Computer-related Embodiments

In general, a library of polynucleotides is a collection of sequence information, which information is provided in either biochemical form (e.g., as a collection of polynucleotide molecules), or in electronic form (e.g., as a collection of polynucleotide sequences stored in a computer-readable form, as in a computer system and/or as part of a computer program). The sequence information of the polynucleotides can be used in a variety of ways, e.g., as a resource for gene discovery, as a representation of sequences expressed in a selected cell type (e.g., cell type markers), and/or as markers of a given disease or disease state. In general, a disease marker is a representation of a gene product that is present in all cells affected by disease either at an increased or decreased level relative to a normal cell (e.g., a cell of the same or similar type that is not substantially affected by disease). For example, a polynucleotide sequence in a library can be a polynucleotide that represents an mRNA, polypeptide, or other gene product encoded by the polynucleotide, that is either overexpressed or underexpressed in a breast ductal cell affected by cancer relative to a normal (i.e., substantially disease-free) breast cell.

The nucleotide sequence information of the library can be embodied in any suitable form, e.g., electronic or biochemical forms. For example, a library of sequence information embodied in electronic form includes an accessible computer data file (or, in biochemical form, a collection of nucleic acid molecules) that contains the representative nucleotide sequences of genes that are differentially expressed (e.g., overexpressed or underexpressed) as between, for example, i) a cancerous cell and a normal cell; ii) a cancerous cell and a dysplastic cell; iii) a cancerous cell and a cell affected by a disease or condition other than cancer; iv) a metastatic cancerous cell and a normal cell and/or non-metastatic cancerous cell; v) a malignant cancerous cell and a non-malignant cancerous cell (or a normal cell) and/or vi) a dysplastic cell relative to a normal cell. Other combinations and comparisons of cells affected by various diseases or stages of disease will be readily apparent to the ordinarily skilled artisan. Biochemical embodiments of the library include a collection of nucleic acids that have the sequences of the genes in the library, where the nucleic acids can correspond to the entire gene in the library or to a fragment thereof, as described in greater detail below.

The polynucleotide libraries of the subject invention include sequence information of a plurality of polynucleotide sequences, where at least one of the polynucleotides has a sequence of any of "SEQ ID NOS:1–5252." By plurality is meant at least 2, usually at least and can include up to all of "SEQ ID NOS:1–5252." The length and number of polynucleotides in the library will vary with the nature of the library, e.g., if the library is an oligonucleotide array, a cDNA array, a computer database of the sequence information, etc.

Where the library is an electronic library, the nucleic acid sequence information can be present in a variety of media. "Media" refers to a manufacture, other than an isolated nucleic acid molecule, that contains the sequence information of the present invention. Such a manufacture provides the genome sequence or a subset thereof in a form that can be examined by means not directly applicable to the sequence as it exists in a nucleic acid. For example, the nucleotide sequence of the present invention, e.g. the nucleic acid sequences of any of the polynucleotides of "SEQ ID NOS:1–5252," can be recorded on computer readable media, e.g. any medium that can be read and accessed directly by a computer. Such media include, but are not limited to: magnetic storage media, such as a floppy disc, a hard disc storage medium, and a magnetic tape; optical storage media such as CD-ROM; electrical storage media such as RAM and ROM; and hybrids of these categories such as magnetic/optical storage media. One of skill in the art can readily appreciate how any of the presently known computer readable mediums can be used to create a manufacture comprising a recording of the present sequence information. "Recorded" refers to a process for storing information on computer readable medium, using any such methods as known in the art. Any convenient data storage structure can be chosen, based on the means used to access the stored information. A variety of data processor programs and formats can be used for storage, e.g. word processing text file, database format, etc. In addition to the sequence information, electronic versions of the libraries of the invention can be provided in conjunction or connection with other computer-readable information and/or other types of computer-readable files (e.g., searchable files, executable files, etc, including, but not limited to, for example, search program software, etc.).

By providing the nucleotide sequence in computer readable form, the information can be accessed for a variety of purposes. Computer software to access sequence information is publicly available. For example, the BLAST (Altschul et al., supra.) and BLAZE (Brutlag et al. *Comp. Chem.* (1993) 17:203) search algorithms on a Sybase system can be used to identify open reading frames (ORFs) within the genome that contain homology to ORFs from other organisms.

As used herein, "a computer-based system" refers to the hardware means, software means, and data storage means used to analyze the nucleotide sequence information of the present invention. The minimum hardware of the computer-based systems of the present invention comprises a central processing unit (CPU), input means, output means, and data storage means. A skilled artisan can readily appreciate that any one of the currently available computer-based system are suitable for use in the present invention. The data storage means can comprise any manufacture comprising a recording of the present sequence information as described above, or a memory access means that can access such a manufacture.

"Search means" refers to one or more programs implemented on the computer-based system, to compare a target sequence or target structural motif with the stored sequence information. Search means are used to identify fragments or regions of the genome that match a particular target sequence or target motif. A variety of known algorithms are publicly known and commercially available, e.g. MacPattern (EMBL), BLASTN and BLASTX (NCBI). A "target sequence" can be any DNA or amino acid sequence of six or more nucleotides or two or more amino acids, preferably from about 10 to 100 amino acids or from about 30 to 300 nucleotide residues.

A "target structural motif," or "target motif," refers to any rationally selected sequence or combination of sequences in which the sequence(s) are chosen based on a three-dimensional configuration that is formed upon the folding of the target motif, or on consensus sequences of regulatory or active sites. There are a variety of target motifs known in the art. Protein target motifs include, but are not limited to, enzyme active sites and signal sequences. Nucleic acid target motifs include, but are not limited to, hairpin structures, promoter sequences and other expression elements such as binding sites for transcription factors.

A variety of structural formats for the input and output means can be used to input and output the information in the computer-based systems of the present invention. One format for an output means ranks fragments of the genome possessing varying degrees of homology to a target sequence or target motif. Such presentation provides a skilled artisan with a ranking of sequences and identifies the degree of sequence similarity contained in the identified fragment.

A variety of comparing means can be used to compare a target sequence or target motif with the data storage means to identify sequence fragments of the genome. A skilled artisan can readily recognize that any one of the publicly available homology search programs can be used as the search means for the computer based systems of the present invention.

As discussed above, the "library" of the invention also encompasses biochemical libraries of the polynucleotides of "SEQ ID NOS:1–5252," e.g., collections of nucleic acids representing the provided polynucleotides. The biochemical libraries can take a variety of forms, e.g., a solution of cDNAs, a pattern of probe nucleic acids stably associated with a surface of a solid support (i.e., an array) and the like. Of particular interest are nucleic acid arrays in which one or more of "SEQ ID NOS:1–5252" is represented on the array. By array is meant a an article of manufacture that has at least a substrate with at least two distinct nucleic acid targets on one of its surfaces, where the number of distinct nucleic acids can be considerably higher, typically being at least 10 nt, usually at least 20 nt and often at least 25 nt. A variety of different array formats have been developed and are known to those of skill in the art, including those described in U.S. Pat. No. 5,242,974; 5,384,261; 5,405,783; 5,412,087; 5,424,186; 5,429,807; 5,436,327; 5,445,934; 5,472,672; 5,527,681; 5,529,756; 5,545,531; 5,554,501; 5,556,752; 5,561,071; 5,599,895; 5,624,711; 5,639,603; 5,658,734; WO 93/17126; WO 95/11995; WO 95/35505; EP 742287; and EP 799897. The arrays of the subject invention find use in a variety of applications, including gene expression analysis, drug screening, mutation analysis and the like, as disclosed in the above-listed exemplary patent documents.

In addition to the above nucleic acid libraries, analogous libraries of polypeptides are also provided, where the where the polypeptides of the library will represent at least a portion of the polypeptides encoded by "SEQ ID NOS:1–5252."

VII. Utilities

A. Use of Polynucleotide Probes in Mapping, and in Tissue Profiling

Polynucleotide probes, generally comprising at least 12 contiguous nucleotides of a polynucleotide as shown in the Sequence Listing, are used for a variety of purposes, such as chromosome mapping of the polynucleotide and detection of transcription levels. Additional disclosure about preferred regions of the disclosed polynucleotide sequences is found in the Examples. A probe that hybridizes specifically to a polynucleotide disclosed herein should provide a detection signal at least 5-, 10-, or 20-fold higher than the background hybridization provided with other unrelated sequences.

Probes in Detection of Expression Levels. Nucleotide probes are used to detect expression of a gene corresponding to the provided polynucleotide. In Northern blots, mRNA is separated electrophoretically and contacted with a probe. A probe is detected as hybridizing to an mRNA species of a particular size. The amount of hybridization is quantitated to determine relative amounts of expression, for example under a particular condition. Probes are used for in situ hybridization to cells to detect expression. Probes can also be used in vivo for diagnostic detection of hybridizing sequences. Probes are typically labeled with a radioactive isotope. Other types of detectable labels can be used such as chromophores, fluors, and enzymes. Other examples of nucleotide hybridization assays are described in WO92/02526 and U.S. Pat. No. 5,124,246.

The Polymerase Chain Reaction (PCR) is another means for detecting small amounts of target nucleic acids (see, e.g., Mullis et al., *Meth. Enzymol.* (1987) 155:335; U.S. Pat. No. 4,683,195; and U.S. Pat. No. 4,683,202). Two primer polynucleotides nucleotides hybridize with the target nucleic acids and are used to prime the reaction. The primers can be composed of sequence within or 3' and 5' to the polynucleotides of the Sequence Listing. Alternatively, if the primers are 3' and 5' to these polynucleotides, they need not hybridize to them or the complements. A thermostable polymerase creates copies of target nucleic acids from the primers using the original target nucleic acids as a template. After a large amount of target nucleic acids is generated by the polymerase, it is detected by methods such as Southern blots. When using the Southern blot method, the labeled probe will hybridize to a polynucleotide of the Sequence Listing or complement.

Furthermore, mRNA or cDNA can be detected by traditional blotting techniques described in Sambrook et al., "Molecular Cloning: A Laboratory Manual" (New York, Cold Spring Harbor Laboratory, 1989). mRNA or cDNA generated from mRNA using a polymerase enzyme can be purified and separated using gel electrophoresis. The nucleic acids on the gel are then blotted onto a solid support, such as nitrocellulose. The solid support is exposed to a labeled probe and then washed to remove any unhybridized probe. Next, the duplexes containing the labeled probe are detected. Typically, the probe is labeled with radioactivity.

Mapping. Polynucleotides of the present invention are used to identify a chromosome on which the corresponding gene resides. Such mapping can be useful in identifying the function of the polynucleotide-related gene by its proximity to other genes with known function. Function can also be assigned to the polynucleotide-related gene when particular syndromes or diseases map to the same chromosome. For example, use of polynucleotide probes in identification and quantification of nucleic acid sequence aberrations is described in U.S. Pat. No. 5,783,387.

For example, fluorescence in situ hybridization (FISH) on normal metaphase spreads facilitates comparative genomic hybridization to allow total genome assessment of changes in relative copy number of DNA sequences. See Schwartz and Samad, *Curr. Opin. Biotechnol.* (1994) 8:70; Kallioniemi et al., *Sem. Cancer Biol.* (1993) 4:41; Valdes et al., *Methods in Molecular Biology* (1997) 68:1, Boultwood, ed., Human Press, Totowa, N.J.

Polynucleotides are mapped to particular chromosomes using, for example, radiation hybrids or chromosome-specific hybrid panels. See Leach et al., *Advances in Genetics*, (1995) 33:63–99; Walter et al., *Nature Genetics* (1994) 7:22; Walter and Goodfellow, *Trends in Genetics* (1992) 9:352. Panels for radiation hybrid mapping are available from Research Genetics, Inc., Huntsville, Ala., USA. Databases for markers using various panels are available via the world wide web at http://F/shgc-www.stanford.edu; and http://www-penome.wi.mit.edu/cpi-bin/contig/rhmapper.pl. The statistical program RHMAP can be used to construct a map based on the data from radiation hybridization with a measure of the relative likelihood of one order versus another. RHMAP is available via the world wide web at http://www.sph.umich.edu/group/statgen/software.

In addition, commercial programs are available for identifying regions of chromosomes commonly associated with disease, such as cancer. Polynucleotides based on the polynucleotides of the invention can be used to probe these regions. For example, if through profile searching a provided polynucleotide is identified as corresponding to a gene encoding a kinase, its ability to bind to a cancer-related chromosomal region will suggest its role as a kinase in one or more stages of tumor cell development/growth. Although some experimentation would be required to elucidate the role, the polynucleotide constitutes a new material for isolating a specific protein that has potential for developing a cancer diagnostic or therapeutic.

Tissue Typing or Profiling. Expression of specific mRNA corresponding to the provided polynucleotides can vary in different cell types and can be tissue-specific. This variation of mRNA levels in different cell types can be exploited with nucleic acid probe assays to determine tissue types. For example, PCR, branched DNA probe assays, or blotting techniques utilizing nucleic acid probes substantially identical or complementary to polynucleotides listed in the Sequence Listing can determine the presence or absence of the corresponding cDNA or mRNA.

For example, a metastatic lesion is identified by its developmental organ or tissue source by identifying the expression of a particular marker of that organ or tissue. If a polynucleotide is expressed only in a specific tissue type, and a metastatic lesion is found to express that polynucleotide, then the developmental source of the lesion has been identified. Expression of a particular polynucleotide is assayed by detection of either the corresponding mRNA or the protein product. Immunological methods, such as antibody staining, are used to detect a particular protein product. Hybridization methods can be used to detect particular mRNA species, including but not limited to in situ hybridization and Northern blotting.

Use of Polymorphisms. A polynucleotide of the invention will be useful in forensics, genetic analysis, mapping, and diagnostic applications if the corresponding region of a gene is polymorphic in the human population. Particular polymorphic forms of the provided polynucleotides can be used to either identify a sample as deriving from a suspect or rule out the possibility that the sample derives from the suspect. Any means for detecting a polymorphism in a gene are used, including but not limited to electrophoresis of protein polymorphic variants, differential sensitivity to restriction enzyme cleavage, and hybridization to allele-specific probes.

B. Antibody Production

Expression products of a polynucleotide of the invention, the corresponding mRNA or cDNA, or the corresponding complete gene are prepared and used for raising antibodies for experimental, diagnostic, and therapeutic purposes. For polynucleotides to which a corresponding gene has not been assigned, this provides an additional method of identifying the corresponding gene. The polynucleotide or related cDNA is expressed as described above, and antibodies are prepared. These antibodies are specific to an epitope on the polypeptide encoded by the polynucleotide, and can precipitate or bind to the corresponding native protein in a cell or tissue preparation or in a cell-free extract of an in vitro expression system.

Immunogens for raising antibodies are prepared by mixing the polypeptides encoded by the polynucleotides of the present invention with adjuvants. Alternatively, polypeptides are made as fusion proteins to larger immunogenic proteins. Polypeptides are also covalently linked to other larger immunogenic proteins, such as keyhole limpet hemocyanin. Immunogens are typically administered intradermally, subcutaneously or intramuscularly. Immunogens are administered to experimental animals such as rabbits, sheep, and mice, to generate antibodies. Optionally, the animal spleen cells are isolated and fused with myeloma cells to form hybridomas which secrete monoclonal antibodies. Such methods are well known in the art. According to another method known in the art, the selected polynucleotide is administered directly, such as by intramuscular injection, and expressed in vivo. The expressed protein generates a variety of protein-specific immune responses, including production of antibodies, comparable to administration of the protein.

Preparations of polyclonal and monoclonal antibodies specific for polypeptides encoded by a selected polynucleotide are made using standard methods known in the art. The antibodies specifically bind to epitopes present in the polypeptides encoded by polynucleotides disclosed in the Sequence Listing. Typically, at least 6, 8, 10, or 12 contiguous amino acids are required to form an epitope. However, epitopes which involve non-contiguous amino acids may require more, for example at least 15, 25, or 50 amino acids. A short sequence of a polynucleotide may then be unsuitable for use as an epitope to raise antibodies for identifying the corresponding novel protein, because of the potential for cross-reactivity with a known protein. However, the antibodies can be useful for other purposes, particularly if they identify common structural features of a known protein and a novel polypeptide encoded by a polynucleotide of the invention.

Antibodies that specifically bind to human polypeptides encoded by the provided polypeptides should provide a detection signal at least 5-, 10-, or 20-fold higher than a detection signal provided with other proteins when used in Western blots or other immunochemical assays. Preferably, antibodies that specifically polypeptides of the invention do not bind to other proteins in immunochemical assays at detectable levels and can immunoprecipitate the specific polypeptide from solution.

To test for the presence of serum antibodies to the polypeptide of the invention in a human population, human antibodies are purified by methods well known in the art. Preferably, the antibodies are affinity purified by passing antiserum over a column to which the corresponding selected polypeptide or fusion protein is bound. The bound antibodies can then be eluted from the column, for example using a buffer with a high salt concentration.

In addition to the antibodies discussed above, genetically engineered antibody derivatives are made, such as single chain antibodies, according to methods well known in the art.

C. Use of Polynucleotides to Construct Arrays for Diagnostics

Polynucleotide arrays provide a high throughput technique that can assay a large number of polynucleotide sequences in a sample. This technology can be used as a diagnostic and as a tool to test for differential expression to determine function of an encoded protein. Arrays can be created by spotting polynucleotide probes onto a substrate (e.g., glass, nitrocellulose, etc.) in a two-dimensional matrix or array having bound probes. The probes can be bound to the substrate by either covalent bonds or by non-specific interactions, such as hydrophobic interactions. Samples of polynucleotides can be detectably labeled (e.g., using radioactive or fluorescent labels) and then hybridized to the probes. Double stranded polynucleotides, comprising the labeled sample polynucleotides bound to probe polynucleotides, can be detected once the unbound portion of the sample is washed away. Techniques for constructing arrays and methods of using these arrays are described in EP No. 0 799 897; PCT No. WO 97/29212; PCT No. WO 97/27317; EP No. 0 785 280; PCT No. WO 97/02357; U.S. Pat. No. 5,593,839; U.S. Pat. No. 5,578,832; EP No. 0 728 520; U.S. Pat. No. 5,599,695; EP No. 0 721 016; U.S. Pat. No. 5,556,752; PCT No. WO 95/22058; and U.S. Pat. No. 5,631,734.

As discussed in some detail above, arrays can be used to examine differential expression of genes and can be used to determine gene function. For example, arrays of the instant polynucleotide sequences can be used to determine if any of the provided polynucleotides are differentially expressed between a test cell and control cell (e.g., cancer cells and normal cells). For example, high expression of a particular message in a cancer cell, which is not observed in a corresponding normal cell, can indicate a cancer specific protein. Exemplary uses of arrays are further described in, for example, Pappalarado et al., *Sem. Radiation Oncol.* (1998) 8:217; and Rarmsay *Nature Biotechnol.* (1998) 16:40.

D. Differential Expression

The polynucleotides of the invention can also be used to detect differences in expression levels between two cells, e.g., as a method to identify abnormal or diseased tissue in a human. For polynucleotides corresponding to profiles of protein families, the choice of tissue can be selected according to the putative biological function. In general, the expression of a gene corresponding to a specific polynucleotide is compared between a first tissue that is suspected of being diseased and a second, normal tissue of the human. The tissue suspected of being abnormal or diseased can be derived from a different tissue type of the human, but preferably it is derived from the same tissue type; for example an intestinal polyp or other abnormal growth should be compared with normal intestinal tissue. The normal tissue can be the same tissue as that of the test sample, or any normal tissue of the patient, especially those that express the polynucleotide-related gene of interest (e.g., brain, thymus, testis, heart, prostate, placenta, spleen, small intestine, skeletal muscle, pancreas, and the mucosal lining of the colon). A difference between the polynucleotide-related gene, mRNA, or protein in the two tissues which are compared, for example in molecular weight, amino acid or nucleotide sequence, or relative abundance, indicates a change in the gene, or a gene which regulates it, in the tissue of the human that was suspected of being diseased. Examples of detection of differential expression and its use in diagnosis of cancer are described in U.S. Pat. Nos. 5,688,641 and 5,677,125.

The polynucleotide-related genes in the two tissues are compared by any means known in the art. For example, the two genes can be sequenced, and the sequence of the gene in the tissue suspected of being diseased compared with the gene sequence in the normal tissue. The genes corresponding to a provided polynucleotide, or portions thereof, in the two tissues are amplified, for example using nucleotide primers based on the nucleotide sequence shown in the Sequence Listing, using the polymerase chain reaction. The amplified genes or portions of genes are hybridized to detectably labeled nucleotide probes selected from a nucleotide sequence shown in the Sequence Listing. A difference in the nucleotide sequence of the isolated gene in the tissue suspected of being diseased compared with the normal nucleotide sequence suggests a role of the gene product encoded by the subject polynucleotide in the disease, and provides guidance for preparing a therapeutic agent.

Alternatively, mRNA corresponding to a provided polynucleotide in the two tissues is compared. PolyA+ RNA is isolated from the two tissues as is known in the art. For example, one of skill in the art can readily determine differences in the size or amount of mRNA transcripts between the two tissues using Northern blots and detectably labeled nucleotide probes selected from the nucleotide sequence shown in the Sequence Listing. Increased or decreased expression of a given mRNA in a tissue sample suspected of being diseased, compared with the expression of the same mRNA in a normal tissue, suggests that the expressed protein has a role in the disease, and also provides a lead for preparing a therapeutic agent.

The comparison can also be accomplished by analyzing polypeptides between the matched samples. The sizes of the proteins in the two tissues are compared, for example, using antibodies of the present invention to detect polypeptides in Western blots of protein extracts from the two tissues. Other changes, such as expression levels and subcellular localization, can also be detected immunologically, using antibodies to the corresponding protein. A higher or lower level of expression of a given polypeptide in a tissue suspected of being diseased, compared with the same protein expression level in a normal tissue, is indicative that the expressed protein has a role in the disease, and provides guidance for preparing a therapeutic agent.

Similarly, comparison of polynucleotide sequences or of gene expression products, e.g., mRNA and protein, between a human tissue that is suspected of being diseased and a normal tissue of a human, are used to follow disease progression or remission in the human. Such comparisons are made as described above. For example, increased or decreased expression of a gene corresponding to an inventive polynucleotide in the tissue suspected of being neoplastic can indicate the presence of neoplastic cells in the tissue. The degree of increased expression of a given gene in the neoplastic tissue relative to expression of the same gene in normal tissue, or differences in the amount of increased expression of a given gene in the neoplastic tissue over time, is used to assess the progression of the neoplasia in that tissue or to monitor the response of the neoplastic tissue to a therapeutic protocol over time.

The expression pattern of any two cell types can be compared, such as low and high metastatic tumor cell lines, malignant or non-malignant cells, or cells from tissue which have and have not been exposed to a therapeutic agent. A genetic predisposition to disease in a human is detected by comparing expression levels of an mRNA or protein corresponding to a polynucleotide of the invention in a fetal tissue with levels associated in normal fetal tissue. Fetal tissues that are used for this purpose include, but are not limited to, amniotic fluid, chorionic villi, blood, and the blastomere of an in vitro-fertilized embryo. The comparable normal polynucleotide-related gene is obtained from any tissue. The mRNA or protein is obtained from a normal tissue of a human in which the polynucleotide-related gene is expressed. Differences such as alterations in the nucleotide sequence or size of the same product of the fetal polynucleotide-related gene or mRNA, or alterations in the molecular weight, amino acid sequence, or relative abundance of fetal protein, can indicate a germline mutation in the polynucleotide-related gene of the fetus, which indicates a genetic predisposition to disease. Particular diagnostic and prognostic uses of the disclosed polynucleotides are described in more detail below.

E. Diagnostic, Prognostic, and Other Uses Based on Differential Expression

In general, diagnostic methods of the invention for involve detection of a level or amount of a gene product, particularly a differentially expressed gene product, in a test sample obtained from a patient suspected of having or being susceptible to a disease (e.g., breast cancer, lung cancer, colon cancer and/or metastatic forms thereof), and comparing the detected levels to those levels found in normal cells (e.g., cells substantially unaffected by cancer) and/or other control cells (e.g., to differentiate a cancerous cell from a cell affected by dysplasia). Furthermore, the severity of the disease can be assessed by comparing the detected levels of a differentially expressed gene product with those levels detected in samples representing the levels of differentially gene product associated with varying degrees of severity of disease.

The term "differentially expressed gene" is intended to encompass a polynucleotide that can, for example; include an open reading frame encoding a gene product (e.g., a polypeptide), and/or introns of such genes and adjacent 5' and 3' non-coding nucleotide sequences involved in the regulation of expression, up to about 20 kb beyond the coding region, but possibly further in either direction. The gene can be introduced into an appropriate vector for extrachromosomal maintenance or for integration into a host genome. In general, a difference in expression level associated with a decrease in expression level of at least about 25%, usually at least about 50% to 75%, more usually at least about 90% or more is indicative of a differentially expressed gene of interest, i.e., a gene that is underexpressed or down-regulated in the test sample relative to a control sample. Furthermore, a difference in expression level associated with an increase in expression of at least about 25%, usually at least about 50% to 75%, more usually at least about 90% and can be at least about 1½-fold, usually at least about 2-fold to about 10-fold, and can be about 100-fold to about 1,000-fold increase relative to a control sample is indicative of a differentially expressed gene of interest, i.e., an overexpressed or up-regulated gene.

"Differentially expressed polynucleotide" as used herein means a nucleic acid molecule (RNA or DNA) having a sequence that represents a differentially expressed gene, e.g., the differentially expressed polynucleotide comprises a sequence (e.g., an open reading frame encoding a gene product) that uniquely identifies a differentially expressed gene so that detection of the differentially expressed polynucleotide in a sample is correlated with the presence of a differentially expressed gene in a sample. "Differentially expressed polynucleotides" is also meant to encompass fragments of the disclosed polynucleotides, e.g., fragments retaining biological activity, as well as nucleic acids homologous, substantially similar, or substantially identical (e.g., having about 90% sequence identity) to the disclosed polynucleotides.

Methods of the subject invention useful in diagnosis or prognosis typically involve comparison of the abundance of a selected differentially expressed gene product in a sample of interest with that of a control to determine any relative differences in the expression of the gene product, where the difference can be measured qualitatively and/or quantitatively. Quantitation can be accomplished, for example, by comparing the level of expression product detected in the sample with the amounts of product present in a standard curve. A comparison can be made visually; by using a technique such as densitometry, with or without computerized assistance; by preparing a representative library of cDNA clones of mRNA isolated from a test sample, sequencing the clones in the library to determine that number of cDNA clones corresponding to the same gene product, and analyzing the number of clones corresponding to that same gene product relative to the number of clones of the same gene product in a control sample; or by using an array to detect relative levels of hybridization to a selected sequence or set of sequences, and comparing the hybridization pattern to that of a control. The differences in expression are then correlated with the presence or absence of an abnormal expression pattern. A variety of different methods for determining the nucleic acid abundance in a sample are known to those of skill in the art, where particular methods of interest include those described in: Pietu et al., *Genome Res.* (1996) 6:492; Zhao et al., *Gene* (1995) 156:207; Soares, *Curr. Opin. Biotechnol.* (1977) 8: 542; Raval, *J. Pharmacol Toxicol Methods* (1994) 32:125; Chalifour et at., *Anal. Biochem* (1994) 216:299; Stolz et al., *Mol. Biolechnol.* (1996) 6:225; Hong et al., *Biosci. Reports* (1982) 2:907; and McGraw, *Anal. Biochem.* (1984) 143:298. Also of interest are the methods disclosed in WO 97/27317, the disclosure of which is herein incorporated by reference.

In general, diagnostic assays of the invention involve detection of a gene product of a the polynucleotide sequence (e.g., mRNA or polypeptide) that corresponds to a sequence of "SEQ ID NOS:1–5252." The patient from whom the sample is obtained can be apparently healthy, susceptible to disease (e.g., as determined by family history or exposure to certain environmental factors), or can already be identified as having a condition in which altered expression of a gene product of the invention is implicated.

In the assays of the invention, the diagnosis can be determined based on detected gene product expression levels of a gene product encoded by at least one, preferably at least two or more, at least 3 or more, or at least 4 or more of the polynucleotides having a sequence set forth in "SEQ ID NOS:1–5252," and can involve detection of expression of genes corresponding to all of "SEQ ID NOS:1–5252" and/or additional sequences that can serve as additional diagnostic markers and/or reference sequences. Where the diagnostic method is designed to detect the presence or susceptibility of a patient to cancer, the assay preferably involves detection of a gene product encoded by a gene corresponding to a polynucleotide that is differentially expressed in cancer. For example, a higher level of expression of a polynucleotide corresponding to SEQ ID NO:2024 relative to a level associated with a normal sample can indicate the presence of cancer in the patient from whom the sample is derived. In another example, detection of a lower level of a polynucleotide corresponding to SEQ ID NO:590 relative to a normal level is indicative of the presence of cancer in the patient. Further examples of such differentially expressed polynucleotides are described in the Examples below. Given the provided polynucleotides and information regarding their relative expression levels provided herein, assays using such polynucleotides and detection of their expression levels in diagnosis and prognosis will be readily apparent to the ordinarily skilled artisan.

Any of a variety of detectable labels can be used in connection with the various embodiments of the diagnostic methods of the invention. Suitable detectable labels include fluorochromes,(e.g. fluorescein isothiocyanate (FITC), rhodamine, Texas Red, phycoerythrin, allophycocyanin, 6-carboxyfluorescein (6-FAM), 2',7'-dimethoxy-4',5'-dichloro-6-carboxyfluorescein, 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA)), radioactive labels, (e.g. $^{32}$P, $^{35}$S, $^{3}$H, etc.), and the like. The detectable label can involve a two stage systems (e.g., biotin-avidin, hapten-anti-hapten antibody, etc.)

Reagents specific for the polynucleotides and polypeptides of the invention, such as antibodies and nucleotide probes, can be supplied in a kit for detecting the presence of an expression product in a biological sample. The kit can also contain buffers or labeling components, as well as instructions for using the reagents to detect and quantify expression products in the biological sample. Exemplary embodiments of the diagnostic methods of the invention are described below in more detail.

Polypeptide detection in diagnosis. In one embodiment, the test sample is assayed for the level of a differentially expressed polypeptide. Diagnosis can be accomplished using any of a number of methods to determine the absence or presence or altered amounts of the differentially expressed polypeptide in the test sample. For example, detection can utilize staining of cells or histological sections with labeled antibodies, performed in accordance with conventional methods. Cells can be permeabilized to stain cytoplasmic molecules. In general, antibodies that specifically bind a differentially expressed polypeptide of the invention are added to a sample, and incubated for a period of time sufficient to allow binding to the epitope, usually at least about 10 minutes. The antibody can be detectably labeled for direct detection (e.g., using radioisotopes, enzymes, fluorescers, chemiluminescers, and the like), or can be used in conjunction with a second stage antibody or reagent to detect binding (e.g., biotin with horseradish peroxidase-conjugated avidin, a secondary antibody conjugated to a fluorescent compound, e.g. fluorescein, rhodamine, Texas red, etc.). The absence or presence of antibody binding can be determined by various methods, including flow cytometry of dissociated cells, microscopy, radiography, scintillation counting, etc. Any suitable alternative methods can of qualitative or quantitative detection of levels or amounts of differentially expressed polypeptide can be used, for example ELISA, western blot, immunoprecipitation, radioimmunoassay, etc.

In general, the detected level of differentially expressed polypeptide in the test sample is compared to a level of the differentially expressed gene product in a reference or control sample, e.g., in a normal cell (negative control) or in a cell having a known disease state (positive control).

mRNA detection. The diagnostic methods of the invention can also or alternatively involve detection of mRNA encoded by a gene corresponding to a differentially expressed polynucleotides of the invention. Any suitable qualitative or quantitative methods known in the art for detecting specific mRNAs can be used. mRNA can be detected by, for example, in situ hybridization in tissue sections, by reverse transcriptase-PCR, or in Northern blots containing poly A+ mRNA. One of skill in the art can readily use these methods to determine differences in the size or amount of mRNA transcripts between two samples. For example, the level of mRNA of the invention in a tissue sample suspected of being cancerous or dysplastic is compared with the expression of the mRNA in a reference sample, e.g., a positive or negative control sample (e.g., normal tissue, cancerous tissue, etc.).

Any suitable method for detecting and comparing mRNA expression levels in a sample can be used in connection with the diagnostic methods of the invention (see, e.g., U.S. Pat. No. 5,804,382). For example, mRNA expression levels in a sample can be determined by generation of a library of expressed sequence tags (ESTs) from the sample, where the EST library is representative of sequences present in the sample (Adams, et al., (1991) *Science* 252:1651). Enumeration of the relative representation of ESTs within the library can be used to approximate the relative representation of the gene transcript within the starting sample. The results of EST analysis of a test sample can then be compared to EST analysis of a reference sample to determine the relative expression levels of a selected polynucleotide, particularly a polynucleotide corresponding to one or more of the differentially expressed genes described herein.

Alternatively, gene expression in a test sample can be performed using serial analysis of gene expression (SAGE) methodology (Velculescu et al., *Science* (1995) 70:484). In short, SAGE involves the isolation of short unique sequence tags from a specific location within each transcript. The sequence tags are concatenated, cloned, and sequenced. The frequency of particular transcripts within the starting sample is reflected by the number of times the associated sequence tag is encountered with the sequence population.

Gene expression in a test sample can also be analyzed using differential display (DD) methodology. In DD, fragments defined by specific sequence delimiters (e.g., restriction enzyme sites) are used as unique identifiers of genes, coupled with information about fragment length or fragment location within the expressed gene. The relative representation of an expressed gene with a sample can then be estimated based on the relative representation of the fragment associated with that gene within the pool of all possible fragments. Methods and compositions for carrying out DD are well known in the art, see, e.g., U.S. Pat. No. 5,776,683; and U.S. Pat. No. 5,807,680.

Alternatively, gene expression in a sample using hybridization analysis, which is based on the specificity of nucleotide interactions. Oligonucleotides or cDNA can be used to selectively identify or capture DNA or RNA of specific sequence composition, and the amount of RNA or cDNA hybridized to a known capture sequence determined qualitatively or quantitatively, to provide information about the relative representation of a particular message within the pool of cellular messages in a sample. Hybridization analysis can be designed to allow for concurrent screening of the relative expression of hundreds to thousands of genes by using, for example, array-based technologies having high density formats, including filters, microscope slides, or microchips, or solution-based technologies that use spectroscopic analysis (e.g., mass spectrometry). One exemplary use of arrays in the diagnostic methods of the invention is described below in more detail.

Use of a single gene in diagnostic applications. The diagnostic methods of the invention can focus on the expression of a single differentially expressed gene. For example, the diagnostic method can involve detecting a differentially expressed gene, or a polymorphism of such a gene (e.g., a polymorphism in an coding region or control region), that is associated with disease. Disease-associated polymorphisms can include deletion or truncation of the gene, mutations that alter expression level and/or affect activity of the encoded protein, etc.

Changes in the promoter or enhancer sequence that affect expression levels of an differentially gene can be compared to expression levels of the normal allele by various methods known in the art. Methods for determining promoter or enhancer strength include quantitation of the expressed natural protein; insertion of the variant control element into a vector with a reporter gene such as β-galactosidase, luciferase, chloramphenicol acetyltransferase, etc. that provides for convenient quantitation; and the like.

A number of methods are available for analyzing nucleic acids for the presence of a specific sequence, e.g. a disease associated polymorphism. Where large amounts of DNA are available, genomic DNA is used directly. Alternatively, the region of interest is cloned into a suitable vector and grown in sufficient quantity for analysis. Cells that express a differentially expressed gene can be used as a source of mRNA, which can be assayed directly or reverse transcribed into cDNA for analysis. The nucleic acid can be amplified by conventional techniques, such as the polymerase chain reaction (PCR), to provide sufficient amounts for analysis, and a detectable label can be included in the amplification reaction (e.g., using a detectably labeled primer or detectably labeled oligonucleotides) to facilitate detection. The use of the polymerase chain reaction is described in Saiki, et al., *Science* (1985) 239:487, and a review of techniques can be found in Sambrook, et al., *Molecular Cloning: A Laboratory Manual*, (1989) pp. 14.2. Alternatively, various methods are known in the art that utilize oligonucleotide ligation as a means of detecting polymorphisms, for examples see Riley et al., *Nucl. Acids Res.* (1990) 18:2887; and Delahunty et al., *Am. J. Hum. Genet.* (1996) 58:1239.

The sample nucleic acid, e.g. amplified or cloned fragment, is analyzed by one of a number of methods known in the art. The nucleic acid can be sequenced by dideoxy or other methods, and the sequence of bases compared to a selected sequence, e.g., to a wild-type sequence. Hybridization with the polymorphic or variant sequence can also be used to determine its presence in a sample (e.g., by Southern blot, dot blot, etc.). The hybridization pattern of a polymorphic or variant sequence and a control sequence to an array of oligonucleotide probes immobilized on a solid support, as described in U.S. Pat. No. 5,445,934, or in WO 95/35505, can also be used as a means of identifying polymorphic or variant sequences associated with disease. Single strand conformational polymorphism (SSCP) analysis, denaturing gradient gel electrophoresis (DGGE), and heteroduplex analysis in gel matrices are used to detect conformational changes created by DNA sequence variation as alterations in electrophoretic mobility. Alternatively, where a polymorphism creates or destroys a recognition site for a restriction endonuclease, the sample is digested with that endonuclease, and the products size fractionated to determine whether the fragment was digested. Fractionation is performed by gel or capillary electrophoresis, particularly acrylamide or agarose gels.

Screening for mutations in an differentially expressed gene can be based on the functional or antigenic characteristics of the protein. Protein truncation assays are useful in detecting deletions that can affect the biological activity of the protein. Various immunoassays designed to detect polymorphisms in proteins can be used in screening. Where many diverse genetic mutations lead to a particular disease phenotype, functional protein assays have proven to be effective screening tools. The activity of the encoded protein can be determined by comparison with the wild-type protein.

Pattern matching in diagnosis using arrays. In another embodiment, the diagnostic and/or prognostic methods of the invention involve detection of expression of a selected set of genes in a test sample to produce a test expression pattern (TEP). The TEP is compared to a reference expression pattern (REP), which is generated by detection of expression of the selected set of genes in a reference sample (e.g., a positive or negative control sample). The selected set of genes includes at least one of the genes of the invention, which genes correspond to the polynucleotide sequences of "SEQ ID NOS:1–5252." Of particular interest is a selected set of genes that includes gene differentially expressed in the disease for which the test sample is to be screened.

"Reference sequences" or "reference polynucleotides" as used herein in the context of differential gene expression analysis and diagnosis/prognosis refers to a selected set of polynucleotides, which selected set includes at least one or more of the differentially expressed polynucleotides described herein. A plurality of reference sequences, preferably comprising positive and negative control sequences, can be included as reference sequences. Additional suitable reference sequences are found in Genbank, Unigene, and other nucleotide sequence databases (including, e.g., expressed sequence tag (EST), partial, and full-length sequences).

"Reference array" means an array having reference sequences for use in hybridization with a sample, where the reference sequences include all, at least one of, or any subset of the differentially expressed polynucleotides described herein. Usually such an array will include at least 3 different reference sequences, and can include any one or all of the provided differentially expressed sequences. Arrays of interest can further comprise sequences, including polymorphisms, of other genetic sequences, particularly other sequences of interest for screening for a disease or disorder (e.g., cancer, dysplasia, or other related or unrelated diseases, disorders, or conditions). The oligonucleotide sequence on the array will usually be at least about 12 nt in length, and can be of about the length of the provided sequences, or can extend into the flanking regions to generate fragments of 100 nt to 200 nt in length or more.

A "reference expression pattern" or "REP" as used herein refers to the relative levels of expression of a selected set of genes, particularly of differentially expressed genes, that is associated with a selected cell type, e.g., a normal cell, a cancerous cell, a cell exposed to an environmental stimulus, and the like. A "test expression pattern" or "TEP" refers to relative levels of expression of a selected set of genes, particularly of differentially expressed genes, in a test sample (e.g., a cell of unknown or suspected disease state, from which mRNA is isolated).

"Diagnosis" as used herein generally includes determination of a subject's susceptibility to a disease or disorder, determination as to whether a subject is presently affected by a disease or disorder, as well as to the prognosis of a subject affected by a disease or disorder (e.g., identification of pre-metastatic or metastatic cancerous states, stages of cancer, or responsiveness of cancer to therapy). The present invention particularly encompasses diagnosis of subjects in the context of breast cancer (e.g., carcinoma in situ (e.g., ductal carcinoma in situ), estrogen receptor (ER)-positive breast cancer, ER-negative breast cancer, or other forms and/or stages of breast cancer), lung cancer (e.g., small cell carcinoma, non-small cell carcinoma, mesothelioma, and other forms and/or stages of lung cancer), and colon cancer (e.g., adenomatous polyp, colorectal carcinoma, and other forms and/or stages of colon cancer).

"Sample" or "biological sample" as used throughout here are generally meant to refer to samples of biological fluids or tissues, particularly samples obtained from tissues, especially from cells of the type associated with the disease for which the diagnostic application is designed (e.g., ductal adenocarcinoma), and the like. "Samples" is also meant to encompass derivatives and fractions of such samples (e.g., cell lysates). Where the sample is solid tissue, the cells of the tissue can be dissociated or tissue sections can be analyzed.

REPs can be generated in a variety of ways according to methods well known in the art. For example, REPs can be generated by hybridizing a control sample to an array having a selected set of polynucleotides (particularly a selected set of differentially expressed polynucleotides), acquiring the hybridization data from the array, and storing the data in a format that allows for ready comparison of the REP with a TEP. Alternatively, all expressed sequences in a control sample can be isolated and sequenced, e.g., by isolating mRNA from a control sample, converting the mRNA into cDNA, and sequencing the cDNA. The resulting sequence information roughly or precisely reflects the identity and relative number of expressed sequences in the sample. The sequence information can then be stored in a format (e.g., a computer-readable format) that allows for ready comparison of the REP with a TEP. The REP can be normalized prior to or after data storage, and/or can be processed to selectively remove sequences of expressed genes that are of less interest or that might complicate analysis (e.g., some or all of the sequences associated with housekeeping genes can be eliminated from REP data).

TEPs can be generated in a manner similar to REPs, e.g., by hybridizing a test sample to an array having a selected set of polynucleotides, particularly a selected set of differentially expressed polynucleotides, acquiring the hybridization data from the array, and storing the data in a format that allows for ready comparison of the TEP with a REP. The REP and TEP to be used in a comparison can be generated simultaneously, or the TEP can be compared to previously generated and stored REPs.

In one embodiment of the invention, comparison of a TEP with a REP involves hybridizing a test sample with a reference array, where the reference array has one or more reference sequences for use in hybridization with a sample. The reference sequences include all, at least one of, or any subset of the differentially expressed polynucleotides described herein. Hybridization data for the test sample is acquired, the data normalized, and the produced TEP compared with a REP generated using an array having the same or similar selected set of differentially expressed polynucleotides. Probes that correspond to sequences differentially expressed between the two samples will show decreased or increased hybridization efficiency for one of the samples relative to the other.

Reference arrays can be produced according to any suitable methods known in the art. For example, methods of producing large arrays of oligonucleotides are described in U.S. Pat. No. 5,134,854, and U.S. Pat. No. 5,445,934 using light-directed synthesis techniques. Using a computer controlled system, a heterogeneous array of monomers is converted, through simultaneous coupling at a number of reaction sites, into a heterogeneous array of polymers. Alternatively, microarrays are generated by deposition of pre-synthesized oligonucleotides onto a solid substrate, for example as described in PCT published application no. WO 95/35505.

Methods for collection of data from hybridization of samples with a reference arrays are also well known in the art. For example, the polynucleotides of the reference and test samples can be generated using a detectable fluorescent label, and hybridization of the polynucleotides in the samples detected by scanning the microarrays for the presence of the detectable label. Methods and devices for detecting fluorescently marked targets on devices are known in the art. Generally, such detection devices include a microscope and light source for directing light at a substrate. A photon counter detects fluorescence from the substrate, while an x-y translation stage varies the location of the substrate. A confocal detection device that can be used in the subject methods is described in U.S. Pat. No. 5,631,734. A scanning laser microscope is described in Shalon et al., *Genome Res.* (1996) 6:639. A scan, using the appropriate excitation line, is performed for each fluorophore used. The digital images generated from the scan are then combined for subsequent analysis. For any particular array element, the ratio of the fluorescent signal from one sample (e.g., a test sample) is compared to the fluorescent signal from another sample (e.g., a reference sample), and the relative signal intensity determined.

Methods for analyzing the data collected from hybridization to arrays are well known in the art. For example, where detection of hybridization involves a fluorescent label, data analysis can include the steps of determining fluorescent intensity as a function of substrate position from the data collected, removing outliers, i.e. data deviating from a predetermined statistical distribution, and calculating the relative binding affinity of the targets from the remaining data. The resulting data can be displayed as an image with the intensity in each region varying according to the binding affinity between targets and probes.

In general, the test sample is classified as having a gene expression profile corresponding to that associated with a disease or non-disease state by comparing the TEP generated from the test sample to one or more REPs generated from reference samples (e.g., from samples associated with cancer or specific stages of cancer, dysplasia, samples affected by a disease other than cancer, normal samples, etc.). The criteria for a match or a substantial match between a TEP and a REP include expression of the same or substantially the same set of reference genes, as well as expression of these reference genes at substantially the same levels (e.g., no significant difference between the samples for a signal associated with a selected reference sequence after normalization of the samples, or at least no greater than about 25% to about 40% difference in signal strength for a given reference sequence. In general, a pattern match between a TEP and a REP includes a match in expression, preferably a match in qualitative or quantitative expression level, of at least one of, all or any subset of the differentially expressed genes of the invention.

Pattern matching can be performed manually, or can be performed using a computer program. Methods for preparation of substrate matrices (e.g., arrays), design of oligonucleotides for use with such matrices, labeling of probes, hybridization conditions, scanning of hybridized matrices, and analysis of patterns generated, including comparison analysis, are described in, for example, U.S. Pat. No. 5,800, 992.

F. Use of the Polynucleotides of the Invention in Cancer

Oncogenesis involves the unbridled growth, dedifferentiation and abnormal migration of cells. Cancerous cells can have the ability to compress, invade, and destroy normal tissue. Cancerous cells may also metastasize to other parts of the body via the bloodstream or the lymph system and colonize in these other areas. Different cancers are classified by the cell from which the cancerous cell is derived and from its cellular morphology and/or state of differentiation.

Somatic genetic abnormalities cause cancer initiation and progression. Cancer generally is clonally formed, i.e. gain of function of oncogenes and loss of function of tumor suppressor genes within a single cell transform the cell to be cancerous, and that single cell grows and divides to form a cancerous lesion. The genes known to be involved in cancer initiation and progression are involved in numerous cellular functions, including developmental differentiation, cell cycle regulation, cell signaling, immunological response, DNA replication, and DNA repair.

The identification and characterization of genetic or biochemical markers in blood or tissues that will detect the earliest changes along the carcinogenesis pathway and monitor the efficacy of various therapies and preventive interventions is a major goal of cancer research. Scientists have identified genetic changes in stool specimens that indicate the stages of colon cancer, and other biomarkers such as gene mutations, hormone receptors, proteins that inhibit metastasis, and enzymes that metabolize drugs are all being used to determine the severity and predict the course of breast, prostate, lung, and other cancers.

Recent advances in the pathogenesis of certain cancers has been helpful in determining patient treatment. The level of expression of certain polynucteotides can indicative of a poorer prognosis, and therefore warrant more aggressive chemo- or radio-therapy for a patient. The correlation of novel surrogate tumor specific features with response to treatment and outcome in patients has defined certain prognostic indicators that allow the design of tailored therapy based on the molecular profile of the tumor. These therapies include antibody targeting and gene therapy. Moreover, a promising level of one or more marker polynucleotides can provide impetus for not aggressively treating a particular patient, thus sparing the patient the deleterious side effects of aggressive therapy. Determining expression of certain polynucleotides and comparison of a patients profile with known expression in normal tissue and variants of the disease allows a determination of the best possible treatment for a patient, both in terms of specificity of treatment and in terms of comfort level of the patient.

Surrogate tumor markers, such as polynucleotide expression, can also be used to better classify, and thus diagnose and treat, different forms and disease states of cancer. Two classifications widely used in oncology that can benefit from identification of the expression levels of the polynucleotides of the invention are staging of the cancerous disorder, and grading the nature of the cancerous tissue.

Staging. Staging is a process used by physicians to describe how advanced the cancerous state is in a patient. Staging assists the physician in determining a prognosis, planning treatment and evaluating the results of such treatment. Different staging systems are used for different types of cancer, but each generally involves the following determinations: the type of tumor, indicated by T; whether the cancer has metastasized to nearby lymph nodes, indicated by N; and whether the cancer has metastasized to more distant parts of the body, indicated by M. This system of staging is called the TNM system. Generally, if a cancer is only detectable in the area of the primary lesion without having spread to any lymph nodes it is called Stage I. If it has spread only to the closest lymph nodes, it is called Stage II. In Stage III, the cancer has generally spread to the lymph nodes in near proximity to the site of the primary lesion. Cancers that have spread to a distant part of the body, such as the liver, bone, brain or another site, are called Stage IV, the most advanced stage.

Currently, the determination of staging is done using pathological techniques and is based more on the presence or absence of malignant tissue rather than the characteristics of the tumor type. Presence or absence of malignant tissue is based primarily on the gross morphology of the cells in the areas biopsied. The polynucleotides of the invention can facilitate fine-tuning of the staging process by identifying markers for the aggresivity of a cancer, e.g. the metastatic potential, as well as the presence in different areas of the body. Thus, a Stage II cancer with a polynucleotide signifying a high metastatic potential cancer can be used to change a borderline Stage II tumor to a Stage III tumor, justifying more aggressive therapy. Conversely, the presence of a polynucleotide signifying a lower metastatic potential allows more conservative staging of a tumor.

Grading of cancers. Grade is a term used to describe how closely a tumor resembles normal tissue of its same type. Based on the microscopic appearance of a tumor, pathologists will identify the grade of a tumor based on parameters such as cell morphology, cellular organization, and other markers of differentiation. As a general rule, the grade of a tumor corresponds to its rate of growth or aggressiveness. That is, undifferentiated or high-grade tumors grow more quickly than well differentiated or low-grade tumors. Information about tumor grade is useful in planning treatment and predicting prognosis.

The American Joint Commission on Cancer has recommended the following guidelines for grading tumors: 1) GX Grade cannot be assessed; 2) G1 Well differentiated; G2 Moderately well differentiated; 3) G3 Poorly differentiated; 4) G4 Undifferentiated. Although grading is used by pathologists to describe most cancers, it plays a more important role in treatment planning for certain types than for others. An example is the Gleason system that is specific for prostate cancer, which uses grade numbers to describe the degree of differentiation. Lower Gleason scores indicate well-differentiated cells. Intermediate scores denote tumors with moderately differentiated cells. Higher scores describe poorly differentiated cells. Grade is also important in some types of brain tumors and soft tissue sarcomas.

The polynucleotides of the invention can be especially valuable in determining the grade of the tumor, as they not only can aid in determining the differentiation status of the cells of a tumor, they can also identify factors other than differentiation that are valuable in determining the aggressivity of a tumor, such as metastatic potential.

Familial Cancer Genes. A number of cancer syndromes are linked to Mendelian inheritance of a predisposition to develop particular cancers. The following table contains a list of cancer types that can be inherited, and for which the gene or genes responsible have been identified. Most of the cancer types listed can occur as part of several different genetic conditions, each caused by alterations in a different gene.

| Cancer Type | Genetic Condition | Gene |
| --- | --- | --- |
| Brain | Li-Fraumeni syndrome | TP53 |
| Brain | Neurofibromatosis 1 | NF1 |
|  | Neurofibromatosis 2 | NF2 |
|  | von Hippel-Lindau syndrome | VHL |
|  | Tuberous sclerosis 2 | TSC2 |
| Breast | Hereditary breast/ovarian cancer 1 | BRCA1 |
|  | Hereditary breast/ovarian cancer 2 | BRCA2 |
|  | Li-Fraumeni syndrome | TP53 |
|  | Ataxia telangiectasia | ATM |
| Colon | Familial adenomatous polyposis (FAP) | APC |
|  | Hereditary non-polyposis colon cancer (HNPCC) 1 | HMSH2 |
|  | Hereditary non-polyposis colon cancer (HNPCC) 2 | hMLH1 |
|  | Hereditary non-polyposis colon cancer (HNPCC) 3 | hPMS1 |
|  | Hereditary non-polyposis colon cancer (HNPCC) 4 | hPMS2 |
| Endocrine (parathyroid, pituitary, GI endocrine) | Multiple endocrine neoplasia 1 (MEN1) | MEN1 |
| Endocrine (pheochromacytoma, medullary thyroid) | Multiple endocrine neoplasia 2 (MEN2) | RET |

-continued

| Cancer Type | Genetic Condition | Gene |
|---|---|---|
| Endometrial | Hereditary non-polyposis colon cancer (HNPCC) 1 | hMSH2 |
| | Hereditary non-polyposis colon cancer (HNPCC) 2 | hMLH1 |
| | Hereditary non-polyposis colon cancer (HNPCC) 3 | hPMS1 |
| | Hereditary non-polyposis colon cancer (HNPCC) 4 | hPMS2 |
| Eye | Hereditary retinoblastoma | RB1 |
| Hematologic | Li-Fraumeni syndrome | TP53 |
| (lymphomas and leukemia) | Ataxia telangiectasia | ATM |
| Kidney | Hereditary Wilms' tumor | WT1 |
| | von Hippel-Lindau syndrome | VHL |
| | Tuberous sclerosis 2 | TSC2 |
| Ovary | Hereditary breast/ovarian cancer 1 | BRCA1 |
| | Hereditary breast/ovarian cancer 2 | BRCA2 |
| Sarcoma | Hereditary retinoblastoma | RB1 |
| | Li-Fraumeni syndrome | TP53 |
| | Neurofibromatosis 1 | NF1 |
| Skin | Hereditary melanoma 1 | CDKN2 |
| | Hereditary melanoma 2 | CDK4 |
| | Basal cell naevus (Gorlin) syndrome | PTCH |
| Stomach | Hereditary non-polyposis colon cancer (HNPCC) 1 | hMSH2 |
| | Hereditary non-polyposis colon cancer (HNPCC) 2 | hMLH1 |
| | Hereditary non-polyposis colon cancer (HNPCC) 3 | hPMS1 |
| | Hereditary non-polyposis colon cancer (HNPCC) 4 | hPMS2 |

The polynucleotides of the invention can be especially useful to monitor patients having any of the above syndromes to detect potentially malignant events at a molecular level before they are detectable at a gross morphological level. As can be seen from the table, a number of genes are involved in multiple forms of cancer. Thus, a polynucleotide of the invention identified as important for metastatic colon cancer can also have clinical implications for a patient diagnosed with stomach cancer or endometrial cancer.

Lung Cancer. Lung cancer is one of the most common cancers in the United States, accounting for about 15 percent of all cancer cases, or 170,000 new cases each year. At this time, over half of the lung cancer cases in the United States are in men, but the number found in women is increasing and will soon equal that in men. Today more women die of lung cancer than of breast cancer. Lung cancer is especially difficult to diagnose and treat because of the large size of the lungs, which allows cancer to develop for years undetected. In fact, lung cancer can spread outside the lungs without causing any symptoms. Adding to the confusion, the most common symptom of lung cancer, a persistent cough, can often be mistaken for a cold or bronchitis.

Although there are more than a dozen different kinds of lung cancer, the two main types of lung cancer are small cell and nonsmall cell, which encompass about 90% of all lung cancer cases. Small cell carcinoma (also called oat cell carcinoma), which usually starts in one of the larger bronchial tubes, grows fairly rapidly, and is likely to be large by the time of diagnosis. Nonsmall cell lung cancer (NSCLC) is made up of three general subtypes of lung cancer. Epidermoid carcinoma (also called squamous cell carcinoma) usually starts in one of the larger bronchial tubes and grows relatively slowly. The size of these tumors can range from very small to quite large. Adenocarcinoma starts growing near the outside surface of the lung and can vary in both size and growth rate. Some slowly growing adenocarcinomas are described as alveolar cell cancer. Large cell carcinoma starts near the surface of the lung, grows rapidly, and the growth is usually fairly large when diagnosed. Other less common forms of lung cancer are carcinoid, cylindroma, mucoepidermoid, and malignant mesothelioma.

Currently, CT scans, MRIs, X-rays, sputum cytology, and biopsies are used to diagnose nonsmall cell lung cancer. The form and cellular origin of the lung cancer is diagnosed primarily through biopsy from either a surgical biopsy or a needle aspiration of lung tissue, and usually the biopsy is prompted from an abnormality identified on an X-ray. In some cases, sputum cytology can reveal lung cancers in patients with normal X-rays or can determine the type of lung cancer, but because it cannot pinpoint the tumor's location, a positive sputum cytology test is usually followed by further tests. Since these tests are based in large part on gross morphology of the tissue, the diagnosis of a particular kind of tumor is largely subjective, and the diagnosis can vary significantly between clinicians.

The polynucleotides of the invention can be used to distinguish types of lung cancer well as identifying traits specific to a certain patient's cancer. For example, if the patient's biopsy expresses a polynucleotide that is associated with a low metastatic potential, it may justify leaving a larger portion of the patient's lung in surgery to remove the lesion. Alternatively, a smaller lesion with expression of a polynucleotide that is associated with high metastatic potential may justify a more radical removal of lung tissue and/or the surrounding lymph nodes, even if no metastasis can be identified through pathological examination.

Similarly, the expression of polynucleotides of the invention can be used in the diagnosis, prognosis and management of colorectal cancer. The differential expression of a polynucleotide in hyperplasia can be used as a diagnostic marker for metastatic lung cancer. The polynucleotides of the invention that would be especially useful for this purpose are those that exhibit differential expression between high metastatic versus low metastatic lung cancer, i.e. SEQ ID NOS: 174, 254, 466, 571, 574, 590, 922, 1355, 1422, 2007, 2038, 2245, 10, 54, 65, 171, 203, 252, 253, 285, 419, 420, 491, 525, 526, 552, 693, 700, 726, 742, 746, 861, 990, 1088, 1288, 1417, 1444, 1454, 1570, 1597, 1979, 2024, 2034, and 2126. Detection of malignant lung cancer with a higher metastatic potential can be determined using expression levels of any of these sequences alone or in combination with the levels of expression of other known genes.

Breast Cancer. The National Cancer Institute (NCI) estimates that about 1 in 8 women in the United States will develop breast cancer during her lifetime. Clinical breast examination and mammography are recommended as combined modalities for breast cancer screening, and the nature of the cancer will often depend upon the location of the tumor and the cell type from which the tumor is derived. The majority of breast cancers are adenocarcinomas subtypes, which can be summarized as follows:

Ductal carcinoma in situ (DCIS): Ductal carcinoma in situ is the most common type of noninvasive breast cancer. In DCIS, the malignant cells have not metastasized through the walls of the ducts into the fatty tissue of the breast. Comedocarcinoma is a type of DCIS that is more likely than other types of DCIS to come back in the same area after lumpectomy. It is more closely linked to eventual development of invasive ductal carcinoma than other forms of DCIS.

Infiltrating (or invasive) ductal carcinoma (IDC): this type of cancer has metastasized through the wall of the duct and invaded the fatty tissue of the breast. At this point, it has the potential to use the lymphatic system and bloodstream for metastasis to more distant parts of the body. Infiltrating ductal carcinoma accounts for about 80% of breast cancers.

Lobular carcinoma in situ (LCIS): While not a true cancer, LCIS (also called lobular neoplasia) is sometimes classified as a type of noninvasive breast cancer. It does not penetrate through the wall of the lobules. Although it does not itself usually become an invasive cancer, women with this condition have a higher risk of developing an invasive breast cancer in the same breast, or in the opposite breast.

Infiltrating (or invasive) lobular carcinoma (ILC): ILC is similar to IDC, in that it has the potential metastasize elsewhere in the body. About 10% to 15% of invasive breast cancers are invasive lobular carcinomas. ILC can be more difficult to detect by mammogram than IDC.

Inflammatory breast cancer: This rare type of invasive breast cancer accounts for about 1% of all breast cancers and is extremely aggressive. Multiple skin symptoms associated with this cancer are caused by cancer cells blocking lymph vessels or channels in the skin over the breast.

Medullary carcinoma: This special type of infiltrating breast cancer has a relatively well defined, distinct boundary between tumor tissue and normal tissue. It accounts for about 5% of breast cancers. The prognosis for this kind of breast cancer is better than for other types of invasive breast cancer.

Mucinous carcinoma: This rare type of invasive breast cancer originates from mucus-producing cells. The prognosis for mucinous carcinoma is better than for the more common types of invasive breast cancer.

Paget's disease of the nipple: This type of breast cancer starts in the ducts and spreads to the skin of the nipple and the areola. It is a rare type of breast cancer, occurring in only 1% of all cases. Paget's disease can be associated with in situ carcinoma, or with infiltrating breast carcinoma. If no lump can be felt in the breast tissue, and the biopsy shows DCIS but no invasive cancer, the prognosis is excellent.

Phyllodes tumor: This very rare type of breast tumor forms from the stroma of the breast, in contrast to carcinomas which develop in the ducts or lobules. Phyllodes (also spelled phylloides) tumors are usually benign, but are malignant on rare occasions. Nevertheless, malignant phyllodes tumors are very rare and less than 10 women per year in the US die of this disease. Benign phyllodes tumors are successfully treated by removing the mass and a narrow margin of normal breast tissue.

Tubular carcinoma: Accounting for about 2% of all breast cancers, tubular carcinomas are a special type of infiltrating breast carcinoma. They have a better prognosis than usual infiltrating ductal or lobular carcinomas.

High-quality mammography combined with clinical breast exam remains the only screening method clearly tied to reduction in breast cancer mortality. Lower dose x-rays, digitized computer rather than film images, and the use of computer programs to assist diagnosis, are almost ready for widespread dissemination. Other technologies also are being developed, including magnetic resonance imaging and ultrasound. In addition, a very low radiation exposure technique, positron emission tomography has the potential for detecting early breast cancer.

It is also possible to differentiate between non-cancerous breast tissue and malignant breast tissue by analyzing differential gene expression between tissues. In addition, there may be several possible alterations that lead to the various possible types of breast cancer. The different types of breast tumors (e.g., invasive vs. non-invasive, ductal vs. axillary lymph node) can be differentiable from one another by the identification of the differences in genes expressed by different types-of breast tumor tissues (Porter-Jordan et al., *Hematol Oncol Clin North Am* (1994) 8:73). Breast cancer can thus be generally diagnosed by detection of expression of a gene or genes associated with breast tumors. Where enough information is available about the differential gene expression between various types of breast tumor tissues, the specific type of breast tumor can also be diagnosed.

For example, increased estrogen receptor (ER) expression in normal breast epithileum, while not itself indicative of malignant tissue, is a known risk marker for development of breast cancer. Khan S A et al., *Cancer Res* (1994) 54:993. Malignant breast cancer is often divided into two groups, ER-positive and ER-negative, based on the estrogen receptor status of the tissue. The ER status represents different survival length and response to hormone therapy, and is thought to represent either: 1) an indicator of different stages of the disease, or 2) an indicator that allows differentiation between two similar but distinct diseases. K. Zhu et al., *Med. Hypoth* (1997) 49:69. A number of other genes are known to vary expression between either different stages of cancer or different types of similar breast cancer.

Similarly, the expression of polynucleotides of the invention can be used in the diagnosis and management of breast cancer. The differential expression of a polynucleotide in human breast tumor tissue can be used as a diagnostic marker for human breast cancer. The polynucleotides of the invention that would be especially useful for this purpose are those that exhibit differential expression between breast cancer tissue with a high metastatic potential and a low metastatic potential, i.e. SEQ ID NOS:15, 36, 44, 89, 172, 203, 261, 419, 420, 503, 552, 564, 570, 590, 693, 707, 711, 726, 746, 756, 990, 1122, 1142, 1286, 1289, 1435, 1860, 1933, 1934, 1979, 1980, 2007, 2023, 2409, 2486, 45, 146, 154, 159, 165, 174, 183, 364, 366, 387, 496, 510, 512, 529, 560, 606, 644, 646, 754, 875, 902, 921, 942, 1095, 1104, 1131, 1170, 1184, 1205, 1354, 1387, 1535, 1751, 1764, 1777, 1795, 1869, 1882, 1890, 1915, 2040, 2059, 2223, 2245, 2300, 2325, 2462, 2488, 2492; Detection of breast cancer can be determined using expression levels of any of these sequences alone or in combination. Determination of the aggressive nature and/or the metastatic potential of a breast cancer can also be determined by comparing levels of one or more polynucleotides of the invention and comparing levels of another sequence known to vary in cancerous tissue, e.g. ER expression. In addition, development of breast cancer can be detected by examining the ratio of SEQ ID NO: to the levels of steroid hormones (e.g., testosterone or estrogen) or to other hormones (e.g., growth hormone, insulin). Thus expression of specific marker polynucleotides can be used to discriminate between normal and cancerous breast tissue, to discriminate between breast cancers with different cells of origin, to discriminate between breast cancers with different potential metastatic rates, etc.

Diagnosis of breast cancer can also involve comparing the expression of a polynucleotide of the invention with the expression of other sequences in non-malignant breast tissue samples in comparison to one or more forms of the diseased tissue. A comparison of expression of one or more polynucleotides of the invention between the samples provides information on relative levels of these polynucleotides as well as the ratio of these polynucleotides to the expression of other sequences in the tissue of interest compared to normal.

This risk of breast cancer is elevated significantly by the presence of an inherited risk for breast cancer, such as a mutation in BRCA-1 or BRCA-2. New diagnostic tools are being developed to address the needs of higher risk patients to complement mammography and physical examinations for early detection of breast cancer, particularly among younger women. The presence of antigen or expression markers in nipple aspirate fluid (NAF) samples collected from one or both breasts can be useful for useful for risk assessment or early cancer detection. Breast cytology and biomarkers obtained by random fine needle aspiration have been used to identify hyperplasia with atypia and overexpression of p53 and EGFR. The polynucleotides of the invention can be used in multivariate analysis with expression studies with genes such as p53 and EGFR as risk predictors and as surrogate endpoint biomarkers for breast cancer.

As well as being used for diagnosis and risk assessment, the expression of certain genes can also correlated to prognosis of a disease state. The expression of particular gene have been used as prognostic indicators for breast cancer including increased expression of c-erbB-2, pS2, ER, progesterone receptor, epidermal growth factor receptor (EGFR), neu, myc, bcl-2, int2, cytosolic tyrosine kinase, cyclin E, prad-1, hst, uPA, PAI-1, PAI-2, cathepsin D, as well as the presence of a number of cancer-specific antigens, e.g. CEA, CA M26, CA M29 and CA 15.3. Davis, *Br. J. Biomed Sci.* (1996) 53:157. Poor prognosis has also been linked to a decrease in expression of certain genes, such as p53, Rb, nm23. The expression of the polynucleotides of the invention can be of prognostic value for determining the metastatic potential of a malignant breast cancer, as this molecules are differentially expressed between high and low metastatic potential tissues tumors. The levels of these polynucleotides in patients with malignant breast cancer can compared to normal tissue, malignant tissue with a known high potential metastatic level, and malignant tissue with a known lower level of metastatic potential to provide a prognosis for a particular patient. Such a prognosis is predictive of the extent and nature of the cancer. The determined prognosis is useful in determining the prognosis of a patient with breast cancer, both for initial treatment of the disease and for longer-term monitoring of the same patient. If samples are taken from the same individual over a period of time, differences in polynucleotide expression that are specific to that patient can be identified and closely watched.

Colon Cancer. Colorectal cancer is one of the most common neoplasms in humans and perhaps the most frequent form of hereditary neoplasia. Prevention and early detection are key factors in controlling and curing colorectal cancer. Indeed, colorectal cancer is the second most preventable cancer, after lung cancer. Colorectal cancer begins as polyps, which are small, benign growths of cells that form on the inner lining of the colon. Over a period of several years, some of these polyps accumulate additional mutations and become cancerous. About 20 percent of all cases of colon cancer are thought to be related to heredity. Currently, multiple familial colorectal cancer disorders have been identified, which are summarized as follows:

Familial adenomatous polyposis (FAP): This condition results in a person having hundreds or even thousands of polyps in the colon and rectum that usually first appear during the teenage years. Cancer nearly always develops in one or more of these polyps between the ages of 30 and 50.

Gardner's syndrome: Like FAP, Gardner's syndrome results in polyps and colorectal cancers that develop at a young age. It can also cause benign tumors of the skin, soft connective tissue and bones.

Hereditary nonpolyposis colon cancer (HNPCC): People with this condition tend to develop colorectal cancer at a young age, without first having many polyps. HNPCC has an autosomal dominant pattern of inheritance with variable but high penetrance estimated to be about 90%. HNPCC underlies 0.5%–10% of all cases of colorectal cancer. An understanding of the mechanisms behind the development of HNPCC is emerging, and genetic presymptomatic testing, now being conducted in research settings, soon will be available on a widespread basis for individuals identified at risk for this disease.

Familial colorectal cancer in Ashkenazi Jews: Recent research has found an inherited tendency to developing colorectal cancer among some Jews of Eastern European descent. Like people with FAP, Gardner's syndrome, and HNPCC, their increased risk is due to an inherited mutation present in about 6% of American Jews.

Several tests are currently used to screen for colorectal cancer, including digital rectal examination, fecal occult blood test, sigmoidoscopy, colonoscopy, virtual colonoscopy and MRI. Each of these tests identifies potential colorectal cancer lesions, or a risk of development of these lesions, at a fairly gross morphological level.

The sequential alteration of a number of genes is associated with malignant adenocarcinoma, including the genes DCC, p53, ras, and FAP. For a review, see e.g. Fearon E R, et al., *Cell* (1990) 61(S):759; Hamilton S R et al., *Cancer* (1993) 72:957; Bodmer W, et al., *Nat Genet.* (1994) 4(3):217; Fearon E R, *Ann NY Acad Sci.* (1995) 768:101. Molecular genetic alterations are thus promising as potential diagnostic and prognostic indicators in colorectal carcinoma and molecular genetics of colorectal carcinoma since it is possible to differentiate between different types of colorectal neoplasias using molecular markers. Colorectal cancer can thus be generally diagnosed by detection of expression of a gene or genes associated with colorectal tumors.

Similarly, the expression of polynucleotides of the invention can be used in the diagnosis, prognosis and management of colorectal cancer. The differential expression of a polynucleotide in hyperplasia can be used as a diagnostic marker for colon cancer. The polynucleotides of the invention that would be especially useful for this purpose are those that exhibit differential expression between malignant metastatic colon cancer and normal patient tissue, i.e. SEQ ID NOS:228, 280, 355, 491, 603, 680, 752, 753, 1241, 1264, 1401, 1442, 1514, 1851, 1915, 2024, 2066, 33, 250, 282, 370, 387, 443, 460, 545, 560, 703, 704, 1095, 1104, 1205, 1354, 1387, 1734, 1742, 1954, 2262, 2325, 1899, 252, 253, 491, 581, 693, 726, 746, 1780, 1899, 65, 252, 253, 581, 693, 716, 726, 746, 1780, 1899, and 1780. Detection of malignant colon cancer can be determined using expression levels of any of these sequences alone or in combination with the levels of expression.

Determination of the aggressive nature and/or the metastatic potential of a colon cancer can also be determined by comparing levels of one or more polynucleotides of the invention and comparing total levels of another sequence known to vary in cancerous tissue, e.g. p53 expression. In addition, development of colon cancer can be detected by examining the ratio of any of the polynucleotides of the invention to the levels of oncogenes (e.g. ras) or tumor suppressor genes (e.g. FAP or p53). Thus expression of specific marker polynucleotides can be used to discriminate between normal and cancerous breast tissue, to discriminate between breast cancers with different cells of origin, to discriminate between breast cancers with different potential metastatic rates, etc.

G. Use of Polynucleotides to Screen for Peptide Analogs and Antagonists

Polypeptides encoded by the instant polynucleotides and corresponding full length genes can be used to screen peptide libraries to identify binding partners, such as receptors, from among the encoded polypeptides.

A library of peptides can be synthesized following the methods disclosed in U.S. Pat. No. 5,010,175 ('175), and in WO 91/17823. As described below in brief, one prepares a mixture of peptides, which is then screened to identify the peptides exhibiting the desired signal transduction and receptor binding activity. In the '175 method, a suitable peptide synthesis support (e.g., a resin) is coupled to a mixture of appropriately protected, activated amino acids. The concentration of each amino acid in the reaction mixture is balanced or adjusted in inverse proportion to its coupling reaction rate so that the product is an equimolar mixture of amino acids coupled to the starting resin. The bound amino acids are then deprotected, and reacted with another balanced amino acid mixture to form an equimolar mixture of all possible dipeptides. This process is repeated until a mixture of peptides of the desired length (e.g., hexamers) is formed. Note that one need not include all amino acids in each step: one can include only one or two amino acids in some steps (e.g., where it is known that a particular amino acid is essential in a given position), thus reducing the complexity of the mixture. After the synthesis of the peptide library is completed, the mixture of peptides is screened for binding to the selected polypeptide. The peptides are then tested for their ability to inhibit or enhance activity. Peptides exhibiting the desired activity are then isolated and sequenced.

The method described in WO 91/17823 is similar. However, instead of reacting the synthesis resin with a mixture of activated amino acids, the resin is divided into twenty equal portions (or into a number of portions corresponding to the number of different amino acids to be added in that step), and each amino acid is coupled individually to its portion of resin. The resin portions are then combined, mixed, and again divided into a number of equal portions for reaction with the second amino acid. In this manner, each reaction can be easily driven to completion. Additionally, one can maintain separate "subpools" by treating portions in parallel, rather than combining all resins at each step. This simplifies the process of determining which peptides are responsible for any observed receptor binding or signal transduction activity.

In such cases, the subpools containing, e.g., 1–2,000 candidates each are exposed to one or more polypeptides of the invention. Each subpool that produces a positive result is then resynthesized as a group of smaller subpools (subsubpools) containing, e.g., 20–100 candidates, and reassayed. Positive sub-subpools can be resynthesized as individual compounds, and assayed finally to determine the peptides that exhibit a high binding constant. These peptides can be tested for their ability to inhibit or enhance the native activity. The methods described in WO 91/823 and U.S. Pat. No. 5,194,392 (herein incorporated by reference) enable the preparation of such pools and subpools by automated techniques in parallel, such that all synthesis and resynthesis can be performed in a matter of days.

Peptide agonists or antagonists are screened using any available method, such as signal transduction, antibody binding, receptor binding, mitogenic assays, chemotaxis assays, etc. The methods described herein are presently preferred. The assay conditions ideally should resemble the conditions under which the native activity is exhibited in vivo, that is, under physiologic pH, temperature, and ionic strength. Suitable agonists or antagonists will exhibit strong inhibition or enhancement of the native activity at concentrations that do not cause toxic side effects in the subject. Agonists or antagonists that compete for binding to the native polypeptide can require concentrations equal to or greater than the native concentration, while inhibitors capable of binding irreversibly to the polypeptide can be added in concentrations on the order of the native concentration.

The end results of such screening and experimentation will be at least one novel polypeptide binding partner, such as a receptor, encoded by a gene or a cDNA corresponding to a polynucleotide of the invention, and at least one peptide agonist or antagonist of the novel binding partner. Such agonists and antagonists can be used to modulate, enhance, or inhibit receptor function in cells to which the receptor is native, or in cells that possess the receptor as a result of genetic engineering. Further, if the novel receptor shares biologically important characteristics with a known receptor, information about agonist/antagonist binding can facilitate development of improved agonists/antagonists of the known receptor.

H. Pharmaceutical Compositions and Therapeutic Uses

Pharmaceutical compositions can comprise polypeptides, antibodies, or polynucleotides of the claimed invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation is determined by routine experimentation and is within the judgment of the clinician. For purposes of the present invention, an effective dose will generally be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which can be administered without undue toxicity. Suitable carriers can be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in *Remington's Pharmaceutical Sciences* (Mack Pub. Co., N.J. 1991).

Pharmaceutically acceptable carriers in therapeutic compositions can include liquids such as water, saline, glycerol and ethanol. Auxiliary substances, such as wetting or emulsifying agents, pH buffering substances, and the like, can also be present in such vehicles. Typically, the therapeutic compositions are prepared as injectables, either as liquid solutions or suspensions; solid forms suitable for solution in, or suspension in, liquid vehicles prior to injection can also be prepared. Liposomes are included within the definition of a pharmaceutically acceptable carrier.

Delivery Methods. Once formulated, the compositions of the invention can be (1) administered directly to the subject (e.g., as polynucleotide or polypeptides); (2) delivered ex vivo, to cells derived from the subject (e.g., as in ex vivo gene therapy); or (3) delivered in vitro for expression of recombinant proteins (e.g., polynucleotides). Direct delivery of the compositions will generally be accomplished by injection, either subcutaneously, intraperitoneally, intravenously or intramuscularly, or delivered to the interstitial space of a tissue. The compositions can also be administered into a tumor or lesion. Other modes of administration include oral and pulmonary administration, suppositories, and transdermal applications, needles, and gene guns or hyposprays. Dosage treatment can be a single dose schedule or a multiple dose schedule.

Methods for the ex vivo delivery and reimplantation of transformed cells into a subject are known in the art and described in e.g., International Publication No. WO 93/14778. Examples of cells useful in ex vivo applications include, for example, stem cells, particularly hematopoetic, lymph cells, macrophages, dendritic cells, or tumor cells. Generally, delivery of nucleic acids for both ex vivo and in vitro applications can be accomplished by, for example, dextran-mediated transfection, calcium phosphate precipitation, polybrene mediated transfection, protoplast fusion, electroporation, encapsulation of the polynucleotide (s) in liposomes, and direct microinjection of the DNA into nuclei, all well known in the art.

Once a gene corresponding to a polynucleotide of the invention has been found to correlate with a proliferative disorder, such as neoplasia, dysplasia, and hyperplasia, the disorder can be amenable to treatment by administration of a therapeutic agent based on the provided polynucleotide or corresponding polypeptide.

Preparation of antisense polynucleotides is discussed above. Neoplasias that are treated with the antisense composition include, but are not limited to, cervical cancers, melanomas, colorectal adenocarcinomas, Wilms' tumor, retinoblastoma, sarcomas, myosarcomas, lung carcinomas, leukemias, such as chronic myelogenous leukemia, promyelocytic leukemia, monocytic leukemia, and myeloid leukemia, and lymphomas, such as histiocytic lymphoma.

Proliferative disorders that are treated with the therapeutic composition include disorders such as anhydric hereditary ectodermal dysplasia, congenital alveolar dysplasia, epithelial dysplasia of the cervix, fibrous dysplasia of bone, and mammary dysplasia. Hyperplasias, for example, endometrial, adrenal, breast, prostate, or thyroid hyperplasias or pseudoepitheliomatous hyperplasia of the skin, are treated with antisense therapeutic compositions based upon a polynucleotide of the invention. Even in disorders in which mutations in the corresponding gene are not implicated, downregulation or inhibition of expression of a gene corresponding to a polynucleotide of the invention can have therapeutic application. For example, decreasing gene expression can help to suppress tumors in which enhanced expression of the gene is implicated.

Both the dose of the antisense composition and the means of administration are determined based on the specific qualities of the therapeutic composition, the condition, age, and weight of the patient, the progression of the disease, and other relevant factors. Administration of the therapeutic antisense agents of the invention includes local or systemic administration, including injection, oral administration, particle gun or catheterized administration, and topical administration. Preferably, the therapeutic antisense composition contains an expression construct comprising a promoter and a polynucleotide segment of at least 12, 22, 25, 30, or 35 contiguous nucleotides of the antisense strand of a polynucleotide disclosed herein. Within the expression construct, the polynucleotide segment is located downstream from the promoter, and transcription of the polynucleotide segment initiates at the promoter.

Various methods are used to administer the therapeutic composition directly to a specific site in the body. For example, a small metastatic lesion is located and the therapeutic composition injected several times in several different locations within the body of tumor. Alternatively, arteries which serve a tumor are identified, and the therapeutic composition injected into such an artery, in order to deliver the composition directly into the tumor. A tumor that has a necrotic center is aspirated and the composition injected directly into the now empty center of the tumor. The antisense composition is directly administered to the surface of the tumor, for example, by topical application of the composition. X-ray imaging is used to assist in certain of the above delivery methods.

Receptor-mediated targeted delivery of therapeutic compositions containing an antisense polynucleotide, subgenomic polynucleotides, or antibodies to specific tissues is also used. Receptor-mediated DNA delivery techniques are described in, for example, Findeis et al., *Trends Biotechnol* (1993) 11:202; Chiou et al., *Gene Therapeutics: Methods And Applications Of Direct Gene Transfer* (J. A. Wolff, ed.) (1994); Wu et al., *J. Biol. Chem.* (1988) 263:621; Wu et al., *J. Biol. Chem.* (1994) 269:542; Zenke et al., *Proc. Natl. Acad. Sci. (USA)* (1990) 87:3655; Wu et al., *J. Biol. Chem.* (1991) 266:338. Preferably, receptor-mediated targeted delivery of therapeutic compositions containing antibodies of the invention is used to deliver the antibodies to specific tissue.

Therapeutic compositions containing antisense subgenomic polynucleotides are administered in a range of about 100 ng to about 200 mg of DNA for local administration in a gene therapy protocol. Concentration ranges of about 500 ng to about 50 mg, about 1 pg to about 2 mg, about 5 µg to about 500 µg, and about 20 µg to about 100 µg of DNA can also be used during a gene therapy protocol. Factors such as method of action and efficacy of transformation and expression are considerations which will affect the dosage required for ultimate efficacy of the antisense subgenomic polynucleotides. Where greater expression is desired over a larger area of tissue, larger amounts of antisense subgenomic polynucleotides or the same amounts readministered in a successive protocol of administrations, or several administrations to different adjacent or close tissue portions of, for example, a tumor site, may be required to effect a positive therapeutic outcome. In all cases, routine experimentation in clinical trials will determine specific ranges for optimal therapeutic effect. A more complete description of gene therapy vectors, especially retroviral vectors, is contained in U.S. Ser. No. 08/869,309, which is expressly incorporated herein, and in section G below.

For polynucleotide-related genes encoding polypeptides or proteins with anti-inflammatory activity, suitable use, doses, and administration are described in U.S. Pat. No. 5,654,173. Therapeutic agents also include antibodies to proteins and polypeptides encoded by the polynucleotides of the invention and related genes, as described in U.S. Pat. No. 5,654,173.

I. Gene Therapy

The therapeutic polynucleotides and polypeptides of the present invention can be utilized in gene delivery vehicles. The gene delivery vehicle can be of viral or non-viral origin (see generally, Jolly, *Cancer Gene Therapy* (1994) 1:51; Kimura, *Human Gene Therapy* (1994) 5:845; Connelly, *Human Gene Therapy* (1995) 1:185; and Kaplitt, *Nature Genetics* (1994) 6:148). Gene therapy vehicles for delivery of constructs including a coding sequence of a therapeutic of the invention can be administered either locally or systemically. These constructs can utilize viral or non-viral vector approaches. Expression of such coding sequences can be induced using endogenous mammalian or heterologous promoters. Expression of the coding sequence can be either constitutive or regulated.

The present invention can employ recombinant retroviruses which are constructed to carry or express a selected nucleic acid molecule of interest. Retrovirus vectors that can be employed include those described in EP 0 415 731; WO 90/07936; WO 94/03622; WO 93/25698; WO 93/25234; U.S. Pat. No. 5,219,740; WO 93/11230; WO 93/10218; Vile and Hart, *Cancer Res.* (1993) 53:3860; Vile et al., *Cancer Res.* (1993) 53:962; Ram et al., *Cancer Res.* (1993) 53:83; Takamiya et al., *J. Neurosci Res.* (1992) 33:493; Baba et al., *J. Neurosurg.* (1993) 79:729; U.S. Pat. No. 4,777,127; GB Patent No. 2,200,651; and EP 0 345 242. Preferred recombinant retroviruses include those described in WO 91/02805.

Packaging cell lines suitable for use with the above-described retroviral vector constructs can be readily prepared (see, e.g., WO 95/30763 and WO 92/05266), and used to create producer cell lines (also termed vector cell lines) for the production of recombinant vector particles. Within particularly preferred embodiments of the invention, packaging cell lines are made from human (such as HT1080 cells) or mink parent cell lines, thereby allowing production of recombinant retroviruses that can survive inactivation in human serum.

The present invention also employs alphavirus-based vectors that can function as gene delivery vehicles. Such vectors can be constructed from a wide variety of alphaviruses, including, for example, Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532). Representative examples of such vector systems include those described in U.S. Pat. Nos. 5,091,309; 5,217,879; and 5,185,440; WO 92/10578; WO 94/21792; WO 95/27069; WO 95/27044; and WO 95/07994. Gene delivery vehicles of the present invention can also employ parvovirus such as adeno-associated virus (AAV) vectors. Representative examples include the AAV vectors disclosed by Srivastava in WO 93/09239, Samulski et al., *J. Virol.* (1989) 63:3822; Mendelson et al., *Virol.* (1988) 166:154; and Flone et al., *PNAS* (1993) 90:10613.

Representative examples of adenoviral vectors include those described by Berkner, *Biotechniques* (1988) 6:616; Rosenfeld et al., *Science* (1991) 252:431; WO 93/19191; Kolls et al., *PNAS* (1994) 91:215; Kass-Eisler et al., *PNAS* (1993) 90:11498; Guzman et al., *Circulation* (1993) 88:2838; Guzman et al., *Cir. Res.* (1993) 73:1202; Zabner et al., *Cell* (1993) 75:207; Li et al., *Hum. Gene Ther.* (1993) 4:403; Cailaud et al., *Eur. J. Neurosci.* (1993) 5:1287; Vincent et al., *Nat. Genet.* (1993) 5:130; Jaffe et al., *Nat. Genet.* (1992) 1:372; and Levrero et al., *Gene* (1991) 101:195. Exemplary adenoviral gene therapy vectors employable in this invention also include those described in WO 94/12649, WO 93/03769; WO 93/19191; WO 94/28938; WO 95/11984 and WO 95/00655.

Administration of DNA linked to killed adenovirus as described in Curiel, *Hum. Gene Ther.* (1992) 3:147 can be employed.

Other gene delivery vehicles and methods can be employed, including polycationic condensed DNA linked or unlinked to killed adenovirus alone, for example Curiel, *Hum. Gene Ther.* (1992) 3:147; ligand linked DNA, for example see Wu, *J. Biol. Chem.* (1989) 264:16985; eukaryotic cell delivery vehicles cells, for example see U.S. Pat. No. 5,814,482; WO 95/07994; WO 96/17072; WO 95/30763; and WO 97/42338; deposition of photopolymerized hydrogel materials; hand-held gene transfer particle gun, as described in U.S. Pat. No. 5,149,655; ionizing radiation as described in U.S. Pat. No. 5,206,152 and in WO92/11033; nucleic charge neutralization or fusion with cell membranes. Additional approaches are described in Philip, *Mol. Cell Biol.* (1994) 14:2411, and in Woffendin, *Proc. Natl. Acad. Sci.* (1994) 91:1581.

Naked DNA can also be employed. Exemplary naked DNA introduction methods are described in WO 90/11092 and U.S. Pat. No. 5,580,859. Liposomes that can act as gene delivery vehicles are described in U.S. Pat. No. 5,422,120; WO 95/13796; WO 94/23697; WO 91/14445; and EP 0524968.

Further non-viral delivery suitable for use includes mechanical delivery systems such as the approach described in Woffendin et al., *Proc. Natl. Acad. Sci. USA* (1994) 91(24):11581. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO 92/11033.

The present invention will now be illustrated by reference to the following examples which set forth particularly advantageous embodiments. However, it should be noted that these embodiments are illustrative and are not to be construed as restricting the invention in any way.

EXAMPLES

Example 1

Source of Biological Materials and Overview of Novel Polynucleotides Expressed by the Biological Materials Human colon cancer cell line Km12L4-A (Morika, W. A. K. et al., *Cancer Research* (1988) 48:6863) was used to construct a cDNA library from mRNA isolated from the cells. As described in the above overview, a total of 4,693 sequences expressed by the Km12L4-A cell line were isolated and analyzed; most sequences were about 275–300 nucleotides in length. The KM12L4-A cell line is derived from the KM12C cell line. The KM12C cell line, which is poorly metastatic (low metastatic) was established in culture from a Dukes' stage $B_2$ surgical specimen (Morikawa et al. *Cancer Res.* (1988) 48:6863). The KML4-A is a highly metastatic subline derived from KM12C (Yeatman et al. *Nucl. Acids. Res.* (1995) 23:4007; Bao-Ling et al. *Proc. Annu. Meet. Am. Assoc. Cancer. Res.* (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res.* (1995) 1:19; Yeatman et al., (1995) supra; Yeatman et al. *Clin. Exp. Metastasis* (1996) 14:246).

The sequences were first masked to eliminate low complexity sequences using the XBLAST masking program (Claverie "Effective Large-Scale Sequence Similarity Searches," In: *Computer Methods for Macromolecular Sequence Analysis, Doolittle, ed., Meth. Enzymol.* 266:212–227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem.* (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. Masking resulted in the elimination of 43 sequences. The remaining sequences were then used in a BLASTN vs. Genbank search with search parameters of greater than 70% overlap, 99% identity, and a p value of less than $1 \times 10^{-40}$, which search resulted in the discarding of 1,432 sequences. Sequences from this search also were discarded if the inclusive parameters were met, but the sequence was ribosomal or vector-derived.

The resulting sequences from the previous search were classified into three groups (1, 2 and 3 below) and searched in a BLASIX vs. NRP (non-redundant proteins) database search: (1) unknown (no hits in the Genbank search), (2) weak similarity (greater than 45% identity and p value of less than $1 \times 10^{-5}$), and (3) high similarity (greater than 60% overlap, greater than 80% identity, and p value less than $1 \times 10^{-5}$). This search resulted in discard of 98 sequences as having greater than 70% overlap, greater than 99% identity, and p value of less than $1 \times 10^{-40}$.

The remaining sequences were classified as unknown (no hits), weak similarity, and high similarity (parameters as above). Two searches were performed on these sequences. First, a BLAST vs. EST database search resulted in discard of 1771 sequences (sequences with greater than 99% overlap, greater than 99% similarity and a p value of less than $1 \times 10^{-40}$; sequences with a p value of less than $1 \times 10^{-65}$ when compared to a database sequence of human origin were also excluded). Second, a BLASTN vs. Patent GeneSeq database resulted in discard of 15 sequences (greater than 99% identity; p value less than $1 \times 10^{-40}$; greater than 99% overlap).

The remaining sequences were subjected to screening using other rules and redundancies in the dataset. Sequences with a p value of less than $1 \times 10^{-111}$ in relation to a database sequence of human origin were specifically excluded. The final result provided the 2502 sequences listed in the accompanying Sequence Listing. The Sequence Listing is arranged beginning with sequences with no similarity to any sequence in a database searched, and ending with sequences with the greatest similarity. Each identified polynucleotide represents sequence from at least a partial mRNA transcript. Polynucleotides that were determined to be novel were assigned a sequence identification number.

The novel polynucleotides were assigned sequence identification numbers SEQ ID NOS:1–2502. The DNA sequences corresponding to the novel polynucleotides are provided in the Sequence Listing. The majority of the sequences are presented in the Sequence Listing in the 5' to 3' direction. A small number of sequences are listed in the Sequence Listing in the 5' to 3' direction but the sequence as written is actually 3' to 5'. These sequences are readily identified with the designation "AR" in the Sequence Name in Table 1 (inserted before the claims). The sequences correctly listed in the 5' to 3' direction in the Sequence Listing are designated "AF." Table 1 provides: 1) the SEQ ID NO assigned to each sequence for use in the present specification; 2) the filing date of the U.S. priority application in which the sequence was first filed; 3) the SEQ ID NO assigned to the sequence in the priority application; 4) the sequence name used as an internal identifier of the sequence; 5) the name assigned to the clone from which the sequence was isolated; and 6) the number of the cluster to which the sequence is assigned (Cluster ID; where the cluster ID is 0, the sequence was not assigned to any cluster.

Because the provided polynucleotides represent partial mRNA transcripts, two or more polynucleotides of the invention may represent different regions of the same mRNA transcript and the same gene. Thus, if two or more SEQ ID NOS: are identified as belonging to the same clone, then either sequence can be used to obtain the full-length mRNA or gene. In addition, some sequences are identified with multiple SEQ ID NOS, since these sequences were present in more than one filing. For example, SEQ ID NO:87 and SEQ ID NO:1000 represent the same sequence.

In order to confirm the sequences of SEQ ID NOS:1–2502, inserts of the clones corresponding to these polynucleotides were re-sequenced. These "validation" sequences are provided in SEQ ID NOS:2503–5106. Of these validation sequences, SEQ ID NOS:3040, 3545, 3863, 4511, 4726, and 4749 are not true validation sequences. Instead, SEQ ID NOS:3545, 4511, 4726, and 4749 represent "placeholder" sequences, i.e., sequences that were inserted into the Sequence Listing only to prevent renumbering of the subsequent sequences during generation of the Sequence Listing. Thus, reference to "SEQ ID NOS:1–5252," "SEQ ID NOS:1–5106," or other ranges of SEQ ID NOS that include these placeholder sequences should be read to exclude SEQ ID NOS:3545, 4511, 4726, and 4749.

The validation sequences were often longer than the original polynucleotide sequences they validate, and thus often provide additional sequence information. Validation sequences can be correlated with the original sequences they validate by referring to Table 1. For example, validation sequences of SEQ ID NOS:2503–3039, 3041–3544, 3546–3862 3864–4510, and 4512–4725 share the clone name of the sequence of SEQ ID NOS:1–2502 that they validate.

Example 2

Results of Public Database Search to Identify Function of Gene Products

SEQ ID NOS:1–2502, as well as the validation sequences SEQ ID NOS:2503–3039, 3041–3544, 3546–3862

3864–4510, and 4512–4725 xx:clf were translated in all three reading frames to determine the best alignment with the individual sequences. These amino acid sequences and nucleotide sequences are referred, generally, as query sequences, which are aligned with the individual sequences. Query and individual sequences were aligned using the BLAST programs, available over the world wide web at http://ww.ncbi.nlm.nih.gov/BLAST/. Again the sequences were masked to various extents to prevent searching of repetitive sequences or poly-A sequences, using the XBLAST program for masking low complexity as described above in Example 1.

Table 2 (inserted before the claims) shows the results of the alignments. Table 2 refers to each sequence by its SEQ ID NO:, the accession numbers and descriptions of nearest neighbors from the Genbank and Non-Redundant Protein searches, and the p values of the search results.

For each of "SEQ ID NOS:1–5106," the best alignment to a protein or DNA sequence is included in Table 2. The activity of the polypeptide encoded by "SEQ ID NOS:1–5106" is the same or similar to the nearest neighbor reported in Table 2. The accession number of the nearest neighbor is reported, providing a reference to the activities exhibited by the nearest neighbor. The search program and database used for the alignment also are indicated as well as a calculation of the p value.

Full length sequences or fragments of the polynucleotide sequences of the nearest neighbors can be used as probes and primers to identify and isolate the full length sequence of "SEQ ID NOS:1–5106." The nearest neighbors can indicate a tissue or cell type to be used to construct a library for the full-length sequences of "SEQ ID NOS:1–5106."

"SEQ ID NOS:1–5106" and the translations thereof may be human homologs of known genes of other species or novel allelic variants of known human genes. In such cases, these new human sequences are suitable as diagnostics or therapeutics. As diagnostics, the human sequences "SEQ ID NOS:1–5106" exhibit greater specificity in detecting and differentiating human cell lines and types than homologs of other species. The human polypeptides encoded by "SEQ ID NOS1–5106" are likely to be less immunogenic when administered to humans than homologs from other species. Further, on administration to humans, the polypeptides encoded by "SEQ ID NOS:1–5106" can show greater specificity or can be better regulated by other human proteins than are homologs from other species.

Example 3

Members of Protein Families

The validation sequences ("SEQ ID NOS:2503–5106") were used to conduct a profile search as described in the specification above. Several of the polynucleotides of the invention were found to encode polypeptides having characteristics of a polypeptide belonging to a known protein families (and thus represent new members of these protein families) and/or comprising a known functional domain (Table 3, inserted prior to claims). Thus the invention encompasses fragments, fusions, and variants of such polynucleotides that retain biological activity associated with the protein family and/or functional domain identified herein.

Start and stop indicate the position within the individual sequences that align with the query sequence having the indicated SEQ ID NO. The direction (Dir) indicates the orientation of the query sequence with respect to the individual sequence, where forward (for) indicates that the alignment is in the same direction (left to right) as the sequence provided in the Sequence Listing and reverse (rev) indicates that the alignment is with a sequence complementary to the sequence provided in the Sequence Listing.

Some polynucleotides exhibited multiple profile hits because, for example, the particular sequence contains overlapping profile regions, and/or the sequence contains two different functional domains. These profile hits are described in more detail below. The acronyms used in Table 3 are provided in parentheses following the full name of the protein family or functional domain to which they refer.

a) Seven Transmembrane Integral Membrane Proteins—Rhodopsin Family (7tm 1). Several of the validation sequences, and thus their corresponding sequence within SEQ ID NOS:1–2502, correspond to a sequence encoding a polypeptide that is a member of the seven transmembrane receptor rhodopsin family. G-protein coupled receptors of the seven transmembrane rhodopsin family (also called R7G) are an extensive group of hormones, neurotransmitters, and light receptors which transduce extracellular signals by interaction with guanine nucleotide-binding (G) proteins (Strosberg A. D. *Eur. J. Biochem.* (1991) 196:1, Kerlavage A. R. *Curr. Opin. Struct. Biol.* (1991) 1:394, Probst, et al., *DNA Cell Biol.* (1992) 11:1, Savarese, et al., *Biochem. J.* (1992) 283:1, http://www.gcrdb.uthscsa.edu/, http://swift.embl-heidelberg.de/7tm/. The receptors that are currently known to belong to this family are: 1) 5-hydroxytryptamine (serotonin) 1A to 1F, 2A to 2C, 4, 5A, 5B, 6 and 7 (Branchek T., *Curr. Biol.* (1993) 3:315), 2) acetylcholine, muscarinic-type, M1 to M5; 3) adenosine A1, A2A, A2B and A3 (Stiles G. L. *J. Biol. Chem.* (1992) 267:6451; 4) adrenergic alpha-1A to -1C; alpha-2A to -2D; beta-1 to -3 (Friell T. et al., *Trends Neurosci.* (1988) 11:321); 5) angiotensin II types I and II; 6) bombesin subtypes 3 and 4; 7) bradykinin B1 and B2; 8) c3a and C5a anaphylatoxin; 9) cannabinoid CB1 and CB2; 10) chemokines C-C CC-CKR-1 to CC-CKR-8; 11) Chemokines C-X-C CXC-CKR-1 to CXC-CKR4; 12) Cholecystokinin-A and cholecystokinin-B/gastrin Dopamine D1 to D5 (Stevens C. F., *Curr. Biol.* (1991) 1:20); 13) Endothelin ET-a and ET-b (Sakurai T. et al., *Trends Pharmacol. Sci.* (1992) 13:103–107); 14) fMet-Leu-Phe (fMLP) (Nfornyl peptide); 15) Follicle stimulating hormone (FSH-R); 16) Galanin; 17) Gastrin-releasing peptide (GRP-R); 18) Gonadotropin-releasing hormone (GNRH-R); 19) Histamine H1 and H2 (gastric receptor 1); 20) Lutropin-choriogonadotropic hormone (LSH-R) (Salesse R., et al., *Biochimie* (1991) 73:109); 21) Melanocortin MC1R to MC5R; 22) Melatonin; 23) Neuromedin B (NMB-R); 24) Neuromedin K (NK-3R); 25) Neuropeptide Y types 1 to 6; 26) Neurotensin (NT-R); 27) Octopamine (tyramine), from insects; 28) Odorants (Lancet D., et al., *Curr. Biol.* (1993) 3:668; 29) Opioids delta-, kappa- and mu-types (Uhl G. R., et al., *Trends Neurosci.* (1994) 17:89; 30) Oxytocin (OT-R); 31) Platelet activating factor (PAF-R); 32) Prostacyclin; 33) Prostaglandin D2; 34) Prostaglandin E2, EP1 to EP4 subtypes; 35) Prostaglandin F2; 36) Purinoreceptors (ATP) (Barnard E. A., et al., *Trends Pharmacol. Sci.* (1994) 15:67; 37); Somatostatin types 1 to 5; 38) Substance-K (NK-2R); Substance-P (NK-1R); 39) Thrombin; 40) Thromboxane A2; 41) Thyrotropin (TSH-R) (Salesse R., et al., *Biochimie* (1991) 73:109); 42) Thyrotropin releasing factor (TRH-R); 42) Vasopressin V1a, V1b and V2; 43) Visual pigments (opsins and rhodopsin) (Applebury M. L., et al., *Vision Res.* (1986) 26:1881; 44) Proto-oncogene mas; 45) A number of orphan receptors (whose ligand is not known) from mammals and birds; 46) *Caenorhabditis elegans* putative receptors C06G4.5, C38C10.1, C43C3.2; 47) T27D1.3 and ZC84.4; 48) Three putative receptors encoded in the genome of cytomegalovirus: US27, US28, and UL33; and 49) ECRF3, a putative receptor encoded in the genome of herpesvirus saimin.

The structure of these receptors is thought to be identical. They have seven hydrophobic regions, each of which most probably spans the membrane. The N-terminus is located on the extracellular side of the membrane and is often glycosylated, while the C-terminus is cytoplasmic and generally phosphorylated. Three extracellular loops alternate with three intracellular loops to link the seven transmembrane regions. Most, but not all of these receptors, lack a signal peptide. The most conserved parts of these proteins are the transmembrane regions and the first two cytoplasmic loops. A conserved acidic-Arg-aromatic triplet is present in the N-terminal extremity of the second cytoplasmic loop (Attwood T. K., Eliopoulos E. E., Findlay J. B. C. *Gene* (1991) 98:153–159) and could be implicated in the interaction with G proteins.

A consensus pattern that contains the conserved triplet and that also spans the major part of the third transmembrane helix is used to detect this widespread family of proteins: [GSTALIVMFYWC]-[GSTANCPDE]-[EDPKRH]-x(2)-[LIVMNQGA]-x(2)-[LIVMFT]-[GSTANC]-[LIVMFYWSTAC]-[DENH]-R-[FYWCSH]-x(2)-[LIVM].

b) Seven Transmembrane Integral Membrane Proteins—Secretin Family (7tm 2). Several of the validation sequences, and thus their corresponding sequence within SEQ ID NOS:1–2502, correspond to a sequence encoding a polypeptide that is a member of the seven transmembrane receptor secretin family. A number of peptide hormones bind to G-protein coupled receptors that, while structurally similar to the majority of G-protein coupled receptors (R7G) (see profile for 7 transmembrane receptors (rhodopsin family), do not show any similarity at the level of their sequence, thus new family whose current known members (Jueppner et al. *Science* (1991) 254:1024; Hamann et al. *Genomics* (1996) 32:144) are: 1) calcitonin receptor, 2) calcitonin gene-related peptide receptor; 3) corticotropin releasing factor receptor types 1 and 2; 4) gastric inhibitory polypeptide receptor; 5) glucagon receptor; 6) glucagon-like peptide 1 receptor; 7) growth hormone-releasing hormone receptor; 7) parathyroid hormone/parathyroid hormone-related peptide types 1 and 2; 8) pituitary adenylate cyclase activating polypeptide receptor, 9) secretin receptor, 10) vasoactive intestinal peptide receptor types 1 and 2; 10) insects diuretic hormone receptor; 11) *Caenorhabditis elegans* putative receptor C13B9.4; 12) *Caenorhabditis elegans* putative receptor ZK643.3; 13) human leucocyte CD97 (which contains 3 EGF-like domains in its N-terminal section); 14) human cell surface glycoprotein EMR1 (which contains 6 EGF-like domains in it N-terminal section); and 15) mouse cell surface glycoprotein F4/80 (which contains 7 EGF-like domains in its N-terminal section). All of 1) through 10) are coupled to G-proteins which activate both adenylyl cyclase and the phosphatidylinositol-calcium pathway.

Like classical R7G the secretin family of 7 transmembrane proteins contain seven transmembrane regions. Their N-terminus is located on the extracellular side of the membrane and potentially glycosylated, while their C-terminus is cytoplasmic. But apart from these topological similarities they do not share any region of sequence similarity and are therefore probably not evolutionary related.

Every receptor in the 7 transmember secretin family is encoded on multiple exons, and several of these functionally distinct products. The N-terminal extracellular domain of these receptors contains five conserved cysteines residues that may be involved in disulfide bonds, with a consensus pattern in the region that spans the first three cysteines. One of the most highly conserved regions spans the C-terminal part of the last transmembrane region and the beginning of the adjacent intracellular region. This second region is used as a second signature pattern. The two consensus patterns are:

1) C-x(3)-[FYWLIV]-D-x(3,4)-C-[F-W]-x(2)-[STAGV]-x(8,9)-C-[PF]
2) Q-G-[LMFCA]-[LIVMFT]-[LIV]-x-[LIVFST]-[LIF]-[VFYH]-C-[LFY]-x-N-x(2)-V c) Ank Repeats (ANK). SEQ IS NO:2656, and thus its corresponding sequence within SEQ ID NOS:1–2502, represents a polynucleotide encoding an Ank repeat-containing protein. The ankyrin motif is a 33 amino acid sequence named after the protein ankyrin which has 24 tandem 33-amino-acid motifs. Ank repeats were originally identified in the cell-cycle-control protein cdc10 (Breeden et al., *Nature* (1987) 329:651). Proteins containing ankyrin repeats include ankyrin, myotropin, I-kappaB proteins, cell cycle protein cdc10, the Notch receptor (Matsuno et al., *Development* (1997) 124(21):4265); G9a (or BAT8) of the class III region of the major histocompatibility complex (Biochem J. 290:811–818, 1993), FABP, GABP, 53BP2, Lin12, glp1, SW14, and SW16. The functions of the ankyrin repeats are compatible with a role in protein-protein interactions (Bork, *Proteins* (1993) 17(4):363; Lambert and Bennet, *Eur. J. Biochem.* (1993) 211:1; Kerr et al., *Current Op. Cell Biol.* (1992) 4:496; Bennet et al., *J. Biol. Chem.* (1980) 255:6424).

The 90 kD N-terminal domain of ankyrin contains a series of 24 33-amino-acid ank repeats. (Lux et al., *Nature* (1990) 344:36–42, Lambert et al., *PNAS USA* (1990) 87:1730.) The 24 ank repeats form four folded subdomains of 6 repeats each. These four repeat subdomains mediate interactions with at least 7 different families of membrane proteins. Ankyrin contains two separate binding sites for anion exchanger dimers. One site utilizes repeat subdomain two (repeats 7–12) and the other requires both repeat subdomains 3 and 4 (repeats 13–24). Since the anion exchangers exist in dimers, ankyrin binds 4 anion exchangers at the same time (Michaely and Bennett, *J. Biol. Chem.* (1995) 270(37):22050). The repeat motifs are involved in ankyrin interaction with tubulin, spectrin, and other membrane proteins. (Lux et al., *Nature* (1990) 344:36.)

The Rel/NF-kappaB/Dorsal family of transcription factors have activity that is controlled by sequestration in the cytoplasm in association with inhibitory proteins referred to as I-kappaB. (Gilmore, *Cell* (1990) 62:841; Nolan and Baltimore, *Curr Opin Genet Dev.* (1992) 2:211; Baeuerle, *Biochim Biophys Acta* (1991) 1072:63; Schmitz et al., *Trends Cell Biol.* (1991) 1:130.) I-kappaB proteins contain 5 to 8 copies of 33 amino acid ankyrin repeats and certain NF-kappaB/rel proteins are also regulated by cis-acting ankyrin repeat containing domains including p105NF-kappaB which contains a series of ankyrin repeats (Diehl and Hannink, *J. Virol.* (1993) 67(12):7161). The I-kappaBs and Cactus (also containing ankyrin repeats) inhibit activators through differential interactions with the Rel-homology domain. The gene family includes proto-oncogenes, thus broadly implicating I-kappaB in the control of both normal gene expression and the aberrant gene expression that makes cells cancerous. (Nolan and Baltimore, *Curr Opin Genet Dev.* (1992) 2(2):211–220). In the case of rel/NF-kappaB and pp40/I-kappaB(, both the ankyrin repeats and the carboxy-terminal domain are required for inhibiting DNA-binding activity and direct association of pp40/I-kappaB (with rel/NF-kappaB protein. The ankyrin repeats and the carboxy-terminal of pp40/I-kappaB(form a structure that associates with the rel homology domain to inhibit DNA binding activity (Inoue et al., *PNAS USA* (1992) 89:4333).

The 4 ankyrin repeats in the amino terminus of the transcription factor subunit GABP are required for its interaction with the GABP subunit to form a functional high affinity DNA-binding protein. These repeats can be crosslinked to DNA when GABP is bound to its target sequence. (Thompson et al., *Science* μ(1991) 253:762; LaMarco et al., *Science* (1991) 253:789). Myotrophin, a 12.5 kDa protein having a key role in the initiation of cardiac hypertrophy, comprises ankyrin repeats. The ankyrin repeats are characteristic of a hairpin-like protruding tip followed by a helix-turn-helix motif. The V-shaped helix-turn-helix of the repeats stack sequentially in bundles and are stabilized by compact hydrophobic cores, whereas the protruding tips are less ordered.

d) Eukaryotic Aspartyl Proteases (asp). Several of the validation sequences, and thus their corresponding sequence within SEQ ID NOS:1–2502, correspond to a sequence encoding a novel eukaryotic aspartyl protease. Aspartyl proteases, known as acid proteases, (EC 3.4.23.-) are a widely distributed family of proteolytic enzymes (Foltmann B., *Essays Biochem.* (1981) 17:52; Davies D. R., *Annu. Rev. Biophys. Chem.* (1990) 19:189; Rao J. K. M., et al., *Biochemistry* (1991) 30:4663) known to exist in vertebrates, fungi, plants, retroviruses and some plant viruses. Aspartate proteases of eukaryotes are monomeric enzymes which consist of two domains. Each domain contains an active site centered on a catalytic aspartyl residue. The two domains most probably evolved from the duplication of an ancestral gene encoding a primordial domain. Currently known eukaryotic aspartyl proteases include: 1) Vertebrate gastric pepsins A and C (also known as gastricsin); 2) Vertebrate chymosin (rennin), involved in digestion and used for making cheese; 3) Vertebrate lysosomal cathepsins D (EC 3.4.23.5) and E (EC 3.4.23.34); 4) Mammalian renin (EC 3.4.23.15) whose function is to generate angiotensin I from angiotensinogen in the plasma; 5) Fungal proteases such as aspergillopepsin A (EC 3.4.23.18), candidapepsin (EC 3.4.23.24), mucoropepsin (EC 3.4.23.23) (mucor rennin), endothiapepsin (EC 3.4.23.22), polyporopepsin (EC 3.4.23.29), and rhizopuspepsin (EC 3.4.23.21); and 6) Yeast saccharopepsin (EC 3.4.23.25) (proteinase A) (gene PEP4). PEP4 is implicated in posttranslational regulation of vacuolar hydrolases; 7) Yeast barrierpepsin (EC 3.4.23.35) (gene BAR1); a protease that cleaves alpha-factor and thus acts as an antagonist of the mating pheromone; and 8) Fission yeast sxa1 which is involved in degrading or processing the mating pheromones.

Most retroviruses and some plant viruses, such as badnaviruses, encode for an aspartyl protease which is an homodimer of a chain of about 95 to 125 amino acids. In most retroviruses, the protease is encoded as a segment of a polyprotein which is cleaved during the maturation process of the virus. It is generally part of the pol polyprotein and, more rarely, of the gag polyprotein. Because the sequence around the two aspartates of eukaryotic aspartyl proteases and around the single active site of the viral proteases is conserved, a single signature pattern can be used to identify members of both groups of proteases. The consensus pattern is: [LIVMFGAC]-[LIVMTADN]-[LIVFSA]-D-[ST]-G-[STAV]-[STAPDENQ]-x-[LIVMFSTNC]-x-[LIVMFGTA], where D is the active site residue.

e) ATPases Associated with Various Cellular Activities (ATPases). Several of the validation sequences, and thus their corresponding sequence within SEQ ID NOS:1–2502, correspond to a sequence that encodes a novel member of the "ATPases Associated with diverse cellular Activities" (AAA) protein family. The AAA protein family is composed of a large number of ATPases that share a conserved region of about 220 amino acids that contains an ATP-binding site (Froehlich et al., *J. Cell Biol.* (1991) 114:443; Erdmann et al. *Cell* (1991) 64:499; Peters et al., *EMBO J.* (1990) 9:1757; Kunau et al., *Biochimie* (1993) 75:209–224; Confalonieri et al., *BioEssays* (1995) 17:639; http://yeamnob.pci.chemie.uni-tuebingen.de/AAA/Description.html). The proteins that belong to this family either contain one or two AAA domains.

Proteins containing two AAA domains include: 1) Mammalian and *drosophila* NSF (N-ethylmaleimide-sensitive fusion protein) and the fungal homolog, SEC18, which are involved in intracellular transport between the endoplasmic reticulum and Golgi, as well as between different Golgi cisternae; 2) Mammalian transitional endoplasmic reticulum ATPase (previously known as p97 or VCP), which is involved in the transfer of membranes from the endoplasmic reticulum to the golgi apparatus. This ATPase forms a ring-shaped homooligomer composed of six subunits. The yeast homolog, CDC48, plays a role in spindle pole proliferation; 3) Yeast protein PAS1 essential for peroxisome assembly and the related protein PAS1 from *Pichia pastoris*; 4) Yeast protein AFG2; 5) *Sulfolobus acidocaldarius* protein SAV and *Halobacterium salinarium* cdcH, which may be part of a transduction pathway connecting light to cell division.

Proteins containing a single AAA domain include: 1) *Escherichia coli* and other bacteria ftsH (or hflb) protein. FtsH is an ATP-dependent zinc metallopeptidase that degrades the heat-shock sigma-32 factor, and is an integral membrane protein with a large cytoplasmic C-terminal domain that contain both the AAA and the protease domains; 2) Yeast protein YME1, a protein important for maintaining the integrity of the mitochondrial compartment. YME1 is also a zinc-dependent protease; 3) Yeast protein AFG3 (or YTA10). This protein also contains an AAA domain followed by a zinc-dependent protease domain; 4) Subunits from regulatory complex of the 26S proteasome (Hilt et al., *Trends Biochem. Sci.* (1996) 21:96), which is involved in the ATP-dependent degradation of ubiquitinated proteins, which subunits include: a) Mammalian 4 and homologs in other higher eukaryotes, in yeast (gene YTA5) and fission yeast (gene mts2); b) Mammalian 6 (TBP7) and homologs in other higher eukaryotes and in yeast (gene YTA2); c) Mammalian subunit 7 (MSS1) and homologs in other higher eukaryotes and in yeast (gene CIM5 or YTA3); d) Mammalian subunit 8 (P45) and homologs in other higher eukaryotes and in yeast (SUG1 or CIM3 or TBY1) and fission yeast (gene let1); e) Other probable subunits include human TBP1, which influences HIV gene expression by interacting with the virus tat transactivator protein, and yeast YTA1 and YTA6; 5) Yeast protein BCS1, a mitochondrial protein essential for the expression of the Rieske iron-sulfur protein; 6) Yeast protein MSP1, a protein involved in intramitochondrial sorting of proteins; 7) Yeast protein PAS8, and the corresponding proteins PAS5 from *Pichia pastoris* and PAY4 from *Yarrowia lipolytica*; 8) Mouse protein SKD1 and its fission yeast homolog (SpAC2G11.06); 9) *Caenorhabditis elegans* meiotic spindle formation protein mei-1; 10) Yeast protein SAP1; 11) Yeast protein YTA7; and 12) *Mycobacterium leprae* hypothetical protein A2126A.

In general, the AAA domains in these proteins act as ATP-dependent protein clamps (Confalonieri et al. (1995) *BioEssays* 17:639). In addition to the ATP-binding 'A' and 'B' motifs, which are located in the N-terminal half of this domain, there is a highly conserved region located in the central part of the domain which was used in the development of the signature pattern. The consensus pattern is: [LIVMT]-x-[LIVMT]-[LIVMF]-x-[GATMC]-[ST]-[NS]-x(4)-[LIVM]-D-x-A-[LIFA]-x-R.

f) Bcl-2 family (Bcl-2). SEQ ID NO:3404, and thus the corresponding sequence it validates, represents a polynucleotide encoding an apoptosis regulator protein of the Bcl-2 family. Active cell suicide (apoptosis) is induced by events such as growth factor withdrawal and toxins. It is controlled by regulators, which have either an inhibitory effect on programmed cell death (anti-apoptotic) or block the protective effect of inhibitors (pro-apoptotic) (Vaux, 1993, Curr. Biol. 3:877–878, and White, 1996, Genes Dev. 10:2859–2869). Many viruses have found a way of countering defensive apoptosis by encoding their own anti-apoptosis genes, preventing their target cells from dying prematurely.

All proteins belonging to the Bcl-2 family (Reed et al., 1996, Adv. Exp. Med. Biol. 406:99–112) contain either a BH1, BH2, BH3, or BH4 domain. All anti-apoptotic proteins contain BH1 and BH2 domains; some of them contain an additional N-terminal BH4 domain (Bcl-2, Bcl-x(L), Bcl-w), which is never seen in pro-apoptotic proteins, except for Bcl-x(S). On the other hand, all pro-apoptotic proteins contain a BH3 domain (except for Bad) necessary for dimerization with other proteins of Bcl-2 family and crucial for their killing activity; some of them also contain BH1 and BH2 domains (Bax, Bak). The BH3 domain is also present in some anti-apoptotic protein, such as Bcl-2 or Bcl-x(L). Proteins that are known to contain these domains are listed below.

1. Vertebrate protein Bcl-2. Bcl-2 blocks apoptosis; it prolongs the survival of hematopoietic cells in the absence of required growth factors and also in the presence of various stimuli inducing cellular death. Two isoforms of bcl-2 (alpha and beta) are generated by alternative splicing. Bcl-2 is expressed in a wide range of tissues at various times during development. It forms heterodimers with the Bax proteins.
2. Vertebrate protein Bcl-x. Two isoforms of Bcl-x (Bcl-x(L) and Bcl-x(S)) are generated by alternative splicing. While the longer product (Bcl-x(L)) can protect a growth-factor-dependent cell line from apoptosis, the shorter form blocks the protective effect of Bcl-2 and Bcl-x(L) and acts as an anti-anti-apoptosis protein.
3. Mammalian protein Bax. Bax blocks the anti-apoptosis ability of Bcl-2 with which it forms heterodimers. There is no evidence that Bax has any activity in the absence of Bcl-2. Three isoforms of bax (alpha, beta and gamma) are generated by alternative splicing.
4. Mammalian protein Bak, which promotes cell death and counteracts the protection from apoptosis provided by Bcl-2.
5. Mammalian protein Bcl-w, which promotes cell survival.
6. Mammalian protein bad, which promotes cell death, and counteracts the protection from apoptosis provided by Bcl-x(L), but not that of Bcl-2.
7. Human protein Bik, which promotes cell death, but cannot counteract the protection from apoptosis provided by Bcl-2.
8. Mouse protein Bid, which induces caspases and apoptosis, and counteracts the protection from apoptosis provided by Bcl-2.
9. Human induced myeloid leukemia cell differentiation protein MCL1. MCL1 is probably involved in programming of differentiation and concomitant maintenance of viability but not proliferation. Its expression increases early during phorbol ester induced differentiation in myeloid leukemia cell line ML-1.
10. Mouse hemopoietic-specific early response protein A1.
11. Mammalian activator of apoptosis Harakiri (Inohara et al., 1997, EMBO J. 16:1686–1694) (also known as neuronal death protein Dp5). This is a small protein of 92 residues that activates apoptosis. It contains a BH3 domain, but no BH1, BH2 or BH4 domains.

The following consensus patterns have been developed for the four BH domains:
1) [LVME]-[FT]-x-[GSD]-x-[GL]-x(1,2)-[NS]-[YW]-G-R-[LIV]-[LIVC]-[GAT]-[LIVMF](2)-x-F-[GSAE]-[GSARY]
2) W-[LIM]-x(3)-[GR]-G-[WQ]-[DENSAV]-x-[FLGA]-[LIVFTC]
3) [LIVAT]-x(3)-L-[KARQ]-x-[IVAL]-G-D-[DESG]-[LIMFV]-[DENSHQ]-[LVSHRQ]-[NSR]
4) [DS]-[NT]-R-[AE]-[LI]-V-x-[KD]-[FY]-[LIV]-[GHS]-Y-K-L-[SR]-Q-[RK]-G-[HY]-x-[CW].

g) Bromodomain (bromodomain). SEQ ID NOS:4036 and 4489, and thus the corresponding sequences they validate, represent polynucleotides encoding a polypeptide having a bromodomain region (Haynes et al., 1992, Nucleic Acids Res. 20:2693–2603, Tamkun et al., 1992, Cell 68–561–572, and Tamkun, 1995, Curr. Opin. Genet. Dev. 5:473–477), which is a conserved region of about 70 amino acids found in the following proteins: 1) Higher eukaryotes transcription initiation factor TFIID 250 Kd subunit (TBP-associated factor p250) (gene CCG1); P250 is associated with the TFIID TATA-box binding protein and seems essential for progression of the G1 phase of the cell cycle. 2) Human RING3, a protein of unknown function encoded in the MHC class II locus; 3) Mammalian CREB-binding protein (CBP), which mediates cAMP-gene regulation by binding specifically to phosphorylated CREB protein; 4) Mammalian homologs of brahma, including three brahma-like human: SNF2a(hBRM), SNF2b, and BRG1; 5) Human BS69, a protein that binds to adenovirus E1A and inhibits E1A transactivation; 6) Human peregrin (or Br140).

The bromodomain is thought to be involved in protein-protein interactions and may be important for the assembly or activity of multicomponent complexes involved in transcriptional activation. The consensus pattern, which spans a major part of the bromodomain, is: [STANVF]-x(2)-F-x(4)-[DNS]-x(5,7)-[DENQTF]-Y-[HFY]-x(2)-[LIVMFY]-x(3)-[LIVM]-x(4)-[LIVM]-x(6,8)-Y-x(12,13)-[LIVM]-x(2)-N-[SACF]-x(2)-[FY].

h) Basic Region Plus Leucine Zipper Transcription Factors (BZIP). SEQ ID NO:3408, 2951, and 4850, and thus the corresponding sequences these sequences validate, represent polynucleotides encoding a novel member of the family of basic region plus leucine zipper transcription factors. The bZIP superfamily (Hurst, *Protein Prof.* (1995) 2:105; and Ellenberger, *Curr. Opin. Struct. Biol.* (1994) 4:12) of eukaryotic DNA-binding transcription factors encompasses proteins that contain a basic region mediating sequence-specific DNA-binding followed by a leucine zipper required for dimerization. Members of the family include transcription factor AP-1, which binds selectively to enhancer elements in the cis control regions of SV40 and metallothionein IIA. AP-1, also known as c-jun, is the cellular homolog of the avian sarcoma virus 17 (ASV 17) oncogene v-jun. Other members of this protein family include jun-B and jun-D, probable transcription factors that are highly similar to jun/AP-1; the fos protein, a proto-oncogene that forms a non-covalent dimer with c-jun; the fos-related proteins fra-1, and fos B; and mammalian cAMP response element (CRE) binding proteins CREB, CREM, ATF-1, ATF-3, ATF-4, ATF-5, ATF-6 and LRF-1. The consensus pattern for this protein family is: [KR]-x(1,3)-[RKSAQ]-N-x(2)-[SAQ](2)-x-[RKTAENQ]-x-R-x-[RK].

i) Cyclins (cyclin). SEQ ID NOS:3618, 3895, and 4536, and thus the corresponding sequences these sequences validate, represent polynucleotides encoding cyclins, and SEQ ID NO:55 and 56, respectively, show the corresponding full-length polynucleotides. SEQ ID NO:57 and 58 show, respectively, the translations of SEQ ID NO:55 and 56. Cyclins (Nurse, 1990, Nature 344:503–508; Norbury et al., 1991, Curr. Biol. 1:23–24; and Lew et al., 1992, Trends Cell Biol. 2:77–81) are eukaryotic proteins that play an active role in controlling nuclear cell division cycles. There are two main groups of cyclins. G2/M cyclins are essential for the control of the cell cycle at the G2/M (mitosis) transition. G2/M cyclins accumulate steadily during G2 and are abruptly destroyed as cells exit from mitosis (at the end of the M-phase). G1/S cyclins are essential for the control of the cell cycle at the G1/S (start) transition.

The best conserved region is in the central part of the cyclins' sequences, known as the "cyclin-box," from which a 32 residue consensus pattern was derived: R-x(2)-[LIVMSA]-x(2)-[FYWS]-[LIVM]-x(8)-[LIVMFC]-x(4)-[LIVMFYA]-x(2)-[STAGC]-[LIVMFYQ]-x-[LIVMFYC]-[LIVMFY]-D-[RKH]-[LIVMFYW].

j) Eukaryotic thiol (cysteine) proteases active sites (Cys-protease). SEQ ID NOS:3344, 3684, 3688, and 4801, and thus also the sequences they validate, represent polynucleotides encoding proteins having a eukaryotic thiol (cysteine) protease active site. Eukaryotic thiol proteases (Dufour E., Biochimie (1988) 70:1335); are a family of proteolytic enzymes which contain an active site cysteine. Catalysis proceeds through a thioester intermediate and is facilitated by a nearby histidine side chain; an asparagine completes the essential catalytic triad. The proteases that belong to this family are: 1) vertebrate lysosomal cathepsins B (Kirschke H., et al., Protein Prof. (1995) 2:1587–1643); 2) vertebrate lysosomal dipeptidyl peptidase 1 (also known as cathepsin C) (Kirschke H., et al., supra); 3) vertebrate calpains (Calpains are intracellular calcium-activated thiol protease that contain both an N-terminal catalytic domain and a C-terminal calcium-binding domain); 4) mammalian cathepsin K, which seems involved in osteoclastic bone resorption (Shi G.-P., et al., FEBS Lett. (1995) 357:129); 5) human cathepsin O ([4] Velasco G., Ferrando A. A., Puente X. S., Sanchez L. M., Lopez-Otin C. J. Biol. Chem. (1994) 269:27136); 6) bleomycin hydrolase (which catalyzes the inactivation of the antitumor drug BLM (a glycopeptide)); 7) Plant enzymes such as: barley aleurain, EP-B1/B4; kidney bean EP-C1, rice bean SH-EP; kiwi fruit actinidin; papaya latex papin, chyrnopapain, caricain, and proteinase IV; pea turgor-responsive protein 15A; pineapple stem bromelain; rape COT44; rice oryzain alpha, beta, and gamma; tomato low-temperature induced, Arabidopsis thaliana A494, RD19A and RD21A; 8)—House-dust mites allergens DerP1 and EurM1; 9) cathepsin B-like proteinases from the worms Caenorhabditis elegans (genes gcp-1, cpr-3, cpr-4, cpr-5 and cpr-6), Schistosoma mansoni (antigen SM31) and Japonica (antigen SJ31), Haemonchus contortus (genes AC-1 and AC-2), and Ostertagia ostertagi (CP-1 and CP-3); 10) slime mold cysteine proteinases CP1 and CP2; 11) cruzipain from Trypanosoma cruzi and brucei; 12) thropho- zoite cysteine proteinase (TCP) from various Plasmodium species; 13) proteases from Leishmania mexicana, Theileria annulata and Theileria parva; 14) Baculoviruses cathepsin-like enzyme (v-cath); 15) Drosophila small optic lobes protein (gene sol), a neuronal protein that contains a calpain-like domain; 16) yeast thiol protease BLH1/YCP1/LAP3; 17) Caenorhabditis elegans hypothetical protein C06G4.2, a calpain-like protein.

In addition, two bacterial peptidases are also part of this family: 1) aminopeptidase C- from Lactococcus lactis (gene pepC) (Chapot-Chartier M. P., et al., Appl. Environ. Microbiol. (1993) 59:330); and 2) thiol protease tpr from Porphyromonas gingivalis. Three other proteins are structurally related to this family, but may have lost their proteolytic activity. These include: 1) soybean oil body protein P34 (which has its active site cysteine replaced by a glycine); 2) rat testin (which is a sertoli cell secretory protein highly similar to cathepsin L but with the active site cysteine is replaced by a serine); and 3) Plasmodium falciparum serine-repeat protein (SERA) (which is the major blood stage antigen and possesses a C-terminal thiol-protease-like domain (Higgins D. G., et al., Nature (1989) 340:604), with the active site cysteine is replaced by a serine).

The sequences around the three active site residues are well conserved and can be used as signature patterns:

Consensus pattern #1: Q-x(3)-[GE]-x-C-[YW]-x(2)-[STAGC]-[STAGCV] (where C is the active site residue)

Consensus pattern #2: [LIVMGSTAN]-x-H-[GSACE]-[LIVM]-x-[LIVMAT](2)-G-x-[GSADNH] (where H is the active site residue);

Consensus pattern #3: [FYCH]-[WI]-[LIVT]-x-[KRQAG]-N-[ST]-W-x(3)-[FYW]-G-x(2)-G-[LFYW]-[LIVMFYG]-x-[LIVMF] (where N is the active site residue).

k) Phorbol Esters/Diacylplycerol Binding (DAG_PE_bind). SEQ ID NO:4659, and thus the sequence it validates, represents a polynucleotide encoding a protein belonging to the family including phorbol esters/diacylglycerol binding proteins. Diacylglycerol (DAG) is an important second messenger. Phorbol esters (PE) are analogues of DAG and potent tumor promoters that cause a variety of physiological changes when administered to both cells and tissues. DAG activates a family of serine/threonine protein kinases, collectively known as protein kinase C (PKC) (Azzi et al, Eur. J. Biochem. (1992) 208:547). Phorbol esters can directly stimulate PKC. The N-terminal region of PKC, known as C1, has been shown (Ono et al., Proc. Natl. Acad. Sci. USA (1989) 86:4868) to bind PE and DAG in a phospholipid and zinc-dependent fashion. The C1 region contains one or two copies (depending on the isozyme of PKC) of a cysteine-rich domain about 50 amino-acid residues long and essential for DAG/PE-binding. Such a domain has also been found in, for example, the following proteins.

(1) Diacylglycerol kinase (EC 2.7.1.107) (DGK) (Sakane et al., Nature (1990) 344:345), the enzyme that converts DAG into phosphatidate. It contains two copies of the DAG/PE-binding domain in its N-terminal section. At least five different forms of DGK are known in mammals; and (2) N-chimaerin, a brain specific protein which shows sequence similarities with the BCR protein at its C-terminal part and contains a single copy of the DAG/PE-binding domain at its N-terminal part. It has been shown (Ahmed et al., Biochem. J. (1990) 272:767, and Ahmed et al., Biochem. J. (1991) 280:233) to be able to bind phorbol esters.

The DAG/PE-binding domain binds two zinc ions; the ligands of these metal ions are probably the six cysteines and two histidines that are conserved in this domain. The signature pattern completely spans the DAGIPE domain. The consensus pattern is: H-x-[LIVMFYW]-x(8,11)-C-x(2)-C-x(3)-[LIVMFC]-x(5,10)-C-x(2)-C-x(4)-[HD]-x(2)-C-x(5,9)-C. All the C and H are probably involved in binding zinc.

l) DEAD and DEAH box families ATP-dependent helicases signatures (Dead_box_helic). SEQ ID NOS:4821 and 5083, and thus the sequences they validate, represent polynucleotides encoding a novel member of the DEAD box family. A number of eukaryotic and prokaryotic proteins have been characterized (Schmid S. R., et al., *Mol. Microbiol.* (1992) 6:283; Linder P., et al., *Nature* (1989) 337:121; Wassarman D. A., et al., *Nature* (1991) 349:463) on the basis of their structural similarity. All are involved in ATP-dependent, nucleic-acid unwinding. Proteins currently known to belong to this family are:

1) Initiation factor eIF-4A. Found in eukaryotes, this protein is a subunit of a high molecular weight complex involved in 5 'cap recognition and the binding of mRNA to ribosomes. It is an ATP-dependent RNA-helicase.

2) PRP5 and PRP28. These yeast proteins are involved in various ATP-requiring steps of the pre-mRNA splicing process.

3) P110, a mouse protein expressed specifically during spermatogenesis.

4) An3, a *Xenopus* putative RNA helicase, closely related to P110.

5) SPP81/DED1 and DBP1, two yeast proteins involved in pre-mRNA splicing and related to P110.

6) *Caenorhabditis elegans* helicase glh-1.

7) MSS116, a yeast protein required for mitochondrial splicing.

8) SPB4, a yeast protein involved in the maturation of 25S ribosomal RNA.

9) p68, a human nuclear antigen. p68 has ATPase and DNA-helicase activities in vitro. It is involved in cell growth and division.

10) Rm62 (p62), a *Drosophila* putative RNA helicase related to p68.

11) DBP2, a yeast protein related to p68.

12) DHH1, a yeast protein.

13) DRS1, a yeast protein involved in ribosome assembly.

14) MAK5, a yeast protein involved in maintenance of dsRNA killer plasmid.

15) ROK1, a yeast protein.

16) ste13, a fission yeast protein.

17) Vasa, a *Drosophila* protein important for oocyte formation and specification of embryonic posterior structures.

18) Me3 B, a *Drosophila* alternally expressed protein of unknown function.

19) dbpA, an *Escherichia coli* putative RNA helicase.

20) deaD, an *Escherichia coli* putative RNA helicase which can suppress a mutation in the rpsB gene for ribosomal protein S2.

21) rhlB, an *Escherichia coli* putative RNA helicase.

22) rhlE, an *Escherichia coli* putative RNA helicase.

23) rmB, an *Escherichia coli* protein that shows RNA-dependent ATPase activity, which interacts with 23S ribosomal RNA.

24) *Caenorhabditis elegans* hypothetical proteins T26G10.1, ZK512.2 and ZK686.2.

25) Yeast hypothetical protein YHR065c.

26) Yeast hypothetical protein YHR169w.

27) Fission yeast hypothetical protein SpAC31A2.07c.

28) *Bacillus subtilis* hypothetical protein yxiN.

All of the above proteins share a number of conserved sequence motifs. Some of them are specific to this family while others are shared by other ATP-binding proteins or by proteins belonging to the helicases 'superfamily' (Hodgman T. C., *Nature* (1988) 333:22 and *Nature* (1988) 333:578 (Errata); http://www.expasy.ch/www/linder/HELICASES_TEXT.html). One of these motifs, called the 'D-E-A-D-box', represents a special version of the B motif of ATP-binding proteins. Some other proteins belong to a subfamily which have His instead of the second Asp and are thus said to be 'D-E-A-H-box' proteins (Wassarman D. A., et al., *Nature* (1991) 349:463; Harosh I., et al., *Nucleic Acids Res.* (1991) 19:6331; Koonin E. V., et al., *J. Gen. Virol.* (1992) 73:989; http://www.expasy.ch/www/linder/HELICASES_TEXT.html). Proteins currently known to belong to this DEAH subfamily are:

1) PRP2, PRP16, PRP22 and PRP43. These yeast proteins are all involved in various ATP-requiring steps of the pre-mRNA splicing process. 2) Fission yeast prh1, which my be involved in pre-mRNA splicing. 3) Male-less (mle), a *Drosophila* protein required in males, for dosage compensation of X chromosome linked genes. 4) RAD3 from yeast. RAD3 is a DNA helicase involved in excision repair of DNA damaged by UV light, bulky adducts or cross-linking agents. Fission yeast rad15 (rhp3) and mammalian DNA excision repair protein XPD (ERCC-2) are the homologs of RAD3. 5) Yeast CHL1 (or CTF1), which is important for chromosome transmission and normal cell cycle progression in G(2)/M. 6) Yeast TPS1. 7) Yeast hypothetical protein YKL078w. 8) *Caenorhabditis elegans* hypothetical proteins C06E1.10 and KO3H1.2. 9) Poxviruses' early transcription factor 70 Kd subunit which acts with RNA polymerase to initiate transcription from early gene promoters. 10) I8, a putative vaccinia virus helicase. 11) hrpA, an *Escherichia coli* putative RNA helicase.

The following signature patterns are used to identify member for both subfamilies:

Consensus pattern: [LVMF](2)-D-E-A-D-[RKEN]-x-[LIVMFYGSTN]

Consensus pattern: [GSAH]-x-[LIVMF](3)-D-E-[ALIV]-H-[NECR].

m) EF Hand (EFhand). Several of the validation sequences, and thus the sequences they validate, correspond to polynucleotides encoding a novel protein in the family of EF-hand proteins. Many calcium-binding proteins belong to the same evolutionary family and share a type of calcium-binding domain known as the EF-hand (Kawasaki et al., *Protein. Prof.* (1995) 2:305–490). This type of domain consists of a twelve residue loop flanked on both sides by a twelve residue alpha-helical domain. In an EF-hand loop the calcium ion is coordinated in a pentagonal bipyramidal configuration. The six residues involved in the binding are in positions 1, 3, 5, 7, 9 and 12; these residues are denoted by X, Y, Z, -Y, -X and -Z. The invariant Glu or Asp at position 12 provides two oxygens for liganding Ca (bidentate ligand).

Proteins known to contain EF-hand regions include: Calmodulin (Ca=4, except in yeast where Ca=3) ("Ca=" indicates approximate number of EF-hand regions); diacylglycerol kinase (EC 2.7.1.107) (DGK) (Ca=2); 2) FAD-dependent glycerol-3-phosphate dehydrogenase (EC 1.1.99.5) from mammals (Ca=1); guanylate cyclase activating protein (GCAP) (Ca=3); MIF related proteins 8 (MRP-8 or CFAG) and 14 (MRP-14) (Ca=2); myosin regulatory light chains (Ca=1); oncomodulin (Ca=2); osteonectin (basement membrane protein BM40) (SPARC); and proteins that contain an "osteonectin[ domain (QR1, matrix glycoprotein SC1).

The consensus pattern includes the complete EF-hand loop as well as the first residue which follows the loop and which seem to always be hydrophobic: D-x-[DNS]-{ILVFYW}-[DENSTG]-[DNQGHRK]-{GP}-LIVMC]-[DENQSTAGC]-x(2)-[DE]-[LIVMFYW].

n) Ets Domain (Ets_Nterm). SEQ ID NO:2849, and thus the sequence it validates, represents a polynucleotide encoding a polypeptide with N-terminal homology in ETS domain. Proteins of this family contain a conserved domain, the "ETS-domain," that is involved in DNA binding. The domain appears to recognize purine-rich sequences; it is about 85 to 90 amino acids in length, and is rich in aromatic and positively charged residues (Wasylyk, et al., *Eur. J. Biochem.* (1993) 211:718).

The ets gene family encodes a novel class of DNA-binding proteins, each of which binds a specific DNA sequence. These proteins comprise an ets domain that specifically interacts with sequences containing the common core tri-nucleotide sequence GGA. In addition to an ets domain, native ets proteins comprise other sequences which can modulate the biological specificity of the protein. Ets genes and proteins are involved in a variety of essential biological processes including cell growth, differentiation and development, and three members are implicated in oncogenic process.

o) Type II fibronectin collagen-binding domain (FntypeII). A few of the validation sequences, and thus the sequences they validate, represent polynucleotides encoding a polypeptide having a type II fibronectin collagen binding domain. Fibronectin is a plasma protein that binds cell surfaces and various compounds including collagen, fibrin, heparin, DNA, and actin. The major part of the sequence of fibronectin consists of the repetition of three types of domains, which are called type I, II, and III (Skorstengaard K., et al., *Er. J. Biochem.* (1986) 161:441). Type II domain is approximately forty residues long, contains four conserved cysteines involved in disulfide bonds and is part of the collagen-binding region of fibronectin. In fibronectin the type II domain is duplicated. Type II domains have also been found in the following proteins: 1) blood coagulation factor XII (Hageman factor) (1 copy); 2) bovine seminal plasma proteins PDC-109 (BSP-A1/A2) and BSP-A3 (Seidah N. G., et al., *Biochem. J.* (1987) 243:195. (twice); 3) cation-independent mannose-6-phosphate receptor (which is also the insulin-like growth factor II receptor) Kornfeld S., *Annu. Rev. Biochem.* (1992) 61:307) (1 copy); 4) Mannose receptor of macrophages (Taylor M. E., et al., *J. Biol. Chem.* (1990) 265:12156) (1 copy); 5) 180 Kd secretory phospholipase A2 receptor (1 copy) Lanbeau G., et al., *J. Biol. Chem.* (1994) 269:1575; 6) DEC-205 receptor (1 copy) 6) Jiang W., et al., *Nature* (1995) 375:151); 7) 72 Kd type IV collagenase (EC 3.4.24.24) (MMP-2) (Collier I. E., et al., *J. Biol. Chem.* (1988) 263:6579) (3 copies); 7) 92 Kd type IV collagenase (EC 3.4.24.24) (MMP-9) (3 copies); 8) Hepatocyte growth factor activator (Miyazawa K., et al., *J. Biol. Chem.* (1993) 268:10024) (1 copy).

A schematic representation of the position of the invariant residues and the topology of the disulfide bonds in fibronectin type II domain is shown below:
xxCxxPFx#xxxxxxxCxxxxxxxxWCxxxxx#xxx#x#Cxx
where 'C' represents the conserved cysteine involved in a disulfide bond and '#' represents a large hydrophobic residue. The consensus pattern for identifying members of this family, which pattern spans this entire domain, is: C-x(2)-P-F-x-[FYWI]-x(7)-C-x(8,10)-W-C-x(4)-[DNSR]-[FYW]-x(3,5)-[FYW]-x-[FYWI]-C (where the four C's are involved in disulfide bonds).

p) G-Protein Alpha Subunit (G-alpha). Several of the validation sequences, and thus the sequences they validate, correspond to a gene encoding a novel polypeptide of the G-protein alpha subunit family. Guanine nucleotide binding proteins (G-proteins) are a family of membrane-associated proteins that couple extracellularly-activated integral-membrane receptors to intracellular effectors, such as ion channels and enzymes that vary the concentration of second messenger molecules. G-proteins are composed of 3 subunits (alpha, beta and gamma) which, in the resting state, associate as a trimer at the inner face of the plasma membrane. The alpha subunit has a molecule of guanosine diphosphate (GDP) bound to it. Stimulation of the G-protein by an activated receptor leads to its exchange for GTP (guanosine triphosphate). This results in the separation of the alpha from the beta and gamma subunits, which always remain tightly associated as a dimer. Both the alpha and beta-gamma subunits are then able to interact with effectors, either individually or in a cooperative manner. The intrinsic GTPase activity of the alpha subunit hydrolyses the bound GTP to GDP. This returns the alpha subunit to its inactive conformation and allows it to reassociate with the beta-gamma subunit, thus restoring the system to its resting state.

G-protein alpha subunits are 350–400 amino acids in length and have molecular weights in the range 40–45 kDa. Seventeen distinct types of alpha subunit have been identified in mammals. These fall into 4 main groups on the basis of both sequence similarity and function: alpha-s, alpha-q, alpha-i and alpha-12 (Simon et al., *Science* (1993) 252:802). Many alpha subunits are substrates for ADP-ribosylation by *cholera* or *pertussis* toxins. They are often N-terminally acylated, usually with myristate and/or palmitoylate, and these fatty acid modifications are probably important for membrane association and high-affinity interactions with other proteins. The atomic structure of the alpha subunit of the G-protein involved in mammalian vision, transducin, has been elucidated in both GTP- and GDB-bound forms, and shows considerable similarity in both primary and tertiary structure in the nucleotide-binding regions to other guanine nucleotide binding proteins, such as p21-ras and EF-Tu.

q) Helicases conserved C-terminal domain (helicase_C). SEQ ID NOS:2503, 4469, and 5020, and thus the sequences they validate, represent polynucleotides encoding novel members of the DEAD/H helicase family. The DEAD and DEAH families are described above.

r) Homeobox domain (homeobox). SEQ ID NO:4241, and thus the sequence it validates, represents a polynucleotide encoding a protein having a homeobox domain. The 'homeobox' is a protein domain of 60 amino acids (Gehring In: *Guidebook to the Homebox Genes*. Duboule D., Ed., pp 1–10, Oxford University Press, Oxford, (1994); Buerglin In: *Guidebook to the Homebox Genes*, pp 25–72, Oxford University Press, Oxford, (1994); Gehring *Trends Biochem. Sci.* (1992) 17:277–280; Gehring et al *Annu. Rev. Genet.* (1986) 20:147–173; Schofield *Trends Neurosci.* (1987) 10:3–6; http://copan.bioz.unibas.ch/homeo.html) first identified in number of *Drosophila* homeotic and segmentation proteins. It is extremely well conserved in many other animals, including vertebrates. This domain binds DNA through a helix-turn-helix type of structure. Several proteins that contain a homeobox domain play an important role in development. Most of these proteins are sequence-specific DNA-binding transcription factors. The homeobox domain is also very similar to a region of the yeast mating type proteins. These are sequence-specific DNA-binding proteins that act as master switches in yeast differentiation by controlling gene expression in a cell type-specific fashion.

A schematic representation of the homeobox domain is shown below. The helix-turn-helix region is shown by the symbols 'H' (for helix), and 't' (for turn).

```
xxxxxxxxxxxxxxxxxxxxxxxxxxxxxxxxxHHHHHHHHtttHHHHHHHHHxxxxxxxxxx
1                                                             60
```

The pattern detects homeobox sequences 24 residues long and spans positions 34 to 57 of the homeobox domain. The consensus pattern is as follows: [LIVMFYG]-[ASLVR]-x(2)-[LIVMSTACN]-x-[LIVM]-x(4)-[LIV]-[RKNQESTAIY]-[LIVFSTNKH]-W-[FYVC]-x-[NDQTAH]-x(5)-[RKNAIMW].

x) MAP kinase kinase (mkk). Several validation sequences, and thus the sequences they validate, represent novel members of the MAP kinase kinase family. MAP kinases (MAPK) are involved in signal transduction, and are important in cell cycle and cell growth controls. The MAP kinase kinases (MAPKK) are dual-specificity protein kinases which phosphorylate and activate MAP kinases. MAPKK homologues have been found in yeast, invertebrates, amphibians, and mammals. Moreover, the MAPKK/MAPK phosphorylation switch constitutes a basic module activated in distinct pathways in yeast and in vertebrates. MAPKK regulation studies have led to the discovery of at least four MAPKK convergent pathways in higher organisms. One of these is similar to the yeast pheromone response pathway which includes the ste11 protein kinase. Two other pathways require the activation of either one or both of the serine/threonine kinase-encoded oncogenes c-Raf-1 and c-Mos. Additionally, several studies suggest a possible effect of the cell cycle control regulator cyclin-dependent kinase 1 (cdc2) on MAPKK activity. Finally, MAPKKs are apparently essential trasducers through which signals must pass before reaching the nucleus. For review, see, e.g., *Biologique Biol Cell* (1993) 79:193–207; Nishida et al., *Trends Biochem Sci* (1993) 18:128–31; Ruderman *Curr Opin Cell Biol* (1993) 5:207–13; Dhanasekam et al., *Oncogene* (1998) 17:1447–55; Kiefer et al., *Biochem Soc Trans* (1997) 25:491–8; and Hill, *Cell Signal* (1996) 8:533–44.

y) 3'5'-cyclic nucleotide phosphodiesterases signature (PDEase). SEQ ID NO:4482, and thus the sequence it validates, represents a polynucleotide encoding a novel 3'5'-cyclic nucleotide phosphodiesterases (PDEases). PDEases catalyze the hydrolysis of cAMP or cGMP to the corresponding nucleoside 5' monophosphates (Charbonneau H., et al., *Proc. Natl. Acad. Sci. U.S.A.* (1986) 83:9308). There are at least seven different subfamilies of PDEases (Beavo J. A., et al., *Trends Pharmacol. Sci.* (1990) 11:150; http://weber.u.washington.edu/~pde/: 1) Type 1, calmodulin/calcium-dependent PDEases; 2) Type 2, cGMP-stimulated PDEases; 3) Type 3, cGMP-inhibited PDEases; 4) Type 4, cAMP-specific PDEases.; 5) Type 5, cGMP-specific PDEases; 6) Type 6, rhodopsin-sensitive cGMP-specific PDEases; and 7) Type 7, High affinity cAMP-specific PDEases.

All PDEase forms share a conserved domain of about 270 residues. The signature pattern is determined from a stretch of 12 residues that contains two conserved histidines: H-D-[LIVMFY]-x-H-x-[AG]-x(2)-[Q]-x-[LIVMFY].

z) Protein Kinase (protkinase). Several validation sequences, and thus the sequences they validate, represent polynucleotides encoding protein kinases. Protein kinases catalyze phosphorylation of proteins in a variety of pathways, and are implicated in cancer. Eukaryotic protein kinases (Hanks S. K., et al., *FASEB J.* (1995) 9:576; Hunter T., *Meth. Enzymol.* (1991) 200:3; Hanks S. K., et al., *Meth. Enzymol* (1991) 200:38; Hanks S. K., *Curr. Opin. Struct. Biol.* (1991) 1:369; Hanks S. K., et al., *Science* (1988) 241:42) are enzymes that belong to a very extensive family of proteins which share a conserved catalytic core common to both serine/threonine and tyrosine protein kinases. There are a number of conserved regions in the catalytic domain of protein kinases. Two of the conserved regions are the basis for the signature pattern in the protein kinase profile. The first region, which is located in the N-terminal extremity of the catalytic domain, is a glycine-rich stretch of residues in the vicinity of a lysine residue, which has been shown to be involved in ATP binding. The second region, which is located in the central part of the catalytic domain, contains a conserved aspartic acid residue which is important for the catalytic activity of the enzyme (Knighton D. R., et al., *Science* (1991) 253:407). The protein kinase profile includes two signature patterns for this second region: one specific for serine/threonine kinases and the other for tyrosine kinases. A third profile is based on the alignment in (Hanks S. K., et al., *FASEB J.* (1995) 9:576) and covers the entire catalytic domain. The consensus patterns are as follows:

1) Consensus pattern: [LIV]-G-{P}-G-{P}-[FYWMGSTNH]-[SGA]-{PW}-[LIVCAT]-{PD}-x-[GSTACLIVMFY]-x(5,18)-[LIVMFYWCSTAR]-[AIVP]-[LIVMFAGCKR]-K, where K binds ATP. The majority of known protein kinases are detected by this pattern. Proteins kinases that are not detected by this consensus include viral kinases, which are quite divergent in this region and are completely missed by this pattern.

2) Consensus pattern: [LIVMFYC]-x-[HY]-x-D-[LIVMFY]-K-x(2)-N-[LIVMFYCT](3), where D is an active site residue. This consensus sequence identifies most serine/threonine-specific protein kinases with only 10 exceptions. Half of the exceptions are viral kinases, while the other exceptions include Epstein-Barr virus BGLF4 and *Drosophila* ninaC, which have Ser and Arg, respectively, instead of the conserved Lys. These latter two protein kinases are detected by the tyrosine kinase specific pattern described below.

3) Consensus pattern: [LIVMFYC]-x-[HY]-x-D-[LIVMFY]-[RSTAC]-x(2)-N-[LIVMFYC], where D is an active site residue. All tyrosine-specific protein kinases are detected by this consensus pattern, with the exception of human ERBB3 and mouse blk. This pattern also detects most bacterial aminoglycoside phosphotransferases (Benner S., *Nature* (1987) 329:21; Kirby R., *J. Mol. Evol.* (1992) 30:489) and herpesviruses ganciclovir kinases (Littler E., et al., *Nature* (1992) 358:160), which are structurally and evolutionary related to protein kinases.

The protein kinase profile also detects receptor guanylate cyclases and 2-5A-dependent ribonucleases. Sequence similarities between these two families and the eukaryotic protein kinase family have been noticed previously. The profile also detects *Arabidopsis thaliana* kinase-like protein TMKL1 which seems to have lost its catalytic activity.

If a protein analyzed includes the two of the above protein kinase signatures, the probability of it being a protein kinase is close to 100%. Eukaryotic-type protein kinases have also been found in prokaryotes such as *Myxococcus xanthus* (Munoz-Dorado J., et al., *Cell* (1991) 67:995) and *Yersinia*

*pseudotuberculosis*. The patterns shown above has been updated since their publication in (Bairoch A., et al., *Nature* (1988) 331:22).

aa) Ras family proteins (ras). SEQ ID NO:3671, and thus the sequence it validates, represent polynucleotides encoding the ras family of small GTP/GDP-binding proteins (Valencia et al., 1991, Biochemistry 30:4637–4648). Ras family members generally require a specific guanine nucleotide exchange factor (GEF) and a specific GTPase activating protein (GAP) as stimulators of overall GTPase activity. Among ras-related proteins, the highest degree of sequence conservation is found in four regions that are directly involved in guanine nucleotide binding. The first two constitute most of the phosphate and Mg2+ binding site (PM site) and are located in the first half of the G-domain. The other two regions are involved in guanosine binding and are located in the C-terminal half of the molecule. Motifs and conserved structural features of the ras-related proteins are described in Valencia et al., 1991, Biochemistry 30:4637–4648.

A major consensus pattern of ras proteins is: D-T-A-G-Q-E-K-[LF]-G-G-L-R-[DE]-G-Y-Y.

bb) Thioredoxin family active site (Thioredox). SEQ ID NO:3936, and thus the sequence it validates, represent a polynucleotide encoding a protein having a thioredoxin family active site. Thioredoxins (Holmgren A., *Annu. Rev. Biochem.* (1985) 54:237; Gleason F. K., et al., *FEMS Microbiol. Rev.* (1988) 54:271; Holmgren A. *J. Biol. Chem.* (1989) 264:13963; Eklund H., et al. *Proteins* (1991) 11:13) are small proteins of approximately one hundred amino-acid residues which participate in various redox reactions via the reversible oxidation of an active center disulfide bond. They exist in either a reduced form or an oxidized form where the two cysteine residues are linked in an intramolecular disulfide bond. Thioredoxin is present in prokaryotes and eukaryotes and the sequence around the redox-active disulfide bond is well conserved.

A number of eukaryotic proteins contain domains evolutionary related to thioredoxin, and all of them are protein disulphide isomerases (PDI). PDI (Freedman R. B., et al., *Biochem. Soc. Trans.* (1988) 16:96; Kivirikko K. I., et al., *FASEB J.* (1989) 3:1609; Freedman R. B., et al. *Trends Biochem. Sci.* (1994) 19:331) is an endoplasmic reticulum enzyme that catalyzes the rearrangement of disulfide bonds in various proteins. The various forms of PDI which are currently known are: 1) PDI major isozyme; a multifunctional protein that also function as the beta subunit of prolyl 4-hydroxylase (EC 1.14.11.2), as a component of oligosaccharyl transferase (EC 2.4.1.119), as thyroxine deiodinase, as glutathione-insulin transhydrogenase, and as a thyroid hormone-binding protein; 2) ERp60 (ER-60; 58 Kd microsomal protein), which is a protease; 3) ERp72; and 4) P5.

All PDI contains two or three (ERp72) copies of the thioredoxin domain. The consensus pattern is: [LIVMF]-[LIVMSTA]-x-[LIVMFYC]-[FYWSTHE]-x(2)-[FYWGTN]-C-[GATPLVE]-[PHYWSTA]-C-x(6)-[LIVMFYWT] (where the two C's form the redox-active bond.

cc) TNFR/NGFR family cysteine-rich region (TNFR_c6). SEQ ID NO:3927, and thus the sequence it validates, represent a polynucleotide encoding a protein having a TNFR/NGFR family cysteine-rich region. A number of proteins, some of which are known to be receptors for growth factors, have been found to contain a cysteine-rich domain of about 110 to 160 amino acids in their N-terminal part, that can be subdivided into four (or in some cases, three) modules of about 40 residues containing 6 conserved cysteines. Proteins known to belong to this family (Mallet S., et al., *Immunol. Today* (1991) 12:220; Sprang S. R., *Trends Biochem. Sci*. (1990) 15:366; Krammer P. H., et al., *Curr. Biol*. (1992) 2:383; Bazan J. F., *Curr. Biol.* (1993) 3:603) are: 1) Tumor Necrosis Factor type I and type II receptors (TNFR) (Both receptors bind TNF-alpha and TNF-beta, but are only similar in the cysteine-rich region.); 2) Shope fibroma virus soluble TNF receptor (protein T2); 3) Lymphotoxin alphalbeta receptor; 4) Low-affinity nerve growth factor receptor (LA-NGFR); 5) CD40 (Bp50), the receptor for the CD40L (or TRAP) cytokine; 6) CD27, the receptor for the CD27L cytokine; 8) CD30, the receptor for the CD30L cytokine; 9) T-cell protein 4-1BB, the receptor for the 4-1BBL putative cytokine; 10) FAS antigen (or APO-1), the receptor for FASL, a protein involved in apoptosis (programmed cell death); 11) T-cell antigen OX40, the receptor for the OX40L cytokine; 12) Wsl-1, a receptor (for a yet undefined ligand) that mediates apoptosis; 13) Vaccinia virus protein A53 (SalF 19R).

The six cysteines all involved in intrachain disulfide bonds (Banner D. W., et al, *Cell* (1993) 73:431). A schematic representation of the structure of the 40 residue module of these receptors is shown below:

xCxxxxxxxxxxxxxCxCxxCxxxxxxxxxCxxxxCxx where 'C' represents the conserved cysteine involved in a disulfide bond. The signature pattern for the cysteine-rich region is based mainly on the position of the six conserved cysteines in each of the repeats: Consensus pattern: C-x(4, 6)-[FYH]-x(5,10)-C-x(0,2)-C-x(2,3)-C-x(7,11)-C-x(4,6)-[DNEQSKP]-x(2)-C (where the six C's are involved in disulfide bonds).

dd) Four Transmembrane Integral Membrane Proteins (transmembrane4). Several of the validation sequences, and thus the sequences they validate, correspond to a sequence encoding a polypeptide that is a member of the 4 transmembrane segments integral membrane protein family (transmembrane 4 family). The transmembrane 4 family of proteins includes a number of evolutionarily-related eukaryotic cell surface antigens (Levy et al., *J. Biol. Chem*., (1991) 266:14597; Tomlinson et al., *Eur. J. Immunol*. (1993) 23:136; Barclay et al. The leucocyte antigen factbooks. (1993) Academic Press, London/San Diego). The proteins belonging to this family include: 1) Mammalian antigen CD9 (MIC3), which is involved in platelet activation and aggregation; 2) Mammalian leukocyte antigen CD37, expressed on B lymphocytes; 3) Mammalian leukocyte antigen CD53 (OX-44), which is implicated in growth regulation in hematopoietic cells; 4) Mammalian lysosomal membrane protein CD63 (melanoma-associated antigen ME491; antigen AD1); 5) Mammalian antigen CD81 (cell surface protein TAPA-1), which is implicated in regulation of lymphoma cell growth; 6) Mammalian antigen CD82 (protein R2; antigen C33; Kangai 1 (KAI1)), which associates with CD4 or CD8 and delivers costimulatory signals for the TCR/CD3 pathway; 7) Mammalian antigen CD151 (SFA-1; platelet-endothelial tetrspan antigen 3 (PETA-3)); 8) Mammalian cell surface glycoprotein A15 (TALLA-1; MXS1); 9) Mammalian novel antigen 2 (NAG-2); 10) Human tumor-associated antigen CO-029; 11) *Schistosoma mansoni* and *japonicum* 23 Kd surface antigen (SM23/SJ23).

The members of the 4 transmembrane family share several characteristics. First, they all are apparently type III membrane proteins, which are integral membrane proteins containing an N-terminal membrane-anchoring domain which is not cleaved during biosynthesis and which functions both as a translocation signal and as a membrane anchor. The family members also contain three additional transmembrane regions, at least seven conserved cysteines residues, and are of approximately the same size (218 to 284 residues). These proteins are collectively know as the "transmembrane 4 superfamily" (TM4) because they span plasma membrane four times.

A schematic diagram of the domain structure of these proteins is as follows:

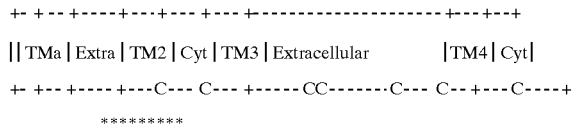

where Cyt is the cytoplasmic domain, TMa is the transmembrane anchor; TM2 to TM4 represents transmembrane regions 2 to 4, 'C' are conserved cysteines, and '*' indicates the position of the consensus pattern. The consensus pattern spans a conserved region including two cysteines located in a short cytoplasmic loop between two transmembrane domains: Consensus pattern: G-x(3)-[LIVMF]-x(2)-[GSA]-[LIVMF](2)-G-C-x-[GA]-[STA]-x(2)-[EG]-x(2)-[CWN]-[LIVM](2).

ee) Trypsin (trypsin). SEQ ID NOS:3381, 4684, and 4688, and thus the sequences they validate, correspond to novel serine proteases of the trypsin family. The catalytic activity of the serine proteases from the trypsin family is provided by a charge relay system involving an aspartic acid residue hydrogen-bonded to a histidine, which itself is hydrogen-bonded to a serine. The sequences in the vicinity of the active site serine and histidine residues are well conserved in this family of proteases (Brenner S., Nature (1988) 334:528). Proteases known to belong to the trypsin family include: 1) Acrosin; 2) Blood coagulation factors VII, IX, X, XI and XII, thrombin, plasminogen, and protein C; 3) Cathepsin G; 4) Chymotrypsins; 5) Complement components C1r, C1s, C2, and complement factors B, D and I; 6) Complement-activating component of RA-reactive factor; 7) Cytotoxic cell proteases (granzymes A to H); 8) Duodenase I; 9) Elastases 1, 2, 3A, 3B (protease E), leukocyte (medullasin).; 10) Enterokinase (EC 3.4.21.9) (enteropeptidase); 11) Hepatocyte growth factor activator; 12) Hepsin; 13) Glandular (tissue) kallikreins (including EGF-binding protein types A, B, and C, NGF-gamma chain, gamma-renin, prostate specific antigen (PSA) and tonin); 14) Plasma kallikrein; 15) Mast cell proteases (MCP) 1 (chymase) to 8; 16) Myeloblastin (proteinase 3) (Wegener's autoantigen); 17) Plasminogen activators (urokinase-type, and tissue-type); 18) Trypsins I, II, III, and IV; 19) Tryptases; 20) Snake venom proteases such as ancrod, batroxobin, cerastobin, flavoxobin, and protein C activator; 21) Collagenase from common cattle grub and collagenolytic protease from Atlantic sand fiddler crab; 22) Apolipoprotein(a); 23) Blood fluke cercarial protease; 24) Drosophila trypsin like proteases: alpha, easter, snake-locus; 25) Drosophila protease stubble (gene sb); and 26) Major mite fecal allergen Der p III. All the above proteins belong to family SI in the classification of peptidases (Rawlings N. D., et al., Meth. Enzymol. (1994) 244:19; http://www.expasv.ch/cgi-bin/lists?peptidas.txt) and originate from eukaryotic species. It should be noted that bacterial proteases that belong to family S2A are similar enough in the regions of the active site residues that they can be picked up by the same patterns.

The consensus patterns for this trypsin protein family are:
1) [LIVM]-[ST]-A-[STAG]-H-C, where H is the active site residue. All sequences known to belong to this class detected by the pattern, except for complement components C1r and C1s, pig plasminogen, bovine protein C, rodent urokinase, ancrod, gyroxin and two insect trypsins; 2) [DNSTAGC]-[GSTAPIMVQH]-x(2)-G-[DE]-S-G-[GS]-[SAPHV]-[LIVMFYWH]-[LIVMFYSTANQH], where S is the active site residue. All sequences known to belong to this family are detected by the above consensus sequences, except for 18 different proteases which have lost the first conserved glycine. If a protein includes both the serine and the histidine active site signatures, the probability of it being a trypsin family serine protease is 100%.

ff) WD Domain, G-Beta Repeats (WD_domain). A few of the validation sequences, and the sequences they validate, represent novel members of the WD domain/G-beta repeat family. Beta-transducin (G-beta) is one of the three subunits (alpha, beta, and gamma) of the guanine nucleotide-binding proteins (G proteins) which act as intermediaries in the transduction of signals generated by transmembrane receptors (Gilman, Annu. Rev. Biochem. (1987) 56:615). The alpha subunit binds to and hydrolyzes GTP; the functions of the beta and gamma subunits are less clear but they seem to be required for the replacement of GDP by GTP as well as for membrane anchoring and receptor recognition.

In higher eukaryotes, G-beta exists as a small multigene family of highly conserved proteins of about 340 amino acid residues. Structurally, G-beta consists of eight tandem repeats of about 40 residues, each containing a central Trp-Asp motif (this type of repeat is sometimes called a WD-40 repeat). Such a repetitive segment has been shown to exist in a number of other proteins including: human LIS1, a neuronal protein involved in type-1 lissencephaly; and mammalian coatomer beta' subunit (beta'-COP), a component of a cytosolic protein complex that reversibly associates with Golgi membranes to form vesicles that mediate biosynthetic protein transport.

The consensus pattern for the WD domain/G-Beta repeat family is: [LIVMSTAC]-[IVMFYWSTAGC]-[LIMSTAG]-[LIVMSTAGC]-x(2)-[DN]-x(2)-[LIVMWSTAC]-x-[LIVMFSTAG]-W-[DEN]-[LIVMFSTAGCN].

gg) wnt Family of Developmental Signaling Proteins (Wnt_dev_sign). Several of the validation sequences, and thus the sequences they validate, correspond to novel members of the wnt family of developmental signaling proteins. Wnt-1 (previously known as int-1), the seminal member of this family, (Nusse R., Trends Genet. (1988) 4:291) is a proto-oncogene induced by the integration of the mouse mammary tumor virus. It is thought to play a role in intercellular communication and seems to be a signalling molecule important in the development of the central nervous system (CNS). The sequence of wnt-1 is highly conserved in mammals, fish, and amphibians. Wnt-1 was found to be a member of a large family of related proteins (Nusse R., et al., Cell (1992) 69:1073; McMahon A. P., Trends Genet. (1992) 8:1; Moon R. T., BioEssays (1993) 15:91) that are all thought to be developmental regulators. These proteins are known as wnt-2 (also known as irp), wnt-3, -3A, 4, -5A, -5B, -6, -7A, -7B, -8, -8B, -9 and -10. At least four members of this family are present in Drosophila; one of them, wingless (wg), is implicated in segmentation polarity.

All these proteins share the following features characteristics of secretory proteins: a signal peptide, several potential N-glycosylation sites and 22 conserved cysteines that are probably involved in disulfide bonds. The Wnt proteins seem to adhere to the plasma membrane of the secreting cells and are therefore likely to signal over only few cell diameters. The consensus pattern, which is based upon a highly conserved region including three cysteines, is as follows: C-K-C-H-G-[LIVMT]-S-G-x-C. All sequences known to belong to this family are detected by the provided consensus pattern.

hh) Protein Tyrosine Phosphatase (Y_phosphatase). Several of the validation sequences, and thus the sequences they validate, represent a polynucleotide encoding a protein tyrosine kinase. Tyrosine specific protein phosphatases (EC 3.1.3.48) (PTPase) (Fischer et al., Science (1991) 253:401; Charbonneau et al., Annu. Rev. Cell Biol. (1992) 8:463; Trowbridge, J. Biol. Chem. (1991) 266:23517; Tonks et al., Trends Biochem. Sci. (1989) 14:497; and Hunter, Cell (1989) 58:1013) catalyze the removal of a phosphate group attached to a tyrosine residue. These enzymes are very important in the control of cell growth, proliferation, differentiation and transformation. Multiple forms of PTPase have been characterized and can be classified into two categories: soluble PTPases and transmembrane receptor proteins that contain PTPase domain(s).

Soluble PTPases include PTPN3 (H1) and PTPN4 (MEG), enzymes that contain an N-terminal band 4.1-like domain and could act at junctions between the membrane and cytoskeleton; PTPN6 (PTP-1C; HCP; SHP) and PTPN11 (PTP-2C; SH-PTP3; Syp), enzymes that contain two copies of the SH2 domain at its N-terminal extremity.

Dual specificity PTPases include DUSP1 (PTPN10; MAP kinase phosphatase-1; MKP-1) which dephosphorylates MAP kinase on both Thr-183 and Tyr-185; and DUSP2 (PAC-1), a nuclear enzyme that dephosphorylates MAP kinases ERK1 and ERK2 on both Thr and Tyr residues.

Structurally, all known receptor PTPases are made up of a variable length extracellular domain, followed by a transmembrane region and a C-terminal catalytic cytoplasmic domain. Some of the receptor PTPases contain fibronectin type III (FN-III) repeats, immunoglobulin-like domains, MAM domains or carbonic anhydrase-like domains in their extracellular region. The cytoplasmic region generally contains two copies of the PTPAse domain. The first seems to have enzymatic activity, while the second is inactive but seems to affect substrate specificity of the first. In these domains, the catalytic cysteine is generally conserved but some other, presumably important, residues are not.

PTPase domains consist of about 300 amino acids. There are two conserved cysteines and the second one has been shown to be absolutely required for activity. Furthermore, a number of conserved residues in its immediate vicinity have also been shown to be important. The consensus pattern for PTPases is: [LIVMF]-H-C-x(2)-G-x(3)-[STC]-[STAGP]-x-[LIVMFY]; C is the active site residue.

ii) Zinc Finger, C2H2 Type (Zincfing_C2H2). Several of the validation sequences, and thus the sequences they validate, correspond to polynucleotides encoding novel members of the of the C2H2 type zinc finger protein family. Zinc finger domains (Klug et al, Trends Biochem. Sci. (1987) 12:464; Evans et al., Cell (1988) 52:1; Payre et al., FEBS Lett. (1988) 234:245; Miller et al., EMBO J. (1985) 4:1609; and Berg, Proc. Natl. Acad. Sci. USA (1988) 85:99) are nucleic acid-binding protein structures first identified in the Xenopus transcription factor TFIIIA. These domains have since been found in numerous nucleic acid-binding proteins. A zinc finger domain is composed of 25 to 30 amino acid residues. Two cysteine or histidine residues are positioned at both extremities of the domain, which are involved in the tetrahedral coordination of a zinc atom. It has been proposed that such a domain interacts with about five nucleotides.

Many classes of zinc fingers are characterized according to the number and positions of the histidine and cysteine residues involved in the zinc atom coordination. In the first class to be characterized, called C2H2, the first pair of zinc coordinating residues are cysteines, while the second pair are histidines. A number of experimental reports have demonstrated the zinc-dependent DNA or RNA binding property of some members of this class.

Mammalian proteins having a C2H2 zipper include (number in parenthesis indicates number of zinc finger regions in the protein): basonuclin (6), BCL-6/LAZ-3 (6), erythroid krueppel-like transcription factor (3), transcription factors Sp1 (3), Sp2 (3), Sp3 (3) and Sp(4) 3, transcriptional repressor YY1 (4), Wilms' tumor protein (4), EGR1/Krox24 (3), EGR2/Krox20 (3), EGR3/Pilot (3), EGR4/AT133 (4), Evi-1 (10), GL11 (5), GL12 (4+), GL13 (3+), HIV-EP1/ZNF40 (4), HIV-EP2 (2), KR1 (9+), KR2 (9), KR3 (15+), KR4 (14+), KR5 (11+), HF.12 (6+), REX-1 (4), ZfX (13), ZfY (13), Zfp-35 (18), ZNF7 (15), ZNF8 (7), ZNF35 (10), ZNF42/MZF-1 (13), ZNF43 (22), ZNF46/Kup (2), ZNF76 (7), ZNF91 (36), ZNF133 (3).

In addition to the conserved zinc ligand residues, it has been shown that a number of other positions are also important for the structural integrity of the C2H2 zinc fingers. (Rosenfeld et al., J. Biomol. Struct. Dyn. (1993) 11:557) The best conserved position is found four residues after the second cysteine; it is generally an aromatic or aliphatic residue. The consensus pattern for C2H2 zinc fingers is: C-x(2,4)-C-x(3)-[LIVMFYWC]-x(8)-H-x(3,5)-H. The two C's and two H's are zinc ligands.

jj) Zinc finger, C3HC4 type (RING finger), signature (Zincfing_C3H4). SEQ ID NOS:3774 and 4477, and thus the sequences they validate, represent polynucleotides encoding a polypeptide having a C3HC4 type zinc finger signature. A number of eukaryotic and viral proteins contain this signature, which is primarily a conserved cysteine-rich domain of 40 to 60 residues (Borden K. L. B., et al., Curr. Opin. Struct. Biol. (1996) 6:395) that binds two atoms of zinc, and is probably involved in mediating protein-protein interactions. The 3D structure of the zinc ligation system is unique to the RING domain and is referred to as the "cross-brace" motif. The spacing of the cysteines in such a domain is C-x(2)-C-x(9 to 39)C-x(1 to 3)-H-x(2 to 3)-C-x(2)-C-x(4 to 48)-C-x(2)-C. Proteins that include the C3HC4 domain include:

1) Mammalian V(D)J recombination activating protein (RAG1). RAG1 activates the rearrangement of immunoglobulin and T-cell receptor genes.

2) Mouse rpt-1. Rpt-1 is a trans-acting factor that regulates gene expression directed by the promoter region of the interleukin-2 receptor alpha chain or the LTR promoter region of HIV-1.

3) Human rfp. Rfp is a developmentally regulated protein that may function in male germ cell development. Recombination of the N-terminal section of rfp with a protein tyrosine kinase produces the ret transforming protein.

4) Human 52 Kd Ro/SS-A protein. A protein of unknown function from the Ro/SS-A ribonucleoprotein complex. Sera from patients with systemic lupus erythematosus or primary Sjogren's syndrome often contain antibodies that react with the Ro proteins.

5) Human histocompatibility locus protein RING1.

6) Human PML, a probable transcription factor. Chromosomal translocation of PML with retinoic receptor alpha creates a fusion protein which is the cause of acute promyelocytic leukemia (APL).

7) Mammalian breast cancer type 1 susceptibility protein (BRCA1) ([E1] http://bioinformatics.weizmann.ac.il/hotmolecbase/entries/brca1.htm).

8) Mammalian cbl proto-oncogene.

9) Mammalian bmi-1 proto-oncogene.

10) Vertebrate CDK-activating kinase (CAK) assembly factor MAT1, a protein that stabilizes the complex between the CDK7 kinase and cyclin H (MAT1 stands for 'Menage A Trois').

11) Mammalian mel-18 protein. Mel-18 which is expressed in a variety of tumor cells is a transcriptional repressor that recognizes and bind a specific DNA sequence.

12) Mammalian peroxisome assembly factor-1 (PAF-1) (PMP35), which is somewhat involved in the biogenesis of peroxisomes. In humans, defects in PAF-1 are responsible for a form of Zellweger syndrome, an autosomal recessive disorder associated with peroxisomal deficiencies.

13) Human MAT1 protein, which interacts with the CDK7-cyclin H complex.

14) Human RING1 protein.

15) *Xenopus* XNF7 protein, a probable transcription factor.

16) *Trypanosoma* protein ESAG-8 (T-LR), which may be involved in the postranscriptional regulation of genes in VSG expression sites or may interact with adenylate cyclase to regulate its activity.

17) *Drosophila* proteins Posterior Sex Combs (Psc) and Suppressor two of zeste (Su(z) 2). The two proteins belong to the Polycomb group of genes needed to maintain the segment-specific repression of homeotic selector genes.

18) *Drosophila* protein male-specific msl-2, a DNA-binding protein which is involved in X chromosome dosage compensation (the elevation of transcription of the male single X chromosome).

19) *Arabidopsis thaliana* protein COP1 which is involved in the regulation of photomorphogenesis.

20) Fungal DNA repair proteins RAD5, RAD16, RAD18 and rad8.

21) Herpesviruses trans-acting transcriptional protein ICP0/IE110. This protein which has been characterized in many different herpesviruses is a trans-activator and/or -repressor of the expression of many viral and cellular promoters.

22) Baculoviruses protein CG30.

23) Baculoviruses major immediate early protein (PE-38).

24) Baculoviruses immediate-early regulatory protein IE-N/IE-2.

25) *Caenorhabditis elegans* hypothetical proteins F54G8.4, R05D3.4 and T02C1.1.

26) Yeast hypothetical proteins YER116c and YKR017c.

The signature pattern for the C3HC4 finger is based on the central region of the domain:

Consensus pattern: C-x-H-x-[LIVMFY]-C-x(2)-C-[LIVMYA].

Example 4

Differential Expression of Polynucleotides of the Invention: Description of Libraries and Detection of Differential Expression The relative expression levels of the polynucleotides of the invention was assessed in several libraries prepared from various sources, including cell lines and patient tissue samples. Table 4 provides a summary of these libraries, including the shortened library name (used hereafter), the mRNA source used to prepared the cDNA library, the "nickname" of the library that is used in the tables below (in quotes), and the approximate number of clones in the library.

TABLE 4

Description of cDNA Libraries

| Library (lib #) | Description | Number of Clones in this Clustering |
|---|---|---|
| 1 | Km12L4 | 307133 |
| | Human Colon Cell Line, High Metastatic Potential (derived from Km12C) | |
| | "High Colon" | |
| 2 | Km12C | 284755 |
| | Human Colon Cell Line, Low Metastatic Potential | |
| | "Low Colon" | |
| 3 | MDA-MB-231 | 326937 |
| | Human Breast Cancer Cell Line, High Metastatic Potential; micro-metastases in lung | |
| | "High Breast" | |
| 4 | MCF7 | 318979 |
| | Human Breast Cancer Cell, Non Metastatic | |
| | "Low Breast" | |
| 8 | MV-522 | 223620 |
| | Human Lung Cancer Cell Line, High Metastatic Potential "High Lung" | |
| 9 | UCP-3 | 312503 |
| | Human Lung Cancer Cell Line, Low Metastatic Potential | |
| | "Low Lung" | |
| 12 | Human microvascular endothelial cells (HMEC) - Untreated PCR (OligodT) cDNA-library | 41938 |
| 13 | Human microvascular endothelial cells (HMEC) - Basic fibroblast growth factor (bFGF) treated PCR (OligodT) cDNA library | 42100 |
| 14 | Human microvascular endothelial cells (HMEC) - Vascular endothelial growth factor (VEGF) treated PCR (OligodT) cDNA library | 42825 |

TABLE 4-continued

Description of cDNA Libraries

| Library (lib #) | Description | Number of Clones in this Clustering |
|---|---|---|
| 15 | Normal Colon - UC#2 Patient PCR (OligodT) cDNA library "Normal Colon Tumor Tissue" | 34285 |
| 16 | Colon Tumor - UC#2 Patient PCR (OligodT) cDNA library "Normal Colon Tumor Tissue" | 35625 |
| 17 | Liver Metastasis from Colon Tumor of UC#2 Patient PCR (OligodT) cDNA library "High Colon Metastasis Tissue" | 36984 |
| 18 | Normal Colon - UC#3 Patient PCR (OligodT) cDNA library "Normal Colon Tumor Tissue" | 36216 |
| 19 | Colon Tumor - UC#3 Patient PCR (OligodT) cDNA library "High Colon Tumor Tissue" | 41388 |
| 20 | Liver Metastasis from Colon Tumor of UC#3 Patient PCR (OligodT) cDNA library "High Colon Metastasis Tissue" | 30956 |

The KM12L4 and KM12C cell lines are described in Example 1 above. The MDA-231 cell line was originally isolated from pleural effusions (Cailleau, *J. Natl. Cancer. Inst.* (1974) 53:661), is of high metastatic potential, and forms poorly differentiated adenocarcinoma-grade II in nude mice consistent with breast carcinoma. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res.* (1979) 39:870 (MDA-MB-231 and MCF-7); Gastpar et al., *J Med Chem* (1998) 41:4965 (MDA-MB-231 and MCF-7); Ranson et al., *Br J Cancer* (1998) 77:1586 (MDA-MB-231 and MCF-7); Kuang et al., *Nucleic Acids Res* (1998) 26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15–20 are derived from two different patients (UC#2, and UC#3). The bFGF-treated HMEC were prepared by incubation with bFGF at 10 ng/ml for 2 hrs; the VEGF-treated HMEC were prepared by incubation with 20 ng/ml BEGF for 2 hrs. Following incubation with the respective growth factor, the cells were washed and lysis buffer added for RNA preparation.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7bp oligonucleotide probes (see Drmanac et al., *Genomics* (1996) 37(1):29). Random cDNA clones from a tissue library are hybridized at moderate stringency to 300 7bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the purity" of each cluster can be controlled. For example, artifacts of clustering may occur in computational clustering just as artifacts can occur in "wetlab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296–298 (1974).

Example 5

Polynucleotides Differentially Expressed in High Metastatic Potential Breast Cancer Cells Versus Low Metastatic Breast Cancer Cells A number of polynucleotide sequences have been identified that are differentially expressed between cells derived from high metastatic potential breast cancer tissue and low metastatic breast cancer cells. Expression of these sequences in breast cancer can be valuable in determining diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic marker, for risk assessment, patient treatment and the like. These polynucleotide sequences can also be used in combination with other known molecular and/or biochemical markers.

The following tables summarize polynucleotides that are differentially expressed between high metastatic potential breast cancer cells and low metastatic potential breast cancer cells.

TABLE 5

Differentially expressed polynucleotides: Higher expression in high metastatic potential breast cancer (lib3) relative to low metastatic breast cancer cells (lib4)

| SEQ ID NOS: | Sequence Name | Cluster ID | Lib3 clones | Lib4 clones | lib3/lib4 | Zscore |
|---|---|---|---|---|---|---|
| 45 | RTA00000197AR.f.12.1 | 3513 | 17 | 5 | 3.317240 | 2.287632 |
| 146 | RTA00000185AF.a.19.2 | 5749 | 9 | 0 | 8.780930 | 2.629923 |
| 154 | RTA00000196F.e.7.1 | 1039 | 10 | 2 | 4.878294 | 1.978215 |
| 159 | RTA00000182AF.l.12.1 | 1027 | 41 | 17 | 2.353059 | 2.926571 |
| 165 | RTA00000192AF.g.23.1 | 6455 | 6 | 0 | 5.853953 | 2.011224 |
| 174 | RTA00000181AF.e.22.3 | 3442 | 17 | 4 | 4.146550 | 2.562391 |
| 183 | RTA00000198AF.c.17.1 | 6923 | 6 | 0 | 5.853953 | 2.011224 |
| 364 | RTA00000187AF.g.13.1 | 2991 | 10 | 1 | 9.756589 | 2.371428 |
| 366 | RTA00000192AF.o.19.1 | 3549 | 10 | 1 | 9.756589 | 2.371428 |
| 387 | RTA00000191AF.j.14.1 | 1002 | 42 | 20 | 2.048883 | 2.570309 |
| 496 | RTA00000190AF.p.3.1 | 2378 | 34 | 0 | 33.17240 | 5.588184 |
| 510 | RTA00000178AF.n.23.1 | 3298 | 12 | 1 | 11.70790 | 2.729313 |
| 512 | RTA00000191AF.c.3.1 | 3549 | 10 | 1 | 9.756589 | 2.371428 |
| 529 | RTA00000178AF.b.13.1 | 3114 | 9 | 1 | 8.780930 | 2.174815 |
| 560 | RTA00000184AF.i.23.3 | 1577 | 25 | 3 | 8.130490 | 3.903813 |
| 606 | RTA00000179AR.e.01.4 | 2493 | 33 | 9 | 3.577416 | 3.469507 |
| 644 | RTA00000197F.i.12.1 | 3605 | 14 | 1 | 13.65922 | 3.050936 |
| 646 | RTA00000186AF.d.24.1 | 3114 | 9 | 1 | 8.780930 | 2.174815 |
| 754 | RTA00000187AF.l.11.1 | 4482 | 14 | 3 | 4.553074 | 2.374769 |
| 875 | RTA00000401F.m.02.1 | 1573 | 34 | 7 | 4.738914 | 3.982056 |
| 902 | RTA00000422F.c.02.1 | 2902 | 18 | 5 | 3.512372 | 2.443314 |
| 921 | RTA00000418F.m.19.1 | 8890 | 6 | 0 | 5.853953 | 2.011224 |
| 942 | RTA00000351R.g.11.1 | 3077 | 17 | 4 | 4.146550 | 2.562391 |
| 1095 | RTA00000408F.l.13.1 | 4423 | 12 | 1 | 11.70790 | 2.729313 |
| 1104 | RTA00000404F.m.10.2 | 779 | 60 | 22 | 2.660887 | 3.974953 |
| 1131 | RTA00000400F.k.22.1 | 2512 | 7 | 0 | 6.829612 | 2.235371 |
| 1170 | RTA00000340R.f.05.1 | 3202 | 18 | 3 | 5.853953 | 2.998867 |
| 1184 | RTA00000422F.c.17.1 | 1360 | 26 | 11 | 2.306102 | 2.226876 |
| 1205 | RTA00000118A.a.23.1 | 3500 | 12 | 3 | 3.902635 | 2.018050 |
| 1354 | RTA00000401F.k.14.1 | 211 | 121 | 43 | 2.745458 | 5.856098 |
| 2124 | RTA00000191AF.j.14.1 | 1002 | 42 | 20 | 2.048883 | 2.570309 |
| 1535 | RTA00000405F.l.11.1 | 2055 | 29 | 8 | 3.536763 | 3.213373 |
| 1751 | RTA00000423F.j.03.1 | 5391 | 6 | 0 | 5.853953 | 2.011224 |
| 1764 | RTA00000399F.o.24.1 | 2272 | 17 | 1 | 16.58620 | 3.483575 |
| 1777 | RTA00000401F.j.15.1 | 3061 | 14 | 0 | 13.65922 | 3.428594 |
| 1795 | RTA00000348R.o.12.1 | 2263 | 6 | 0 | 5.853953 | 2.011224 |
| 1869 | RTA00000340F.f.22.1 | 1720 | 57 | 8 | 6.951569 | 5.855075 |
| 1882 | RTA00000401F.g.22.1 | 1147 | 28 | 12 | 2.276537 | 2.294031 |
| 1890 | RTA00000346F.o.16.1 | 176 | 170 | 44 | 3.769591 | 8.366611 |
| 1915 | RTA00000400F.g.02.1 | 1508 | 21 | 5 | 4.097767 | 2.879196 |
| 2040 | RTA00000527F.j.02.2 | 4896 | 11 | 0 | 10.73224 | 2.974502 |
| 2059 | RTA00000528F.i.22.1 | 2478 | 17 | 5 | 3.317240 | 2.287632 |
| 2223 | RTA00000528F.j.11.1 | 1070 | 26 | 6 | 4.227855 | 3.289393 |
| 2245 | RTA00000527F.k.09.1 | 213 | 17 | 4 | 4.146550 | 2.562391 |

TABLE 5-continued

Differentially expressed polynucleotides: Higher expression in high metastatic potential breast cancer (lib3) relative to low metastatic breast cancer cells (lib4)

| SEQ ID NOS: | Sequence Name | Cluster ID | Lib3 clones | Lib4 clones | lib3/lib4 | Zscore |
|---|---|---|---|---|---|---|
| 2300 | RTA00000528F.b.03.1 | 2078 | 11 | 2 | 5.366124 | 2.174565 |
| 2325 | RTA00000525F.d.13.1 | 349 | 77 | 1 | 75.12573 | 8.384408 |
| 2462 | RTA00000528F.g.22.2 | 920 | 76 | 32 | 2.317189 | 4.010278 |
| 2488 | RTA00000528F.h.02.2 | 1701 | 18 | 4 | 4.390465 | 2.714073 |
| 2492 | RTA00000528F.c.11.1 | 1701 | 18 | 4 | 4.390465 | 2.714073 |

TABLE 6

Differentially expressed polynucleotides: Higher expression in low metastatic breast cancer cells (lib4) relative to high metastatic potential breast cancer (lib3)

| SEQ ID NOS: | Sequence Name | Cluster ID | Lib4 Clones | Lib3 Clones | lib4/lib3 | Zscore |
|---|---|---|---|---|---|---|
| 15 | RTA00000177AR.n.8.1 | 4188 | 4 | 13 | 3.33108 | 1.99126 |
| 36 | RTA00000181AF.p.4.3 | 40392 | 1 | 8 | 8.19958 | 2.03713 |
| 44 | RTA00000199F.f.08.2 | 12445 | 0 | 11 | 11.2744 | 3.05623 |
| 89 | RTA00000177AF.n.8.3 | 4188 | 4 | 13 | 3.33108 | 1.99126 |
| 172 | RTA00000186AF.p.09.2 | 6879 | 3 | 43 | 14.6909 | 5.83444 |
| 203 | RTA00000201F.d.09.1 | 1827 | 37 | 157 | 4.34910 | 8.71727 |
| 261 | RTA00000192AF.a.24.1 | 13183 | 0 | 7 | 7.17463 | 2.30057 |
| 419 | RTA00000182AF.j.20.1 | 4769 | 2 | 20 | 10.2494 | 3.68254 |
| 420 | RTA00000181AF.c.11.1 | 4769 | 2 | 20 | 10.2494 | 3.68254 |
| 503 | RTA00000197AF.k.9.1 | 3138 | 1 | 10 | 10.2494 | 2.45316 |
| 552 | RTA00000193AF.b.24.1 | 35 | 386 | 1967 | 5.22298 | 33.2328 |
| 564 | RTA00000200AF.g.18.1 | 1600 | 0 | 23 | 23.5738 | 4.64683 |
| 570 | RTA00000183AF.a.19.2 | 3788 | 0 | 6 | 6.14969 | 2.07158 |
| 590 | RTA00000190AF.d.2.1 | 2444 | 26 | 55 | 2.16815 | 3.22244 |
| 693 | RTA00000198F.m.12.1 | 4 | 987 | 2807 | 2.91492 | 30.3819 |
| 707 | RTA00000179AF.p.15.1 | 5622 | 2 | 13 | 6.66216 | 2.62993 |
| 711 | RTA00000198F.i.2.1 | 8076 | 0 | 9 | 9.22453 | 2.70385 |
| 726 | RTA00000200R.f.10.1 | 4 | 987 | 2807 | 2.91492 | 30.3819 |
| 746 | RTA00000178AF.i.01.2 | 4 | 987 | 2807 | 2.91492 | 30.3819 |
| 756 | RTA00000404F.a.02.1 | 9738 | 1 | 13 | 13.3243 | 2.98623 |
| 990 | RTA00000126A.o.23.1 | 6268 | 3 | 18 | 6.14969 | 3.11179 |
| 1122 | RTA00000401F.o.06.1 | 2679 | 4 | 23 | 5.89345 | 3.52846 |
| 1142 | RTA00000411F.a.15.1 | 73812 | 0 | 12 | 12.2993 | 3.21838 |
| 1286 | RTA00000345F.n.12.1 | 7337 | 3 | 16 | 5.46639 | 2.80694 |
| 1289 | RTA00000126A.g.7.1 | 1902 | 13 | 48 | 3.78442 | 4.45002 |
| 1435 | RTA00000345F.e.11.1 | 4392 | 1 | 8 | 8.19958 | 2.03713 |
| 1860 | RTA00000340F.p.18.1 | 287 | 6 | 173 | 29.5526 | 12.5749 |
| 1933 | RTA00000400F.f.11.1 | 4088 | 0 | 82 | 84.0457 | 9.05778 |
| 1934 | RTA00000341F.o.12.1 | 2883 | 9 | 21 | 2.39154 | 2.07600 |
| 1979 | RTA00000122A.h.24.1 | 48 | 412 | 1020 | 2.53749 | 16.5262 |
| 1980 | RTA00000346F.j.13.1 | 5337 | 5 | 17 | 3.48482 | 2.40321 |
| 2007 | RTA00000400F.g.08.1 | 1275 | 15 | 32 | 2.18655 | 2.41857 |
| 2023 | RTA00000523F.d.19.1 | 26489 | 1 | 8 | 8.19958 | 2.03713 |
| 2409 | RTA00000526F.d.17.1 | 2757 | 4 | 16 | 4.09979 | 2.51500 |
| 1220 | RTA00000528F.d.04.1 | 2395 | 12 | 37 | 3.16025 | 3.51521 |

Example 6

Polynucleotides Differentially Expressed in High Metastatic Potential Lung Cancer Cells Versus Low Metastatic Lung Cancer Cells A number of polynucleotide sequences have been identified that are differentially expressed between cells derived from high metastatic potential lung cancer tissue and low metastatic lung cancer cells. Expression of these sequences in lung cancer tissue can be valuable in determining diagnostic, prognostic and/or treatment information. For example, sequences that are highly expressed in the high metastatic potential cells are associated can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

he differential expression of these polynucleotides can be used as a diagnostic marker, a prognostic marker, for risk assessment, patient treatment and the like. These polynucleotide sequences can also be used in combination with other known molecular and/or biochemical markers.

The following tables summarize polynucleotides that are differentially expressed between high metastatic potential lung cancer cells and low metastatic potential lung cancer cells:

TABLE 7

Differentially expressed polynucleotides: Higher expression in high metastatic potential lung cancer cells (lib8) relative to low metastatic lung cancer cells (lib9)

| SEQ ID NO: | Sequence Name | Cluster ID | Lib8 clones | Lib9 clones | lib8/lib9 | Zscore |
|---|---|---|---|---|---|---|
| 10 | RTA00000198AF.n.16.1 | 3721 | 9 | 0 | 12.5772 | 3.20845 |
| 54 | RTA00000200F.o.22.1 | 983 | 8 | 1 | 11.1797 | 2.53243 |
| 65 | RTA00000198AF.m.16.1 | 51 | 348 | 66 | 7.36849 | 17.4315 |
| 171 | RTA00000198R.c.07.1 | 19181 | 6 | 0 | 8.38484 | 2.48169 |
| 203 | RTA00000201F.d.09.1 | 1827 | 45 | 15 | 4.19242 | 5.09891 |
| 252 | RTA00000181AF.e.18.3 | 8 | 1355 | 122 | 15.5211 | 39.0214 |
| 253 | RTA00000181AF.e.17.3 | 8 | 1355 | 122 | 15.5211 | 39.0214 |
| 285 | RTA00000181AR.j.14.3 | 5399 | 12 | 0 | 16.7696 | 3.80239 |
| 419 | RTA00000182AF.j.20.1 | 4769 | 10 | 3 | 4.65824 | 2.29362 |
| 420 | RTA00000181AF.c.11.1 | 4769 | 10 | 3 | 4.65824 | 2.29362 |
| 491 | RTA00000196F.k.11.1 | 3 | 986 | 392 | 3.51507 | 22.4683 |
| 525 | RTA00000198AF.c.7.1 | 19181 | 6 | 0 | 8.38484 | 2.48169 |
| 526 | RTA00000185AF.e.20.1 | 5865 | 12 | 0 | 16.7696 | 3.80239 |
| 552 | RTA00000193AF.b.24.1 | 35 | 868 | 11 | 110.273 | 34.2897 |
| 693 | RTA00000198F.m.12.1 | 4 | 506 | 209 | 3.38335 | 15.7309 |
| 700 | RTA00000183AF.i.18.2 | 40129 | 7 | 0 | 9.78231 | 2.74441 |
| 726 | RTA00000200R.f.10.1 | 4 | 506 | 209 | 3.38335 | 15.7309 |
| 742 | RTA00000177AF.m.1.1 | 14929 | 23 | 16 | 2.00886 | 2.02420 |
| 746 | RTA00000178AF.i.01.2 | 4 | 506 | 209 | 3.38335 | 15.7309 |
| 861 | RTA00000339F.f.11.1 | 5832 | 5 | 0 | 6.98736 | 2.18988 |
| 990 | RTA00000126A.o.23.1 | 6268 | 5 | 0 | 6.98736 | 2.18988 |
| 1088 | RTA00000399F.f.11.1 | 40167 | 8 | 0 | 11.1797 | 2.98512 |
| 1288 | RTA00000423F.e.11.1 | 2566 | 11 | 2 | 7.68610 | 2.85611 |
| 1417 | RTA00000339F.o.07.1 | 2566 | 11 | 2 | 7.68610 | 2.85611 |
| 1444 | RTA00000419F.p.03.1 | 1937 | 10 | 3 | 4.65824 | 2.29362 |
| 1454 | RTA00000340F.l.05.1 | 38935 | 7 | 0 | 9.78231 | 2.74441 |
| 1570 | RTA00000403F.a.17.1 | 13686 | 8 | 0 | 11.1797 | 2.98512 |
| 1597 | RTA00000401F.n.23.1 | 1552 | 8 | 1 | 11.1797 | 2.53243 |
| 1979 | RTA00000122A.h.24.1 | 48 | 342 | 155 | 3.08345 | 12.2138 |
| 2024 | RTA00000528F.b.23.1 | 1605 | 22 | 4 | 7.68610 | 4.23808 |
| 2034 | RTA00000528F.m.16.1 | 4468 | 6 | 1 | 8.38484 | 1.97787 |
| 2126 | RTA00000526F.d.01.1 | 4468 | 6 | 1 | 8.38484 | 1.97787 |

TABLE 8

Differentially expressed polynucleotides: Higher expression in low metastatic lung cancer cells (lib9) relative to high metastatic potential lung cancer cells

| SEQ ID NO: | Sequence Name | Cluster ID | Lib8 clones | Lib9 clones | lib9/lib8 | Zscore |
|---|---|---|---|---|---|---|
| 174 | RTA00000181AF.e.22.3 | 3442 | 5 | 23 | 3.291654 | 2.368262 |
| 254 | RTA00000178AF.n.2.1 | 17083 | 0 | 8 | 5.724617 | 2.034117 |
| 466 | RTA00000177AF.p.20.1 | 4141 | 4 | 27 | 4.830145 | 3.070829 |
| 571 | RTA00000198AF.b.14.1 | 801 | 16 | 46 | 2.057284 | 2.411087 |
| 574 | RTA00000192AF.f.3.1 | 5257 | 5 | 25 | 3.577885 | 2.596857 |
| 590 | RTA00000190AF.d.2.1 | 2444 | 12 | 37 | 2.206362 | 2.299984 |
| 922 | RTA00000399F.l.14.1 | 3354 | 5 | 20 | 2.862308 | 1.998763 |
| 1355 | RTA00000406F.m.04.1 | 14959 | 11 | 41 | 2.667151 | 2.865855 |
| 1422 | RTA00000405F.h.07.2 | 4984 | 3 | 16 | 3.816411 | 2.058861 |
| 2007 | RTA00000400F.g.08.1 | 1275 | 10 | 42 | 3.005423 | 3.147111 |
| 2038 | RTA00000527F.p.06.1 | 1292 | 8 | 33 | 2.951755 | 2.724411 |
| 2245 | RTA00000527F.k.09.1 | 213 | 137 | 403 | 2.104945 | 7.661033 |

Example 7

Polynucleotides Differentially Expressed in High Metastatic Potential Colon Cancer Cells Versus Low Metastatic Colon Cancer Cells A number of polynucleotide sequences have been identified that are differentially expressed between cells derived from high metastatic potential colon cancer tissue and low metastatic colon cancer cells. Expression of these sequences in colon cancer tissue can be valuable in determining diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic marker, for risk assessment, patient treatment and the like. These polynucleotide sequences can also be used in combination with other known molecular and/or biochemical markers.

The following table summarizes identified polynucleotides with differential expression between high metastatic potential colon cancer cells and low metastatic potential colon cancer cells:

Example 8

Polynucleotides Differentially Expressed in High Metastatic Potential Colon Cancer Patient Tissue Versus Normal Patient Tissue A number of polynucleotide sequences have been identified that are differentially expressed between cells derived from high metastatic potential colon cancer tissue and normal tissue. Expression of these sequences in colon cancer tissue can be valuable in determining diagnostic, prognostic and/or treatment information. For example, sequences that are highly expressed in the high metastatic potential cells are

TABLE 9

Differentially expressed polynucleotides: Higher expression in high metastatic potential colon cancer (lib1) relative to low metastatic colon cancer cells (lib2)

| SEQ ID NO: | Sequence Name | Cluster ID | Lib1 clones | Lib2 clones | lib1/lib2 | Zscore |
|---|---|---|---|---|---|---|
| 228 | RTA00000187AR.h.15.2 | 6660 | 7 | 0 | 6.489973399 | 2.169320547 |
| 280 | RTA00000193AF.b.18.1 | 7542 | 8 | 0 | 7.417112456 | 2.36964728 |
| 355 | RTA00000184AR.b.24.1 | 5777 | 9 | 1 | 8.344251513 | 2.09555146 |
| 491 | RTA00000196F.k.11.1 | 3 | 5268 | 2164 | 2.257009497 | 32.96556438 |
| 603 | RTA00000183AR.d.11.3 | 6420 | 8 | 0 | 7.417112456 | 2.36964728 |
| 680 | RTA00000177AF.f.10.1 | 6420 | 8 | 0 | 7.417112456 | 2.36964728 |
| 752 | RTA00000192AF.o.7.1 | 5275 | 11 | 2 | 5.099264814 | 2.083995588 |
| 753 | RTA00000192AF.o.17.1 | 5275 | 11 | 2 | 5.099264814 | 2.083995588 |
| 1241 | RTA00000346F.l.13.1 | 7542 | 8 | 0 | 7.417112456 | 2.36964728 |
| 1264 | RTA00000349R.g.10.1 | 5777 | 9 | 1 | 8.344251513 | 2.09555146 |
| 1401 | RTA00000421F.m.14.1 | 3524 | 21 | 6 | 3.2449867 | 2.499690198 |
| 1442 | RTA00000350R.g.10.1 | 9026 | 7 | 0 | 6.489973399 | 2.169320547 |
| 1514 | RTA00000399F.o.06.1 | 13574 | 7 | 0 | 6.489973399 | 2.169320547 |
| 1851 | RTA00000421F.a.06.1 | 2385 | 27 | 4 | 6.258188635 | 3.743586088 |
| 1915 | RTA00000400F.g.02.1 | 1508 | 46 | 17 | 2.508729213 | 3.230059264 |
| 2024 | RTA00000528F.b.23.1 | 1605 | 36 | 11 | 3.034273278 | 3.244010467 |
| 2066 | RTA00000528F.m.12.1 | 5768 | 12 | 0 |  | 3.046665462 |

TABLE 10

Differentially expressed polynucleotides: Higher expression in low metastatic colon cancer cells (lib2)relative to high metastatic potential colon cancer (lib1)

| SEQ ID NOS: | Sequence Name | Cluster ID | Lib1 clones | Lib2 clones | lib2/lib1 | Zscore |
|---|---|---|---|---|---|---|
| 33 | RTA00000178AR.a.20.1 | 945 | 9 | 21 | 2.51670 | 2.21703 |
| 250 | RTA00000192AF.j.21.1 | 2289 | 3 | 23 | 8.26916 | 3.92187 |
| 282 | RTA00000193AF.c.15.1 | 3726 | 3 | 14 | 5.03340 | 2.58312 |
| 370 | RTA00000179AF.c.15.3 | 2995 | 4 | 13 | 3.50540 | 2.09770 |
| 387 | RTA00000191AF.j.14.1 | 1002 | 12 | 65 | 5.84234 | 6.26259 |
| 443 | RTA00000197AR.i.17.1 | 3516 | 5 | 17 | 3.66719 | 2.52439 |
| 460 | RTA00000179AF.c.15.1 | 2995 | 4 | 13 | 3.50540 | 2.09770 |
| 545 | RTA00000196F.a.2.1 | 3575 | 5 | 14 | 3.02004 | 2.00158 |
| 560 | RTA00000184AF.i.23.3 | 1577 | 12 | 40 | 3.59528 | 4.01991 |
| 703 | RTA00000198F.l.09.1 | 3611 | 2 | 13 | 7.01081 | 2.73040 |
| 704 | RTA00000190AF.o.12.1 | 3438 | 5 | 14 | 3.02004 | 2.00158 |
| 1095 | RTA00000408F.l.13.1 | 4423 | 1 | 8 | 8.62869 | 2.11495 |
| 1104 | RTA00000404F.m.10.2 | 779 | 27 | 54 | 2.15717 | 3.23169 |
| 1205 | RTA00000118A.a.23.1 | 3500 | 3 | 13 | 4.67387 | 2.40298 |
| 1354 | RTA00000401F.k.14.1 | 211 | 109 | 206 | 2.03843 | 6.08597 |
| 1387 | RTA00000191AF.j.14.1 | 1002 | 12 | 65 | 5.84234 | 6.26259 |
| 1734 | RTA00000345F.b.17.1 | 945 | 9 | 21 | 2.51670 | 2.21703 |
| 1742 | RTA00000422F.b.22.1 | 2368 | 14 | 34 | 2.61942 | 3.00662 |
| 1954 | RTA00000401F.j.23.1 | 570 | 59 | 148 | 2.70560 | 6.66631 |
| 2262 | RTA00000527F.o.12.1 | 688 | 29 | 60 | 2.23155 | 3.53946 |
| 2325 | RTA00000525F.d.13.1 | 349 | 69 | 138 | 2.15717 | 5.27497 | associated can be indicative of increased expression of genes or regulatory sequences involved in the advanced disease state which involves processes such as angiogenesis, dedifferentiation, cell replication, and metastasis. A patient sample displaying an increased level of one or more of these polynucleotides may thus warrant more aggressive treatment.

The differential expression of these polynucleotides can be used as a diagnostic marker, a prognostic marker, for risk assessment, patient treatment and the like. These polynucleotide sequences can also be used in combination with other known molecular and/or biochemical markers.

The following tables summarize polynucleotides that are differentially expressed between high metastatic potential colon cancer cells and normal colon cells:

Example 9

Polynucleotides Differentially Expressed in High Colon Tumor Potential Patient Tissue Versus Metastasized Colon Cancer Patient Tissue A number of polynucleotide sequences have been identified that are differentially expressed between cells derived from high tumor potential colon cancer tissue and cells derived from high metastatic potential colon cancer cells. Expression of these sequences in colon cancer tissue can be valuable in determining diagnostic, prognostic and/or treatment information associated with the transformation of precancerous tissue to malignant tissue. This information can be useful in the prevention of achieving the advanced malignant state in these tissues, and can be important in risk assessment for a patient.

TABLE 11

Differentially expressed polynucleotides isolated from samples from two patients (UC#2 and UC#3): Higher expression in high metastatic potential colon tissue (UC#2:lib17; UC#3:lib20) vs. normal colon tissue (UC#2:lib15; UC#3:lib18)

| SEQ ID NO: | Sequence Name | Cluster ID | lib15 clones | lib17 clones | lib17/lib15 | | Zscore |
|---|---|---|---|---|---|---|---|
| 65 | RTA00000198AF.m.16.1 | 51 | 1 | 10 | 9.27022 | | 2.28830 |
| 1780 | RTA00000118A.j.24.1 | 18 | 4 | 23 | 5.33037 | | 3.27028 |
| 1899 | RTA00000345F.j.09.1 | 13 | 14 | 80 | 5.29727 | | 6.34580 |
| | | | lib18 clones | lib20 clones | lib20/lib18 | | |
| 1899 | RTA00000345F.j.09.1 | 13 | 12 | 23 | 2.24234 | | 2.16077 |

TABLE 12

Differentially expressed polynucleotides isolated from samples from two patients (UC#2 and UC#3): Higher expression in normal colon tissue (UC#2:lib15; UC#3:lib18)vs. high metastatic potential colon tissue (UC#2:lib17; UC#3:lib20).

| SEQ ID NO: | Sequence Name | Cluster ID | Lib5 Clones | Lib7 Clones | lib15/lib17 | Z Score: >2.5899%; >1.96 |
|---|---|---|---|---|---|---|
| 491 | RTA00000196F.k.11.1 | 3 | 242 | 26 | 10.04 | 13.78900072 |
| | | | Lib18 clones | Lib20 clones | lib18/lib20 | Zscore |
| 491 | RTA00000196F.k.11.1 | 3 | 409 | 46 | 7.59993 | 15.3998 |

The following table summarizes identified polynucleotides with differential expression between high tumor potential colon cancer tissue and cells derived from high metastatic potential colon cancer cells:

TABLE 13

Differentially expressed polynucleotides: High tumor potential colon tissue vs. metastatic colon tissue

| SEQ ID NO: | Sequence Name | Cluster ID | L19 clones | L20 clones | lib19/lib20 | Zscore |
|---|---|---|---|---|---|---|
| 252 | RTA00000181AF.e.18.3 | 8 | 14 | 1 | 10.4712 | 2.56699 |
| 253 | RTA00000181AF.e.17.3 | 8 | 14 | 1 | 10.4712 | 2.56699 |
| 491 | RTA00000196F.k.11.1 | 3 | 328 | 46 | 5.33318 | 11.8962 |
| 581 | RTA00000191AF.p.3.2 | 17 | 24 | 2 | 8.97535 | 3.41950 |
| 693 | RTA00000198F.m.12.1 | 4 | 26 | 8 | 2.43082 | 2.09705 |
| 726 | RTA00000200R.f.10.1 | 4 | 26 | 8 | 2.43082 | 2.09705 |
| 746 | RTA00000178AF.i.01.2 | 4 | 26 | 8 | 2.43082 | 2.09705 |
| 1780 | RTA00000118A.j.24.1 | 18 | 80 | 13 | 4.60274 | 5.51440 |
| 1899 | RTA00000345F.j.09.1 | 13 | 148 | 23 | 4.81287 | 7.68618 |

Example 10

Polynucleotides Differentially Expressed in High Tumor Potential Colon Cancer Patient Tissue Versus Normal Patient Tissue A number of polynucleotide sequences have been identified that are differentially expressed between cells derived from high tumor potential colon cancer tissue and normal tissue. Expression of these sequences in colon cancer tissue can be valuable in determining diagnostic, prognostic and/or treatment information associated with the prevention of achieving the malignant state in these tissues, and can be important in risk assessment for a patient. For example, sequences that are highly expressed in the potential colon cancer cells are associated with or can be indicative of increased expression of genes or regulatory sequences involved in early tumor progression. A patient sample displaying an increased level of one or more of these polynucleotides may thus warrant closer attention or more frequent screening procedures to catch the malignant state as early as possible.

The following tables summarize polynucleotides that are differentially expressed between high metastatic potential colon cancer cells and normal colon cells:

TABLE 14

Differentially expressed polynucleotides detected in samples from two patients (UC#2 and UC#3): Higher expression in tumor potential colon tissue (UC#2:lib16; UC#3:lib19)vs. normal colon tissue (UC#2:lib15; UC#3:lib18)

| SEQ ID NO: | Sequence Name | Cluster ID | Lib15 clones | Lib16 clones | lib16/lib15 | Zscore |
|---|---|---|---|---|---|---|
| 1899 | RTA00000345Fj.09.1 | 13 | 14 | 50 | 3.43709 | 4.22436 |
| | | | Lib18 clones | Lib19 clones | lib19/lib18 | |
| 65 | RTA00000198AF.m.16.1 | 51 | 0 | 14 | 12.2505 | 3.23250 |
| 252 | RTA00000181AF.e.18.3 | 8 | 1 | 14 | 12.2505 | 2.84687 |
| 253 | RTA00000181AF.e.17.3 | 8 | 1 | 14 | 12.2505 | 2.84687 |
| 581 | RTA00000191AF.p.3.2 | 17 | 4 | 24 | 5.25021 | 3.24580 |
| 693 | RTA00000198F.m.12.1 | 4 | 6 | 26 | 3.79182 | 2.98901 |
| 716 | RTA00000200F.p.05.1 | 3984 | 0 | 7 | 6.12525 | 2.09621 |
| 726 | RTA00000200R.f.10.1 | 4 | 6 | 26 | 3.79182 | 2.98901 |
| 746 | RTA00000178AF.i.01.2 | 4 | 6 | 26 | 3.79182 | 2.98901 |
| 1780 | RTA00000118A.j.24.1 | 18 | 10 | 80 | 7.00028 | 6.65963 |
| 1899 | RTA00000345F.j.09.1 | 13 | 12 | 148 | 10.7921 | 9.86174 |

TABLE 15

Differentially expressed polynucleotides: Higher expression in normal colon tissue (UC#2:lib15) vs. tumor potential colon tissue (UC#2:lib16)

| SEQ ID NO: | Sequence Name | Cluster ID | Lib15 clones | Lib16 clones | lib15/lib16 | Zscore |
|---|---|---|---|---|---|---|
| 491 | RTA00000196F.k.11.1 | 3 | 242 | 39 | 6.44765 | 12.3988 |

Example 11

Polynucleotides Differentially Expressed in Growth Factor-stimulated Human Microvascular Endothelial Cells (HMEC) Relative to Untreated HMEC A number of polynucleotide sequences have been identified that are differentially expressed between human microvascular endothelial cells (HMEC) that have been treated with growth factors relative to untreated HMEC.

Sequences that are differentially expressed between growth factor-treated HMEC and untreated HMEC can represent sequences encoding gene products involved in angiogenesis, metastasis (cell migration), and other development and oncogenic processes. For example, sequences that are more highly expressed in HMEC treated with growth factors (such as bFGF or VEGF) relative to untreated HMEC can serve as markers of cancer cells of higher metastatic potential. Detection of expression of these sequences in colon cancer tissue can be valuable in determining diagnostic, prognostic and/or treatment information associated with the prevention of achieving the malignant state in these tissues, and can be important in risk assessment for a patient. A patient sample displaying an increased level of one or more of these polynucleotides may thus warrant closer attention or more frequent screening procedures to catch the malignant state as early as possible.

The following table summarizes identified polynucleotides with differential expression between growth factor-treated and untreated HMEC.

TABLE 16

Differentially expressed polynucleotides: Higher expression in bFGF treated HMEC (lib13) vs. untreated HMEC (lib12)

| SEQ ID NO: | Sequence Name | Cluster ID | Lib12 clones | Lib13 clones | lib13/lib12 | Zscore |
|---|---|---|---|---|---|---|
| 648 | RTA00000199F.i.9.1 | 7 | 25 | 52 | 2.07199 | 2.94741 |

TABLE 17

Differentially expressed polynucleotides: Higher expression in VEGF treated HMEC (lib14) vs. untreated HMEC (lib12)

| SEQ ID NO: | Sequence Name | Cluster ID | Lib12 clones | Lib14 clones | lib14/lib12 | Zscore |
|---|---|---|---|---|---|---|
| 648 | RTA00000199F.i.9.1 | 7 | 25 | 67 | 2.62449 | 4.17666 |
| 1899 | RTA00000345F.j.09.1 | 13 | 22 | 49 | 2.18114 | 2.99887 |

Example 12

Polynucleotides Differentially Expressed Across Multiple Libraries

A number of polynucleotide sequences have been identified that are differentially expressed between cancerous cells and normal cells across all three tissue types tested (i.e., breast, colon, and lung). Expression of these sequences in a tissue or any origin can be valuable in determining diagnostic, prognostic and/or treatment information associated with the prevention of achieving the malignant state in these tissues, and can be important in risk assessment for a patient. These polynucleotides can also serve as non-tissue specific markers of, for example, risk of metastasis of a tumor. The following table summarizes identified polynucleotides that were differentially expressed but without tissue type-specificity in the breast, colon, and lung libraries tested.

TABLE 18

Polynucleotides Differentially Expressed Across Multiple Library Comparisons

| SEQ ID NO. | Cluster | Clones in 1st Lib | Clones in 2nd Lib | Ratio | Cell or Tissue Sample and Cancer State Compared (Z Score) |
|---|---|---|---|---|---|
| 2024 | 1605 | lib1 | lib2 | lib1/lib2 | colon: high met > low met |
|  |  | 36 | 11 | 3.0342732 | (3.2440104) |
|  |  | lib8 | lib9 | lib8/lib9 | lung: high met > low met |
|  |  | 22 | 4 | 7.6861036 | (4.2380835) |

TABLE 18-continued

Polynucleotides Differentially Expressed Across Multiple Library Comparisons

| SEQ ID NO. | Cluster | Clones in 1st Lib | Clones in 2nd Lib | Ratio | Cell or Tissue Sample and Cancer State Compared (Z Score) |
|---|---|---|---|---|---|
| 65 | 51 | lib8 | lib9 | lib8/lib9 | lung: high met > low met |
|  |  | 348 | 66 | 7.3684960 | (17.431560) |
|  |  | lib18 | lib19 | lib19/lib18 | pt #3 colon: tumor > normal |
|  |  | 0 | 14 | 12.250507 | (3.2325073) |
|  |  | lib15 | lib17 | lib17/lib15 | pt #2 colon: met > normal |
|  |  | 1 | 10 | 9.2702249 | (2.2883061) |
| 174 | 3442 | lib8 | lib9 | lib9/lib8 | lung: low met > high met |
|  |  | 5 | 23 | 3.2916548 | (2.3682625) |
|  |  | lib3 | lib4 | lib3/lib4 | breast: high met > low met |
|  |  | 17 | 4 | 4.1465504 | (2.5623912) |
| 203 | 1827 | lib8 | lib9 | lib8/lib9 | lung: high met > low met |
|  |  | 45 | 15 | 4.1924201 | (5.0989192) |
|  |  | lib3 | lib4 | lib4/lib3 | breast: low met > high met |
|  |  | 37 | 157 | 4.3491051 | (8.7172773) |
| 2245 | 213 | lib8 | lib9 | lib9/lib8 | lung: low met > high met |
|  |  | 137 | 403 | 2.1049458 | (7.6610331) |
|  |  | lib3 | lib4 | lib3/lib4 | breast: high met > low met |
|  |  | 17 | 4 | 4.1465504 | (2.5623912) |
| 990 | 6268 | lib8 | lib9 | lib8/lib9 | lung: high met > low met |
|  |  | 5 | 0 | 6.9873669 | (2.1898837) |
|  |  | lib3 | lib4 | lib4/lib3 | breast: low met > high met |
|  |  | 3 | 18 | 6.1496901 | (3.1117967) |
| 252 | 8 | lib8 | lib9 | lib8/lib9 | lung: high met > low met |
|  |  | 1355 | 122 | 15.521118 | (39.021411) |
|  |  | lib19 | lib20 | lib19/lib20 | pt. #3 colon: tumor > met |
|  |  | 14 | 1 | 10.471247 | (2.5669948) |
|  |  | lib18 | lib19 | lib19/lib18 | pt #3 colon: tumor > normal |
|  |  | 1 | 14 | 12.250507 | (2.8468716) |
| 253 | 8 | lib8 | lib9 | lib8/lib9 | lung: high met > low met |
|  |  | 1355 | 122 | 15.521118 | (39.021411) |
|  |  | lib19 | lib20 | lib19/lib20 | pt. #3 colon: tumor > met |
|  |  | 14 | 1 | 10.471247 | (2.5669948) |
|  |  | lib18 | lib19 | lib19/lib18 | pt #3 colon: tumor > normal |
|  |  | 1 | 14 | 12.250507 | (2.8468716) |
| 2325 | 349 | lib3 | lib4 | lib3/lib4 | breast: high met > low met |
|  |  | 77 | 1 | 75.125736 | (°.3°440°7) |
|  |  | lib1 | lib2 | lib2/lib1 | colon: low met > high met |
|  |  | 69 | 138 | 2.1571737 | (5.2749799) |
| 1095 | 4423 | lib3 | lib4 | lib3/lib4 | breast: high met > low met |
|  |  | 12 | 1 | 11.707907 | (2.7293134) |
|  |  | lib1 | lib2 | lib2/lib1 | colon: low met > high met |
|  |  | 1 | 8 | 8.6286948 | (2.1149516) |
| 1124 | 779 | lib3 | lib4 | lib3/lib4 | breast: high met > low met |
|  |  | 60 | 22 | 2.6608879 | (3.9749537) |
|  |  | lib1 | lib2 | lib2/lib1 | colon: low met > high met |
|  |  | 27 | 54 | 2.1571737 | (3.2316908) |
| 387 | 1002 | lib3 | lib4 | lib3/lib4 | breast: high met > low met |
|  |  | 42 | 20 | 2.0488837 | (2.5703094) |
|  |  | lib1 | lib2 | lib2/lib1 | colon: low met > high met |
|  |  | 12 | 65 | 5.8423454 | (6.2625969) |
| 419 | 4769 | lib8 | lib9 | lib8/lib9 | lung: high met > low met |
|  |  | 10 | 3 | 4.6582446 | (2.2936274) |
|  |  | lib3 | lib4 | lib4/lib3 | breast: low met > high met |
|  |  | 2 | 20 | 10.249483 | (3.6825426) |
| 420 | 4769 | lib8 | lib9 | lib8/lib9 | lung: high met > low met |
|  |  | 10 | 3 | 4.6582446 | (2.2936274) |
|  |  | lib3 | lib4 | lib4/lib3 | breast: low met > high met |
|  |  | 2 | 20 | 10.249483 | (3.6825426) |
| 1205 | 3500 | lib3 | lib4 | lib3/lib4 | breast: high met > low met |
|  |  | 12 | 3 | 3.9026356 | (2.0180506) |
|  |  | lib1 | lib2 | lib2/lib1 | colon: low met > high met |
|  |  | 3 | 13 | 4.6738763 | (2.4029818) |
| 491 | 3 | lib1 | lib2 | lib1/lib2 | colon: high met > low met |
|  |  | 5268 | 2164 | 2.2570094 | (32.965564) |
|  |  | lib8 | lib9 | lib8/lib9 | lung: high met > low met |
|  |  | 986 | 392 | 3.5150733 | (22.468331) |
|  |  | lib19 | lib20 | lib19/lib20 | pt #3 colon: tumor > met |
|  |  | 328 | 46 | 5.3331820 | (11.896271) |
|  |  | lib18 | lib20 | lib18/lib20 | pt #3 colon: normal > met |
|  |  | 409 | 46 | 7.5999342 | (15.399861) |
|  |  | lib15 | lib17 | lib15/lib17 | pt #2 colon: normal > met |
|  |  | 242 | 26 | 10.04 | (13.789000) |

TABLE 18-continued

Polynucleotides Differentially Expressed Across Multiple Library Comparisons

| SEQ ID NO. | Cluster | Clones in 1st Lib | Clones in 2nd Lib | Ratio | Cell or Tissue Sample and Cancer State Compared (Z Score) |
|---|---|---|---|---|---|
|  |  | lib15 | lib16 | lib15/lib16 | pt #2 colon: normal > tumor |
|  |  | 242 | 39 | 6.44765 | 12.39883 |
| 552 | 35 | lib8 | lib9 | lib8/lib9 | lung: high met > low met |
|  |  | 868 | 11 | 110.27335 | (34.289704) |
|  |  | lib3 | lib4 | lib4/lib3 | breast: low met > high met |
|  |  | 386 | 1967 | 5.2229880 | (33.232871) |
| 560 | 1577 | lib3 | lib4 | lib3/lib4 | breast: high met > low met |
|  |  | 25 | 3 | 8.1304909 | (3.9038139) |
|  |  | lib1 | lib2 | lib2/lib1 | colon: low met > high met |
|  |  | 12 | 40 | 3.5952895 | (4.0199130) |
| 581 | 17 | lib19 | lib20 | lib19/lib20 | pt #3 colon: tumor > met |
|  |  | 24 | 2 | 8.9753551 | (3.4195074) |
|  |  | lib18 | lib19 | lib19/lib18 | pt #3 colon: tumor > normal |
|  |  | 4 | 24 | 5.2502174 | (3.2458055) |
| 590 | 2444 | lib3 | lib4 | lib4/lib3 | breast: low met > high met |
|  |  | 26 | 55 | 2.1681599 | (3.2224421) |
|  |  | lib8 | lib9 | lib9/lib8 | lung: low met > high met |
|  |  | 12 | 37 | 2.2063628 | (2.2999846) |
| 1354 | 211 | lib3 | lib4 | lib3/lib4 | breast: high met > low met |
|  |  | 121 | 43 | 2.7454588 | (5.8560985) |
|  |  | lib1 | lib2 | lib2/lib1 | colon: low met > high met |
|  |  | 109 | 206 | 2.0384302 | (6.0859794) |
| 1387 | 1002 | lib3 | lib4 | lib3/lib4 | breast: high met > low met |
|  |  | 42 | 20 | 2.0488837 | (2.5703094) |
|  |  | lib1 | lib2 | lib2/lib1 | colon: low met > high met |
|  |  | 12 | 65 | 5.8423454 | (6.2625969) |
| 648 | 7 | lib12 | lib14 | lib14/lib12 | HMEC: VEGF > untreated |
|  |  | 25 | 67 | 2.6244913 | (4.1766696) |
|  |  | lib12 | lib13 | lib13/lib12 | HMEC: bFGF > untreated |
|  |  | 25 | 52 | 2.0719962 | (2.9474155) |
| 693 | 4 | lib8 | lib9 | lib8/lib9 | lung: high met > low met |
|  |  | 506 | 209 | 3.3833566 | (15.730912) |
|  |  | lib3 | lib4 | lib4/lib3 | breast: low met > high met |
|  |  | 987 | 2807 | 2.9149240 | (30.381945) |
|  |  | lib19 | lib20 | lib19/lib20 | pt #3 colon: tumor > met |
|  |  | 26 | 8 | 2.4308253 | (2.0970580) |
|  |  | lib18 | lib19 | lib19/lib18 | pt #3 colon: tumor > normal |
|  |  | 6 | 26 | 3.7918237 | (2.9890107) |
| 726 | 4 | lib8 | lib9 | lib8/lib9 | lung: high met > low met |
|  |  | 506 | 209 | 3.3833566 | (15.730912) |
|  |  | lib3 | lib4 | lib4/lib3 | breast: low met > high met |
|  |  | 987 | 2807 | 2.9149240 | (30.381945) |
|  |  | lib19 | lib20 | lib19/lib20 | pt #3 colon: tumor > met |
|  |  | 26 | 8 | 2.4308253 | (2.0970580) |
|  |  | lib18 | lib19 | lib19/lib18 | pt #3 colon: tumor > normal |
|  |  | 6 | 26 | 3.7918237 | (2.9890107) |
| 746 | 4 | lib8 | lib9 | lib8/lib9 | lung: high met > low met |
|  |  | 506 | 209 | 3.3833566 | (15.730912) |
|  |  | lib3 | lib4 | lib4/lib3 | breast: low met > high met |
|  |  | 987 | 2807 | 2.9149240 | (30.381945) |
|  |  | lib19 | lib20 | lib19/lib20 | pt #3 colon: tumor > met |
|  |  | 26 | 8 | 2.4308253 | (2.0970580) |
|  |  | lib18 | lib19 | lib19/lib18 | pt #3 colon: tumor > normal |
|  |  | 6 | 26 | 3.7918237 | (2.9890107) |
| 1780 | 18 | lib19 | lib20 | lib19/lib20 | pt #3 colon: tumor > met |
|  |  | 80 | 13 | 4.6027462 | (5.5144093) |
|  |  | lib18 | lib19 | lib19/lib18 | pt #3 colon: tumor > normal |
|  |  | 10 | 80 | 7.0002899 | (6.6596394) |
|  |  | lib15 | lib17 | lib17/lib15 | pt #3 colon: met > normal |
|  |  | 4 | 23 | 5.3303793 | (3.2702852) |
| 1899 | 13 | lib19 | lib20 | lib19/lib20 | pt #3 colon: tumor > met |
|  |  | 148 | 23 | 4.8128716 | (7.6861840) |
|  |  | lib18 | lib20 | lib20/lib18 | pt #3 colon: met > normal |
|  |  | 12 | 23 | 2.2423439 | (2.1607719) |
|  |  | lib18 | lib19 | lib19/lib18 | pt #3 colon: tumor > normal |
|  |  | 12 | 148 | 10.792113 | (9.8617485) |
|  |  | lib15 | lib17 | lib17/lib15 | pt #2 colon: met > normal |
|  |  | 14 | 80 | 5.2972714 | (6.3458044) |
|  |  | lib15 | lib16 | lib16/lib15 | pt #2 colon: tumor > normal |
|  |  | 14 | 50 | 3.4370927 | (4.2243697) |
|  |  | lib12 | lib14 | lib14/lib12 | HMEC: VEGF > untreated |
|  |  | 22 | 49 | 2.1811410 | (2.9988774) |

TABLE 18-continued

Polynucleotides Differentially Expressed Across Multiple Library Comparisons

| SEQ ID NO. | Cluster | Clones in 1st Lib | Clones in 2nd Lib | Ratio | Cell or Tissue Sample and Cancer State Compared (Z Score) |
|---|---|---|---|---|---|
| 1915 | 1508 | lib1 | lib2 | lib1/lib2 | colon: high met > low met |
|  |  | 46 | 17 | 2.5087292 | (3.2300592) |
|  |  | lib3 | lib4 | lib3/lib4 | breast: high met > low met |
|  |  | 21 | 5 | 4.0977674 | (2.8791960) |
| 1979 | 48 | lib8 | lib9 | lib8/lib9 | lung: high met > low met |
|  |  | 342 | 155 | 3.0834574 | (12.213852) |
|  |  | lib3 | lib4 | lib4/lib3 | breast: low met > high met |
|  |  | 412 | 1020 | 2.5374934 | (16.526285) |
| 2007 | 1275 | lib3 | lib4 | lib4/lib3 | breast: low met > high met |
|  |  | 15 | 32 | 2.1865564 | (2.4185764) |
|  |  | lib8 | lib9 | lib9/lib8 | lung: low met > high met |
|  |  | 10 | 42 | 3.0054239 | 3.1471113 | high met = high metastatic potential; low met = low metastatic potential;
met = metastasized; tumor = non-metastasized tumor;
pt = patient; #2 = UC#2; #3 = UC#3;
HMEC = human microvascular endothelial cell;
bFGF = bFGF treated;
VEGF = VEGF treated

Example 12

Polynucleotides Exhibiting Colon-specific Expression

The cDNA libraries described herein were also analyzed to identify those polynucleotides that were specifically expressed in colon cells or tissue, i.e., the polynucleotides were identified in libraries prepared from colon cell lines or tissue, but not in libraries of breast or lung origin. The polynucleotides that were expressed in a colon cell line and/or in colon tissue, but were present in the breast or lung cDNA libraries described herein, are shown in Table 19 (inserted before claims).

No clones corresponding to the colon-specific polynucleotides in the table above were present in any of Libraries 3, 4, 8, 9, 12, 13, 14, or 15. The polynucleotide provided above can be used as markers of cells of colon origin, and find particular use in reference arrays, as described above.

Example 13

Identification of Continuous Sequences Having a Polynucleotide of the Invention The novel polynucleotides were used to screen publicly available and proprietary databases to determine if any of the polynucleotides of SEQ ID NOS:1–2502 would facilitate identification of a contiguous sequence, e.g., the polynucleotides would provide sequence that would result in 5′ extension of another DNA sequence, resulting in production of a longer contiguous sequence composed of the provided polynucleotide and the other DNA sequence(s). Contiging was performed using the Gelmerge application (default settings) of GCG from the Univ. of Wisconsin.

Using these parameters, 146 contiged sequences were generated. These contiged sequences are provided as SEQ ID NOS:5107–5252 (see Table 1). The contiged sequences can be correlated with the sequences of SEQ ID NOS:1–2502 upon which the contiged sequences are based by, for example, identifying those sequences of SEQ ID NOS:1–2502 and the contiged sequences of SEQ ID NOS:5107–5252 that share the same clone name in Table 1.

The contiged sequences (SEQ ID NO:5107–5252) thus represent longer sequences that encompass a polynucleotide sequence of the invention. The contiged sequences were then translated in all three reading frames to determine the best alignment with individual sequences using the BLAST programs as described above for SEQ ID NOS:1–2502 and the validation sequences "SEQ ID NOS:2503–5106." Again the sequences were masked using the XBLAST program for masking low complexity as described above in Example 1 (Table 2). Several of the contiged sequences were found to encode polypeptides having characteristics of a polypeptide belonging to a known protein families (and thus represent new members of these protein families) and/or comprising a known functional domain (Table 20). Thus the invention encompasses fragments, fusions, and variants of such polynucleotides that retain biological activity associated with the protein family and/or functional domain identified herein.

TABLE 20

Profile hits using contiged sequences

| SEQ ID NO | Biological Activity (Profile) | Start | Stop | Score | Direction | Sequence Name |
|---|---|---|---|---|---|---|
| 5111 | 7tm_2 | 71 | 915 | 8090 | for | RTA00000399F.o.01.1 |
| 5120 | 7tm_2 | 101 | 919 | 8475 | rev | RTA00000341F.m.21.1 |
| 5174 | 7tm_2 | 3 | 963 | 9431 | for | RTA00000192AF.h.19.1 |
| 5197 | 7tm_2 | 214 | 1073 | 8528 | rev | RTA00000192AF.f.3.1 |
| 5208 | ANK | 546 | 629 | 4920 | for | RTA00000190AF.f.5.1 |
| 5120 | asp | 126 | 1067 | 6620 | rev | RTA00000341F.m.21.1. |
| 5241 | asp | 112 | 1094 | 6553 | for | RTA00000418F.i.06.1 |
| 5243 | asp | 347 | 1028 | 5981 | for | RTA00000339F.b.02.1 |
| 5197 | ATPases | 113 | 781 | 5690 | for | RTA00000192AF.f.3.1 |
| 5239 | ATPases | 1 | 348 | 15955 | for | RTA00000401F.m.07.1 |
| 5241 | ATPases | 110 | 823 | 6782 | for | RTA00000418F.i.06.1 |
| 5243 | ATPases | 338 | 874 | 5832 | for | RTA00000339F.b.02.1 |

TABLE 20-continued

Profile hits using contiged sequences

| SEQ ID NO | Biological Activity (Profile) | Start | Stop | Score | Direction | Sequence Name |
|---|---|---|---|---|---|---|
| 5125 | prot-kinase | 59 | 685 | 5791 | for | RTA00000182AF.c.5.1 |
| 5217 | prot-kinase | 75 | 1035 | 5405 | for | RTA00000181AF.p.12.3 |
| 5237 | prot-kinase | 25 | 546 | 5107 | rev | RTA00000118A.n.5.1 |
| 5248 | prot-kinase | 14 | 422 | 5103 | rev | RTA00000419F.k.05.1 |
| 5252 | prot-kinase | 89 | 755 | 5499 | for | RTA00000404F.m.17.2 |
| 5120 | Wnt_dev_sign | 3 | 948 | 11036 | for | RTA00000341F.m.21.1 |

All stop/start sequences are provided in the forward direction.

Descriptions of the profiles for the indicated protein families and functional domains are provided in Example 3 above.

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

DEPOSIT INFORMATION:

The following materials were deposited with the American Type Culture Collection: CMCC=(Chiron Master Culture Collection)

| Cell Lines Deposited with ATCC | | | |
|---|---|---|---|
| Cell Line | Deposit Date | ATCC Accession No. | CMCC Accession No. |
| KM12L4-A | Mar. 9, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

| cDNA Libraries Deposited with ATCC | |
|---|---|
| cDNA Library No. | cDNA Library ES10 |
| Deposit Date | Jan. 13, 1999 |
| ATCC Accession No. | ATCC No. 207032 |
| Clone Names | M00001358C:C06 |
| | M00001388D:G05 |
| | M00001394A:F01 |
| | M00001429A:H04 |
| | M00001447A:G03 |
| | M00001448D:C09 |
| | M00001454D:G03 |

| cDNA Library No. | cDNA Library ES21 | cDNA Library ES22 | cDNA Library ES23 |
|---|---|---|---|
| Deposit Date | Jan. 22, 1999 | Jan. 22, 1999 | Jan. 22, 1999 |
| ATCC Accession No. | ATCC No. | ATCC No. | ATCC No. |
| Clone Names | M00001575D:G05 | M00001364A:E11 | M00001489B:A06 |
| | M00001460A:A03 | M00001694C:H10 | M00001585A:D06 |
| | M00001655C:E04 | M00003841D:E03 | M00001637B:E07 |
| | M00001676C:C11 | M00004176D:B12 | M00001529D:H02 |
| | M00001679D:D05 | M00001387B:E02 | M00001500C:C08 |
| | M00001546B:C05 | M00004282B:A04 | M00001483B:D03 |
| | M00001453B:E10 | M00001376B:F03 | M00001623C:H07 |
| | | M00001445D:A06 | M00003975B:F03 |
| | | M00001399C:H12 | |
| | | M00004208D:H08 | |

-continued

| cDNA Library No. | cDNA Library ES24 | cDNA Library ES25 | cDNA Library ES26 |
|---|---|---|---|
| Deposit Date | Jan. 22, 1999 | Jan. 22, 1999 | Jan. 22, 1999 |
| ATCC Accession No. | ATCC No. | ATCC No. | ATCC No. |
| Clone Names | M00003987D:D06 | M00001675D:B08 | M00001479C:F10 |
|  | M00004073A:H12 | M00001589B:E12 | M00003842D:F08 |
|  | M00004104B:F11 | M00001607D:A11 | M00003901A:C09 |
|  | M00004237D:D08 | M00001636D:E07 | M00003982A:B06 |
|  | M00004111D:B07 | M00001530A:B12 | M00003824A:A06 |
|  | M00004138B:B11 | M00001495B:B08 | M00003845D:C03 |
|  | M00001391C:C04 | M00001487C:F01 | M00003856A:B07 |
|  | M00001448D:E12 | M00001644B:D06 | M00004104B:A02 |
|  | M00001450A:B03 | M00003751C:A04 | M00004110C:E03 |
|  | M00001451B:F01 |  |  |

In addition, libraries of selected clones were deposited. The details of these deposits are provided in Tables 21–24.

This deposit is provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

Retrieval of Individual Clones from Deposit of Pooled Clones

Where the ATCC deposit is composed of a pool of cDNA clones, the deposit was prepared by first transfecting each of the clones into separate bacterial cells. the clones were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

TABLE 1

| SEQ ID NO: | Filing Date of Priority Appln | SEQ ID NO: in Priority Appln | Sequence Name | Clone Name | Cluster ID |
|---|---|---|---|---|---|
| 1 | Jan. 28, 1998 | 1 | RTA00000197AF.i.16.1 | M00001490A:D11 | 16402 |
| 2 | Jan. 28, 1998 | 2 | RTA00000188AF.n.15.1 | M00003804A:H04 | 0 |
| 3 | Jan. 28, 1998 | 3 | RTA00000197AF.e.24.1 | M00001456B:F10 | 39250 |
| 4 | Jan. 28, 1998 | 4 | RTA00000198R.f.04.1 | M00001607D:F07 | 5023 |
| 5 | Jan. 28, 1998 | 5 | RTA00000195R.c.11.1 | M00003811A:E03 | 66087 |
| 6 | Jan. 28, 1998 | 6 | RTA00000195AF.c.16.1 | M00003829C:A11 | 23508 |
| 7 | Jan. 28, 1998 | 7 | RTA00000197AR.e.12.1 | M00001454B:G07 | 22095 |
| 8 | Jan. 28, 1998 | 8 | RTA00000200AF.h.11.2 | M00004146A:C08 | 8399 |
| 9 | Jan. 28, 1998 | 9 | RTA00000177AF.g.22.1 | M00001347C:G08 | 7031 |
| 10 | Jan. 28, 1998 | 10 | RTA00000198AF.n.16.1 | M00001694C:H10 | 3721 |
| 11 | Jan. 28, 1998 | 11 | RTA00000199AF.i.17.1 | M00003880C:F10 | 9615 |
| 12 | Jan. 28, 1998 | 12 | RTA00000183AF.i.15.2 | M00001529B:C04 | 2642 |
| 13 | Jan. 28, 1998 | 13 | RTA00000190AF.i.5.1 | M00003919A:A10 | 0 |
| 14 | Jan. 28, 1998 | 14 | RTA00000196R.c.11.2 | M00001352A:E12 | 13658 |
| 15 | Jan. 28, 1998 | 15 | RTA00000177AR.n.8.1 | M00001356D:F06 | 4188 |
| 16 | Jan. 28, 1998 | 16 | RTA00000196AF.e.16.1 | M00001363C:H02 | 39252 |
| 17 | Jan. 28, 1998 | 17 | RTA00000183AR.e.14.2 | M00001506B:D09 | 17437 |
| 18 | Jan. 28, 1998 | 18 | RTA00000196AF.c.17.1 | M00001352C:F06 | 39602 |
| 19 | Jan. 28, 1998 | 19 | RTA00000185AF.a.8.1 | M00001570D:A03 | 4868 |
| 20 | Jan. 28, 1998 | 20 | RTA00000181AF.l.14.2 | M00001454D:D06 | 2364 |
| 21 | Jan. 28, 1998 | 21 | RTA00000131A.g.19.2 | M00001449A:G10 | 36535 |
| 22 | Jan. 28, 1998 | 22 | RTA00000187AR.o.10.2 | M00001718D:F07 | 8984 |
| 23 | Jan. 28, 1998 | 23 | RTA00000198R.b.08.1 | M00001567C:H12 | 22636 |
| 24 | Jan. 28, 1998 | 24 | RTA00000200AF.f.11.1 | M00004111D:D11 | 0 |
| 25 | Jan. 28, 1998 | 25 | RTA00000196AF.c.1.1 | M00001349C:C05 | 8171 |
| 26 | Jan. 28, 1998 | 26 | RTA00000200R.g.09.1 | M00004131B:H09 | 22785 |
| 27 | Jan. 28, 1998 | 27 | RTA00000192AF.i.12.1 | M00004169C:C12 | 5319 |
| 28 | Jan. 28, 1998 | 28 | RTA00000178AR.o.01.5 | M00001387B:H07 | 0 |
| 29 | Jan. 28, 1998 | 29 | RTA00000200AF.b.19.1 | M00004042D:H02 | 22847 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 30 | Jan. 28, 1998 | 30 | RTA00000184AR.n.07.2 | M00001561C:F06 | 0 |
| 31 | Jan. 28, 1998 | 31 | RTA00000200F.m.15.1 | M00004236C:D10 | 22601 |
| 32 | Jan. 28, 1998 | 32 | RTA00000198R.m.19.1 | M00001680D:D02 | 40041 |
| 33 | Jan. 28, 1998 | 33 | RTA00000178AR.a.20.1 | M00001362C:H11 | 945 |
| 34 | Jan. 28, 1998 | 34 | RTA00000197AF.n.8.1 | M00001536D:A12 | 4101 |
| 35 | Jan. 28, 1998 | 35 | RTA00000191AF.n.17.1 | M00004091B:D11 | 7848 |
| 36 | Jan. 28, 1998 | 36 | RTA00000181AF.p.4.3 | M00001460A:A03 | 40392 |
| 37 | Jan. 28, 1998 | 37 | RTA00000181AF.n.15.2 | M00001457A:B07 | 86128 |
| 38 | Jan. 28, 1998 | 38 | RTA00000196R.k.07.1 | M00001399C:D09 | 22443 |
| 39 | Jan. 28, 1998 | 39 | RTA00000189AR.b.19.1 | M00003832B:E01 | 5294 |
| 40 | Jan. 28, 1998 | 40 | RTA00000200AR.e.02.1 | M00004090A:F09 | 36059 |
| 41 | Jan. 28, 1998 | 41 | RTA00000184F.k.12.1 | M00001557D:D09 | 8761 |
| 42 | Jan. 28, 1998 | 42 | RTA00000184F.j.21.1 | M00001557A:D02 | 7065 |
| 43 | Jan. 28, 1998 | 43 | RTA00000179AF.c.14.3 | M00001392D:H04 | 0 |
| 44 | Jan. 28, 1998 | 44 | RTA00000199F.f.08.2 | M00003841D:E03 | 12445 |
| 45 | Jan. 28, 1998 | 45 | RTA00000197AR.f.12.1 | M00001458C:E01 | 3513 |
| 46 | Jan. 28, 1998 | 46 | RTA00000182AF.f.13.1 | M00001470C:B10 | 8010 |
| 47 | Jan. 28, 1998 | 47 | RTA00000192AF.m.12.1 | M00004191D:B11 | 0 |
| 48 | Jan. 28, 1998 | 48 | RTA00000177AR.a.23.5 | M00001339D:G02 | 6995 |
| 49 | Jan. 28, 1998 | 49 | RTA00000198R.o.05.1 | M00003750A:D01 | 26702 |
| 50 | Jan. 28, 1998 | 50 | RTA00000201R.a.02.1 | M00004295B:D02 | 35362 |
| 51 | Jan. 28, 1998 | 51 | RTA00000199R.k.07.1 | M00003901C:A03 | 12973 |
| 52 | Jan. 28, 1998 | 52 | RTA00000201R.b.02.1 | M00004319D:G09 | 22660 |
| 53 | Jan. 28, 1998 | 53 | RTA00000199AF.p.9.1 | M00003988A:E10 | 10430 |
| 54 | Jan. 28, 1998 | 54 | RTA00000200F.o.22.1 | M00004282B:A04 | 983 |
| 55 | Jan. 28, 1998 | 55 | RTA00000186AF.i.21.1 | M00001636C:H09 | 6033 |
| 56 | Jan. 28, 1998 | 56 | RTA00000177AF.e.9.1 | M00001343D:C04 | 37442 |
| 57 | Jan. 28, 1998 | 57 | RTA00000198AF.k.20.1 | M00001660C:B12 | 22553 |
| 58 | Jan. 28, 1998 | 58 | RTA00000199F.b.01.2 | M00003778A:D08 | 19118 |
| 59 | Jan. 28, 1998 | 59 | RTA00000195AF.b.13.1 | M00001560D:A03 | 12605 |
| 59 | Feb. 24, 1998 | 78 | RTA00000195AF.b.13.1 | M00001560D:A03 | 12605 |
| 60 | Jan. 28, 1998 | 60 | RTA00000196AR.i.12.3 | M00001389D:G11 | 38800 |
| 61 | Jan. 28, 1998 | 61 | RTA00000197AF.h.11.1 | M00001476D:G03 | 22264 |
| 62 | Jan. 28, 1998 | 62 | RTA00000190AF.a.18.2 | M00003900D:B10 | 0 |
| 63 | Jan. 28, 1998 | 63 | RTA00000184AF.k.19.1 | M00001558B:D08 | 8022 |
| 64 | Jan. 28, 1998 | 64 | RTA00000198AF.p.12.1 | M00003763D:E10 | 8878 |
| 65 | Jan. 28, 1998 | 65 | RTA00000198AF.m.16.1 | M00001679D:D05 | 51 |
| 66 | Jan. 28, 1998 | 66 | RTA00000199F.c.09.2 | M00003800A:C09 | 16824 |
| 67 | Jan. 28, 1998 | 67 | RTA00000200AF.g.07.1 | M00004128B:G01 | 0 |
| 68 | Jan. 28, 1998 | 68 | RTA00000184F.k.19.1 | M00001558B:D08 | 8022 |
| 69 | Jan. 28, 1998 | 69 | RTA00000186AF.h.8.1 | M00001632C:C09 | 35547 |
| 70 | Jan. 28, 1998 | 70 | RTA00000192AF.e.3.1 | M00004138B:H02 | 13272 |
| 71 | Jan. 28, 1998 | 71 | RTA00000193AR.o.16.3 | M00004409B:A11 | 52972 |
| 72 | Jan. 28, 1998 | 72 | RTA00000200F.a.6.1 | M00004029B:F11 | 36952 |
| 73 | Jan. 28, 1998 | 73 | RTA00000177AF.e.21.3 | M00001344A:H07 | 4306 |
| 74 | Jan. 28, 1998 | 74 | RTA00000196AF.h.20.1 | M00001385B:F10 | 0 |
| 75 | Jan. 28, 1998 | 75 | RTA00000180AR.h.19.2 | M00001428A:H10 | 84182 |
| 76 | Jan. 28, 1998 | 76 | RTA00000200AF.h.05.2 | M00004142D:E10 | 10950 |
| 77 | Jan. 28, 1998 | 77 | RTA00000197AF.n.2.1 | M00001535A:D02 | 6229 |
| 78 | Jan. 28, 1998 | 78 | RTA00000199R.f.09.1 | M00003842B:D09 | 22907 |
| 79 | Jan. 28, 1998 | 79 | RTA00000199AF.p.4.1 | M00003985C:F01 | 10282 |
| 80 | Jan. 28, 1998 | 80 | RTA00000196AF.p.13.2 | M00001432A:E06 | 6125 |
| 81 | Jan. 28, 1998 | 81 | RTA00000196AF.b.15.1 | M00001347B:E01 | 5102 |
| 82 | Jan. 28, 1998 | 82 | RTA00000183AF.l.18.1 | M00001535D:C01 | 3484 |
| 83 | Jan. 28, 1998 | 83 | RTA00000186AF.f.24.2 | M00001629B:E06 | 0 |
| 84 | Jan. 28, 1998 | 84 | RTA00000191AF.h.14.1 | M00004056B:D09 | 13553 |
| 85 | Jan. 28, 1998 | 85 | RTA00000200R.o.03.1 | M00004257C:H06 | 22807 |
| 86 | Jan. 28, 1998 | 86 | RTA00000189AF.l.22.1 | M00003879C:G10 | 33333 |
| 87 | Feb. 24, 1998 | 245 | RTA00000195AF.d.20.1 | M00004117A:D11 | 37574 |
| 87 | Jan. 28, 1998 | 87 | RTA00000195AF.d.20.1 | M00004117A:D11 | 37574 |
| 88 | Jan. 28, 1998 | 88 | RTA00000197AF.e.23.1 | M00001456B:C09 | 37157 |
| 89 | Jan. 28, 1998 | 89 | RTA00000177AF.n.8.3 | M00001356D:F06 | 4188 |
| 90 | Jan. 28, 1998 | 90 | RTA00000199F.f.15.2 | M00003845A:H12 | 8772 |
| 91 | Jan. 28, 1998 | 91 | RTA00000198AF.j.19.1 | M00001653C:F12 | 38914 |
| 92 | Jan. 28, 1998 | 92 | RTA00000198AF.j.18.1 | M00001653B:G07 | 22759 |
| 93 | Jan. 28, 1998 | 93 | RTA00000200F.o.11.1 | M00004270A:F11 | 0 |
| 94 | Jan. 28, 1998 | 94 | RTA00000195AF.b.4.1 | M00001490C:D07 | 0 |
| 95 | Jan. 28, 1998 | 95 | RTA00000180AF.g.3.1 | M00001425A:C11 | 9024 |
| 96 | Jan. 28, 1998 | 96 | RTA00000197AF.j.20.1 | M00001496C:C11 | 4915 |
| 97 | Jan. 28, 1998 | 97 | RTA00000197AF.o.2.1 | M00001541C:B07 | 5739 |
| 98 | Jan. 28, 1998 | 98 | RTA00000200AF.f.14.1 | M00004115D:C08 | 22051 |
| 99 | Jan. 28, 1998 | 99 | RTA00000184AF.d.8.1 | M00001548A:A08 | 4393 |
| 100 | Jan. 28, 1998 | 100 | RTA00000200R.f.14.1 | M00004115D:C08 | 22051 |
| 101 | Jan. 28, 1998 | 101 | RTA00000191AF.d.08.2 | M00003997B:G07 | 970 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 102 | Jan. 28, 1998 | 102 | RTA00000199R.j.08.1 | M00003884D:G07 | 37844 |
| 103 | Jan. 28, 1998 | 103 | RTA00000199F.e.10.1 | M00003822A:F02 | 22906 |
| 104 | Jan. 28, 1998 | 104 | RTA00000196R.h.03.1 | M00001381A:D02 | 6636 |
| 105 | Jan. 28, 1998 | 105 | RTA00000179AF.g.12.3 | M00001398A:G03 | 36390 |
| 106 | Jan. 28, 1998 | 106 | RTA00000197AF.n.21.1 | M00001540B:C09 | 0 |
| 107 | Jan. 28, 1998 | 107 | RTA00000196R.i.13.1 | M00001390A:A09 | 9857 |
| 108 | Jan. 28, 1998 | 108 | RTA00000183AR.h.23.2 | M00001528A:F09 | 18957 |
| 109 | Jan. 28, 1998 | 109 | RTA00000197AF.d.12.1 | M00001451D:C10 | 39546 |
| 110 | Jan. 28, 1998 | 110 | RTA00000197R.h.01.1 | M00001470A:H01 | 13075 |
| 111 | Jan. 28, 1998 | 111 | RTA00000198AF.o.12.1 | M00003751D:B02 | 22038 |
| 112 | Jan. 28, 1998 | 112 | RTA00000177AF.m.8.1 | M00001354C:C10 | 8010 |
| 113 | Jan. 28, 1998 | 113 | RTA00000196AF.d.09.1 | M00001354B:B10 | 16934 |
| 114 | Jan. 28, 1998 | 114 | RTA00000200R.f.02.1 | M00004108A:A09 | 7138 |
| 115 | Jan. 28, 1998 | 115 | RTA00000179AR.o.20.3 | M00001409D:F11 | 2409 |
| 116 | Jan. 28, 1998 | 116 | RTA00000181AR.k.24.3 | M00001454B:C12 | 7005 |
| 117 | Jan. 28, 1998 | 117 | RTA00000199AF.j.18.1 | M00003889D:B09 | 5140 |
| 118 | Jan. 28, 1998 | 118 | RTA00000199F.b.24.2 | M00003794A:B03 | 0 |
| 119 | Jan. 28, 1998 | 119 | RTA00000181AR.k.24.2 | M00001454B:C12 | 7005 |
| 120 | Jan. 28, 1998 | 120 | RTA00000178AR.m.19.5 | M00001384D:H07 | 0 |
| 121 | Jan. 28, 1998 | 121 | RTA00000199AF.o.16.1 | M00003979A:F03 | 16721 |
| 122 | Jan. 28, 1998 | 122 | RTA00000197AF.l.15.1 | M00001517B:G08 | 4947 |
| 123 | Jan. 28, 1998 | 123 | RTA00000191AF.k.6.1 | M00004078B:A11 | 5451 |
| 124 | Jan. 28, 1998 | 124 | RTA00000199AR.m.06.1 | M00003933C:D06 | 19122 |
| 125 | Jan. 28, 1998 | 125 | RTA00000197AF.k.15.1 | M00001504D:D11 | 22750 |
| 126 | Jan. 28, 1998 | 126 | RTA00000201F.d.16.1 | M00004338B:A08 | 0 |
| 127 | Jan. 28, 1998 | 127 | RTA00000178AF.k.18.1 | M00001382A:F04 | 9755 |
| 128 | Jan. 28, 1998 | 128 | RTA00000196F.i.12.1 | M00001389D:G11 | 38800 |
| 129 | Jan. 28, 1998 | 129 | RTA00000134A.d.10.1 | M00001528A:F09 | 18957 |
| 130 | Jan. 28, 1998 | 130 | RTA00000196AF.h.23.1 | M00001386A:C02 | 13357 |
| 131 | Jan. 28, 1998 | 131 | RTA00000185AF.d.11.2 | M00001579D:C03 | 6539 |
| 132 | Jan. 28, 1998 | 132 | RTA00000178AF.f.20.3 | M00001372C:F07 | 39881 |
| 133 | Jan. 28, 1998 | 133 | RTA00000181AR.n.20.3 | M00001457B:E03 | 0 |
| 134 | Jan. 28, 1998 | 134 | RTA00000197F.e.11.1 | M00001454B:G03 | 2306 |
| 135 | Jan. 28, 1998 | 135 | RTA00000196AF.c.22.1 | M00001352D:C05 | 22548 |
| 136 | Jan. 28, 1998 | 136 | RTA00000197AF.c.10.1 | M00001448B:F06 | 10400 |
| 137 | Jan. 28, 1998 | 137 | RTA00000181AF.m.4.3 | M00001455A:E09 | 13238 |
| 138 | Jan. 28, 1998 | 138 | RTA00000182AF.a.3.3 | M00001462B:A10 | 0 |
| 139 | Jan. 28, 1998 | 139 | RTA00000191AF.d.01.2 | M00003996A:A06 | 7031 |
| 140 | Jan. 28, 1998 | 140 | RTA00000199F.a.2.1 | M00003772A:D07 | 12674 |
| 141 | Jan. 28, 1998 | 141 | RTA00000196F.c.6.1 | M00001350A:D06 | 23148 |
| 142 | Jan. 28, 1998 | 142 | RTA00000198AF.k.19.1 | M00001660B:C04 | 75879 |
| 143 | Jan. 28, 1998 | 143 | RTA00000199R.h.09.1 | M00003867C:H09 | 76020 |
| 144 | Jan. 28, 1998 | 144 | RTA00000198AF.o.18.1 | M00003755A:A09 | 13018 |
| 145 | Jan. 28, 1998 | 145 | RTA00000178AF.h.24.1 | M00001376B:C06 | 6745 |
| 146 | Jan. 28, 1998 | 146 | RTA00000185AF.a.19.2 | M00001571C:H06 | 5749 |
| 147 | Jan. 28, 1998 | 147 | RTA00000185AF.c.24.2 | M00001578B:E04 | 23001 |
| 148 | Jan. 28, 1998 | 148 | RTA00000199F.h.17.2 | M00003871A:A05 | 36254 |
| 149 | Jan. 28, 1998 | 149 | RTA00000181AR.h.06.3 | M00001450D:D04 | 87226 |
| 150 | Jan. 28, 1998 | 150 | RTA00000184F.k.09.1 | M00001557C:H07 | 7065 |
| 151 | Jan. 28, 1998 | 151 | RTA00000200R.l.17.1 | M00004217C:D03 | 12771 |
| 152 | Jan. 28, 1998 | 152 | RTA00000196AF.c.20.1 | M00001352C:H02 | 8934 |
| 153 | Jan. 28, 1998 | 153 | RTA00000200F.n.17.2 | M00004252C:E03 | 19064 |
| 154 | Jan. 28, 1998 | 154 | RTA00000196F.e.7.1 | M00001360D:E11 | 1039 |
| 155 | Jan. 28, 1998 | 155 | RTA00000197F.e.8.1 | M00001454A:C11 | 3135 |
| 156 | Jan. 28, 1998 | 156 | RTA00000199R.o.12.1 | M00003977A:E04 | 16128 |
| 157 | Jan. 28, 1998 | 157 | RTA00000188AF.n.01.1 | M00003801A:B10 | 36412 |
| 158 | Jan. 28, 1998 | 158 | RTA00000198AF.k.03.1 | M00001655A:F06 | 22765 |
| 159 | Jan. 28, 1998 | 159 | RTA00000182AF.l.12.1 | M00001487A:A05 | 1027 |
| 160 | Jan. 28, 1998 | 160 | RTA00000192AF.b.20.1 | M00004118D:E08 | 0 |
| 161 | Jan. 28, 1998 | 161 | RTA00000183AF.e.23.2 | M00001506D:A09 | 0 |
| 162 | Jan. 28, 1998 | 162 | RTA00000201F.e.15.1 | M00004444B:D11 | 9960 |
| 163 | Jan. 28, 1998 | 163 | RTA00000192AR.e.13.3 | M00004142A:B12 | 9457 |
| 164 | Jan. 28, 1998 | 164 | RTA00000193AR.i.14.4 | M00004307C:A06 | 9457 |
| 165 | Jan. 28, 1998 | 165 | RTA00000192AF.g.23.1 | M00004157C:A09 | 6455 |
| 166 | Jan. 28, 1998 | 166 | RTA00000198AF.f.21.1 | M00001614D:D09 | 22676 |
| 167 | Jan. 28, 1998 | 167 | RTA00000179AF.d.22.3 | M00001394C:C11 | 7955 |
| 168 | Jan. 28, 1998 | 168 | RTA00000177AR.k.23.1 | M00001352D:D02 | 35550 |
| 169 | Jan. 28, 1998 | 169 | RTA00000196AF.g.24.1 | M00001380C:F02 | 8685 |
| 170 | Jan. 28, 1998 | 170 | RTA00000197AF.d.23.1 | M00001453A:E11 | 16130 |
| 171 | Jan. 28, 1998 | 171 | RTA00000198R.c.07.1 | M00001575D:G05 | 19181 |
| 172 | Jan. 28, 1998 | 172 | RTA00000186AF.p.09.2 | M00001655C:E04 | 6879 |
| 173 | Jan. 28, 1998 | 173 | RTA00000200AR.b.07.1 | M00004039C:C01 | 17125 |
| 174 | Jan. 28, 1998 | 174 | RTA00000181AF.e.22.3 | M00001448D:F09 | 3442 |
| 175 | Jan. 28, 1998 | 175 | RTA00000200F.i.5.1 | M00004156B:A12 | 22892 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 176 | Jan. 28, 1998 | 176 | RTA00000183AF.h.19.1 | M00001528A:A01 | 5175 |
| 177 | Jan. 28, 1998 | 177 | RTA00000197AF.c.3.1 | M00001447C:C01 | 3145 |
| 178 | Jan. 28, 1998 | 178 | RTA00000200F.o.03.1 | M00004257C:H06 | 22807 |
| 179 | Jan. 28, 1998 | 179 | RTA00000179AF.f.20.3 | M00001397B:B09 | 16154 |
| 180 | Jan. 28, 1998 | 180 | RTA00000199AF.j.12.1 | M00003887A:A06 | 22461 |
| 181 | Jan. 28, 1998 | 181 | RTA00000198AF.d.2.1 | M00001585A:F07 | 0 |
| 182 | Jan. 28, 1998 | 182 | RTA00000196AF.h.16.1 | M00001384C:E03 | 39895 |
| 183 | Jan. 28, 1998 | 183 | RTA00000198AF.c.17.1 | M00001579C:E08 | 6923 |
| 184 | Jan. 28, 1998 | 184 | RTA00000197AF.f.7.1 | M00001457C:C11 | 19261 |
| 185 | Feb. 24, 1998 | 234 | RTA00000195AF.d.4.1 | M00003881D:D06 | 22766 |
| 185 | Jan. 28, 1998 | 185 | RTA00000195AF.d.4.1 | M00003881D:D06 | 22766 |
| 186 | Jan. 28, 1998 | 186 | RTA00000198R.p.09.1 | M00003761D:E02 | 10473 |
| 187 | Jan. 28, 1998 | 187 | RTA00000180AR.j.04.4 | M00001429C:G12 | 22300 |
| 188 | Jan. 28, 1998 | 188 | RTA00000188AF.o.05.1 | M00003806D:G05 | 4668 |
| 189 | Jan. 28, 1998 | 189 | RTA00000197AF.h.10.1 | M00001476B:F10 | 15554 |
| 190 | Jan. 28, 1998 | 190 | RTA00000134A.c.7.1 | M00001528A:A01 | 5175 |
| 191 | Jan. 28, 1998 | 191 | RTA00000187AF.p.23.1 | M00003748B:F02 | 39804 |
| 192 | Jan. 28, 1998 | 192 | RTA00000185AF.m.7.1 | M00001605C:D12 | 39804 |
| 193 | Jan. 28, 1998 | 193 | RTA00000199AF.n.3.1 | M00003946D:C11 | 0 |
| 194 | Jan. 28, 1998 | 194 | RTA00000200R.k.01.1 | M00004188C:A09 | 40049 |
| 195 | Jan. 28, 1998 | 195 | RTA00000198AF.c.10.1 | M00001577B:H02 | 77149 |
| 196 | Jan. 28, 1998 | 196 | RTA00000198F.e.10.1 | M00001599B:E09 | 9727 |
| 197 | Jan. 28, 1998 | 197 | RTA00000198F.l.12.1 | M00001669C:B01 | 8592 |
| 198 | Jan. 28, 1998 | 198 | RTA00000197AR.e.07.1 | M00001453D:G12 | 86969 |
| 199 | Jan. 28, 1998 | 199 | RTA00000199R.c.09.1 | M00003800A:C09 | 16824 |
| 200 | Jan. 28, 1998 | 200 | RTA00000182AF.f.2.1 | M00001469D:D02 | 4794 |
| 201 | Jan. 28, 1998 | 201 | RTA00000198AF.p.18.1 | M00003769B:D03 | 23081 |
| 202 | Jan. 28, 1998 | 202 | RTA00000200R.l.17.2 | M00004217C:D03 | 12771 |
| 203 | Jan. 28, 1998 | 203 | RTA00000201F.d.09.1 | M00004380B:A05 | 1827 |
| 204 | Jan. 28, 1998 | 204 | RTA00000180AR.o.5.2 | M00001437D:C04 | 7848 |
| 205 | Jan. 28, 1998 | 205 | RTA00000189AF.g.11.1 | M00003858D:F12 | 0 |
| 206 | Jan. 28, 1998 | 206 | RTA00000181AF.o.04.2 | M00001457C:C12 | 22205 |
| 207 | Jan. 28, 1998 | 207 | RTA00000199AF.l.19.1 | M00003924B:D04 | 22460 |
| 208 | Jan. 28, 1998 | 208 | RTA00000198AF.h.22.1 | M00001635C:A03 | 22366 |
| 209 | Jan. 28, 1998 | 209 | RTA00000182AF.c.5.1 | M00001464D:F06 | 6397 |
| 210 | Jan. 28, 1998 | 210 | RTA00000189AR.b.12.1 | M00003829B:G03 | 17233 |
| 211 | Jan. 28, 1998 | 211 | RTA00000199AF.m.15.1 | M00003939A:A02 | 10101 |
| 212 | Jan. 28, 1998 | 212 | RTA00000197AF.j.9.1 | M00001494B:C01 | 13236 |
| 213 | Jan. 28, 1998 | 213 | RTA00000200F.o.04.1 | M00004260D:C12 | 12514 |
| 214 | Jan. 28, 1998 | 214 | RTA00000200AF.f.22.1 | M00004121C:F06 | 16521 |
| 215 | Jan. 28, 1998 | 215 | RTA00000192AR.e.14.3 | M00004142A:D08 | 3300 |
| 216 | Jan. 28, 1998 | 216 | RTA00000188AF.g.9.1 | M00003774B:B08 | 4959 |
| 217 | Jan. 28, 1998 | 217 | RTA00000198AF.h.3.1 | M00001625D:C07 | 22562 |
| 218 | Jan. 28, 1998 | 218 | RTA00000188AF.o.18.1 | M00003811D:A12 | 13678 |
| 219 | Jan. 28, 1998 | 219 | RTA00000198AF.m.19.1 | M00001680D:D02 | 40041 |
| 220 | Jan. 28, 1998 | 220 | RTA00000200AF.h.01.2 | M00004141D:A09 | 0 |
| 221 | Jan. 28, 1998 | 221 | RTA00000189AF.i.17.1 | M00003868C:H10 | 16814 |
| 222 | Jan. 28, 1998 | 222 | RTA00000185AF.i.4.1 | M00001594A:B12 | 13942 |
| 223 | Jan. 28, 1998 | 223 | RTA00000197F.i.9.1 | M00001488D:C10 | 0 |
| 224 | Jan. 28, 1998 | 224 | RTA00000188AF.m.11.1 | M00003799A:D09 | 0 |
| 225 | Jan. 28, 1998 | 225 | RTA00000189AF.b.5.1 | M00003828A:E04 | 3784 |
| 226 | Jan. 28, 1998 | 226 | RTA00000191AR.o.09.4 | M00004096A:G02 | 0 |
| 227 | Jan. 28, 1998 | 227 | RTA00000201AF.d.02.2 | M00004375A:H01 | 2599 |
| 228 | Jan. 28, 1998 | 228 | RTA00000187AR.h.15.2 | M00001679A:A06 | 6660 |
| 229 | Jan. 28, 1998 | 229 | RTA00000198AF.g.3.1 | M00001615C:F03 | 0 |
| 230 | Jan. 28, 1998 | 230 | RTA00000185AR.b.18.1 | M00001575B:C09 | 12171 |
| 231 | Jan. 28, 1998 | 231 | RTA00000192AF.l.13.2 | M00004185C:C03 | 11443 |
| 232 | Jan. 28, 1998 | 232 | RTA00000186AF.j.03.2 | M00001638A:E07 | 0 |
| 233 | Jan. 28, 1998 | 233 | RTA00000197AF.l.8.1 | M00001511B:C06 | 39954 |
| 234 | Jan. 28, 1998 | 234 | RTA00000191AF.f.8.1 | M00004035A:A04 | 6541 |
| 235 | Jan. 28, 1998 | 235 | RTA00000201AF.a.02.1 | M00004295B:D02 | 35362 |
| 236 | Jan. 28, 1998 | 236 | RTA00000183AR.h.23.1 | M00001528A:F09 | 18957 |
| 237 | Jan. 28, 1998 | 237 | RTA00000197AF.k.10.1 | M00001500D:B11 | 0 |
| 238 | Jan. 28, 1998 | 238 | RTA00000187AR.k.12.1 | M00001679D:F02 | 78415 |
| 239 | Jan. 28, 1998 | 239 | RTA00000201R.d.02.1 | M00004375A:H01 | 2599 |
| 240 | Jan. 28, 1998 | 240 | RTA00000178AF.e.1.1 | M00001369A:H12 | 2664 |
| 241 | Jan. 28, 1998 | 241 | RTA00000200AF.l.17.1 | M00004217C:D03 | 12771 |
| 242 | Jan. 28, 1998 | 242 | RTA00000198AF.m.17.1 | M00001679D:F06 | 77992 |
| 243 | Jan. 28, 1998 | 243 | RTA00000181AF.m.15.3 | M00001455D:A11 | 12081 |
| 244 | Jan. 28, 1998 | 244 | RTA00000199F.f.12.2 | M00003844C:A08 | 8131 |
| 245 | Jan. 28, 1998 | 245 | RTA00000200AF.k.7.1 | M00004193C:G11 | 0 |
| 246 | Jan. 28, 1998 | 246 | RTA00000199AF.l.4.1 | M00003911D:B04 | 4410 |
| 247 | Jan. 28, 1998 | 247 | RTA00000198AF.k.08.1 | M00001656C:G08 | 17436 |
| 248 | Jan. 28, 1998 | 248 | RTA00000198R.c.14.1 | M00001578D:C04 | 39814 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 249 | Jan. 28, 1998 | 249 | RTA00000200R.o.03.2 | M00004257C:H06 | 22807 |
| 250 | Jan. 28, 1998 | 250 | RTA00000192AF.j.21.1 | M00004176D:B12 | 2289 |
| 251 | Jan. 28, 1998 | 251 | RTA00000192AF.n.13.1 | M00004197D:H01 | 8210 |
| 252 | Jan. 28, 1998 | 252 | RTA00000181AF.e.18.3 | M00001448D:C09 | 8 |
| 253 | Jan. 28, 1998 | 253 | RTA00000181AF.e.17.3 | M00001448D:C09 | 8 |
| 254 | Jan. 28, 1998 | 254 | RTA00000178AF.n.2.1 | M00001385C:H11 | 17083 |
| 255 | Jan. 28, 1998 | 255 | RTA00000199AF.j.17.1 | M00003889A:D10 | 5121 |
| 256 | Jan. 28, 1998 | 256 | RTA00000184AR.e.15.1 | M00001549C:E06 | 16347 |
| 257 | Jan. 28, 1998 | 257 | RTA00000198AF.e.20.1 | M00001604C:E09 | 9810 |
| 258 | Jan. 28, 1998 | 258 | RTA00000199F.h.12.2 | M00003868B:D12 | 16621 |
| 259 | Jan. 28, 1998 | 259 | RTA00000197AF.j.4.1 | M00001492D:A11 | 17209 |
| 260 | Jan. 28, 1998 | 260 | RTA00000198R.m.17.1 | M00001679D:F06 | 77992 |
| 261 | Jan. 28, 1998 | 261 | RTA00000192AF.a.24.1 | M00004114C:F11 | 13183 |
| 262 | Jan. 28, 1998 | 262 | RTA00000186AF.c.17.1 | M00001619D:G05 | 8551 |
| 263 | Jan. 28, 1998 | 263 | RTA00000190AF.n.6.1 | M00003965A:B11 | 0 |
| 264 | Jan. 28, 1998 | 264 | RTA00000179AF.k.3.3 | M00001401A:H07 | 0 |
| 265 | Jan. 28, 1998 | 265 | RTA00000177AF.e.14.1 | M00001343D:H07 | 23255 |
| 266 | Jan. 28, 1998 | 266 | RTA00000199F.f.21.2 | M00003847C:E09 | 13344 |
| 267 | Jan. 28, 1998 | 267 | RTA00000186AF.g.11.2 | M00001630B:H09 | 5214 |
| 268 | Jan. 28, 1998 | 268 | RTA00000186AF.h.01.2 | M00001632A:F12 | 0 |
| 269 | Jan. 28, 1998 | 269 | RTA00000183AF.k.13.1 | M00001534B:C12 | 0 |
| 270 | Jan. 28, 1998 | 270 | RTA00000178R.l.08.1 | M00001383A:C03 | 39648 |
| 271 | Jan. 28, 1998 | 271 | RTA00000201F.d.02.1 | M00004375A:H01 | 2599 |
| 272 | Jan. 28, 1998 | 272 | RTA00000199F.g.08.2 | M00003853D:G08 | 0 |
| 273 | Jan. 28, 1998 | 273 | RTA00000201F.c.08.1 | M00004353C:H07 | 0 |
| 274 | Jan. 28, 1998 | 274 | RTA00000191AF.o.17.1 | M00004102A:H02 | 5957 |
| 275 | Jan. 28, 1998 | 275 | RTA00000191AF.o.17.2 | M00004102A:H02 | 5957 |
| 276 | Jan. 28, 1998 | 276 | RTA00000198AF.j.15.1 | M00001653B:E09 | 4369 |
| 277 | Jan. 28, 1998 | 277 | RTA00000198AR.i.08.1 | M00001639A:F10 | 9807 |
| 278 | Jan. 28, 1998 | 278 | RTA00000198AF.p.16.1 | M00003768A:E02 | 71877 |
| 279 | Jan. 28, 1998 | 279 | RTA00000196AF.h.24.1 | M00001386A:D11 | 7308 |
| 280 | Jan. 28, 1998 | 280 | RTA00000193AF.b.18.1 | M00004233C:H09 | 7542 |
| 281 | Jan. 28, 1998 | 281 | RTA00000188AF.n.10.1 | M00003802D:B11 | 10283 |
| 282 | Jan. 28, 1998 | 282 | RTA00000193AF.c.15.1 | M00004248B:E08 | 3726 |
| 283 | Jan. 28, 1998 | 283 | RTA00000177AF.i.8.4 | M00001350A:H01 | 7187 |
| 284 | Jan. 28, 1998 | 284 | RTA00000199F.d.10.2 | M00003808C:B05 | 22049 |
| 285 | Jan. 28, 1998 | 285 | RTA00000181AR.j.14.3 | M00001453B:E10 | 5399 |
| 286 | Jan. 28, 1998 | 286 | RTA00000181AR.k.2.3 | M00001453C:A11 | 0 |
| 287 | Jan. 28, 1998 | 287 | RTA00000200AF.b.07.1 | M00004039C:C01 | 17125 |
| 288 | Jan. 28, 1998 | 288 | RTA00000181AR.i.06.3 | M00001452A:C07 | 19119 |
| 289 | Jan. 28, 1998 | 289 | RTA00000196F.k.07.1 | M00001399C:D09 | 22443 |
| 290 | Jan. 28, 1998 | 290 | RTA00000201F.f.10.1 | M00004498D:D05 | 5231 |
| 291 | Jan. 28, 1998 | 291 | RTA00000200AF.e.16.1 | M00004101C:G08 | 12068 |
| 292 | Jan. 28, 1998 | 292 | RTA00000199AF.m.18.1 | M00003939C:F04 | 0 |
| 293 | Jan. 28, 1998 | 293 | RTA00000197AF.e.13.1 | M00001454C:F02 | 662 |
| 294 | Jan. 28, 1998 | 294 | RTA00000198AF.k.23.1 | M00001661B:C08 | 8995 |
| 295 | Jan. 28, 1998 | 295 | RTA00000181AR.i.19.2 | M00001452C:B06 | 16970 |
| 296 | Jan. 28, 1998 | 296 | RTA00000196AF.f.20.1 | M00001371D:G01 | 22774 |
| 297 | Jan. 28, 1998 | 297 | RTA00000178AF.f.9.3 | M00001371C:E09 | 7172 |
| 298 | Jan. 28, 1998 | 298 | RTA00000197AR.e.11.1 | M00001454B:G03 | 2306 |
| 299 | Jan. 28, 1998 | 299 | RTA00000196AF.f.5.1 | M00001366D:G02 | 11937 |
| 300 | Feb. 24, 1998 | 464 | RTA00000195AF.c.12.1 | M00003818B:G12 | 37582 |
| 300 | Jan. 28, 1998 | 300 | RTA00000195AF.c.12.1 | M00003818B:G12 | 37582 |
| 301 | Jan. 28, 1998 | 301 | RTA00000181AR.i.19.3 | M00001452C:B06 | 16970 |
| 302 | Jan. 28, 1998 | 302 | RTA00000186AF.d.1.2 | M00001621C:C08 | 40044 |
| 303 | Jan. 28, 1998 | 303 | RTA00000186AR.e.03.3 | M00001623D:C10 | 22110 |
| 304 | Jan. 28, 1998 | 304 | RTA00000182AR.c.5.1 | M00001464D:F06 | 6397 |
| 305 | Jan. 28, 1998 | 305 | RTA00000200AF.b.15.1 | M00004040D:F01 | 10627 |
| 306 | Jan. 28, 1998 | 306 | RTA00000199AF.p.12.1 | M00003989A:H11 | 12578 |
| 307 | Jan. 28, 1998 | 307 | RTA00000200F.n.05.2 | M00004246C:A09 | 18989 |
| 308 | Jan. 28, 1998 | 308 | RTA00000178AF.j.20.1 | M00001380C:E05 | 15066 |
| 309 | Jan. 28, 1998 | 309 | RTA00000198AF.h.12.1 | M00001632C:A02 | 9503 |
| 310 | Jan. 28, 1998 | 310 | RTA00000188AF.m.08.1 | M00003798D:H08 | 22155 |
| 311 | Jan. 28, 1998 | 311 | RTA00000191AR.j.4.2 | M00004071D:A10 | 5198 |
| 312 | Jan. 28, 1998 | 312 | RTA00000193AF.h.2.1 | M00004290A:B03 | 3273 |
| 313 | Jan. 28, 1998 | 313 | RTA00000183AF.o.11.1 | M00001540D:D02 | 0 |
| 314 | Jan. 28, 1998 | 314 | RTA00000182AF.o.5.1 | M00001493B:D09 | 5007 |
| 315 | Jan. 28, 1998 | 315 | RTA00000199R.d.23.1 | M00003815D:H09 | 37477 |
| 316 | Jan. 28, 1998 | 316 | RTA00000198AF.h.24.1 | M00001636C:C01 | 8390 |
| 317 | Jan. 28, 1998 | 317 | RTA00000198AF.p.09.1 | M00003761D:E02 | 10473 |
| 318 | Jan. 28, 1998 | 318 | RTA00000200AF.g.17.1 | M00004138A:H09 | 0 |
| 319 | Jan. 28, 1998 | 319 | RTA00000200F.n.05.1 | M00004246C:A09 | 18989 |
| 320 | Jan. 28, 1998 | 320 | RTA00000196AF.m.13.1 | M00001415B:E09 | 16290 |
| 321 | Jan. 28, 1998 | 321 | RTA00000181AR.b.21.1 | M00001444C:D05 | 3266 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 322 | Jan. 28, 1998 | 322 | RTA00000184AR.b.21.1 | M00001546B:B02 | 39788 |
| 323 | Jan. 28, 1998 | 323 | RTA00000182AF.m.21.1 | M00001490C:C12 | 18699 |
| 324 | Jan. 28, 1998 | 324 | RTA00000184F.j.06.1 | M00001556B:G02 | 11294 |
| 325 | Jan. 28, 1998 | 325 | RTA00000182AF.d.18.4 | M00001467D:H05 | 37435 |
| 326 | Jan. 28, 1998 | 326 | RTA00000197AR.e.19.1 | M00001455D:A09 | 8047 |
| 327 | Jan. 28, 1998 | 327 | RTA00000182AF.i.1.3 | M00001479B:A01 | 7033 |
| 328 | Jan. 28, 1998 | 328 | RTA00000200AF.g.09.1 | M00004131B:H09 | 22785 |
| 329 | Jan. 28, 1998 | 329 | RTA00000186AF.b.9.1 | M00001616C:F07 | 0 |
| 330 | Jan. 28, 1998 | 330 | RTA00000177AR.m.17.4 | M00001355B:G10 | 14391 |
| 331 | Jan. 28, 1998 | 331 | RTA00000197AR.c.20.1 | M00001449D:A06 | 16282 |
| 332 | Jan. 28, 1998 | 332 | RTA00000193AR.n.04.3 | M00004375C:D01 | 9850 |
| 333 | Jan. 28, 1998 | 333 | RTA00000196F.k.15.1 | M00001400A:F06 | 8320 |
| 334 | Jan. 28, 1998 | 334 | RTA00000181AR.b.21.3 | M00001444C:D05 | 3266 |
| 335 | Jan. 28, 1998 | 335 | RTA00000182AF.e.3.2 | M00001468B:H06 | 0 |
| 336 | Jan. 28, 1998 | 336 | RTA00000186AF.f.24.1 | M00001629B:E06 | 0 |
| 337 | Jan. 28, 1998 | 337 | RTA00000177AR.m.17.3 | M00001355B:G10 | 14391 |
| 338 | Jan. 28, 1998 | 338 | RTA00000184AF.i.1.1 | M00001554B:C07 | 0 |
| 339 | Jan. 28, 1998 | 339 | RTA00000193AF.d.1.1 | M00004250D.D10 | 0 |
| 340 | Jan. 28, 1998 | 340 | RTA00000185AF.n.8.1 | M00001608B:A03 | 0 |
| 341 | Jan. 28, 1998 | 341 | RTA00000181AF.l.06.2 | M00001454C:C08 | 0 |
| 342 | Jan. 28, 1998 | 342 | RTA00000196AF.d.10.1 | M00001354C:B06 | 22256 |
| 343 | Jan. 28, 1998 | 343 | RTA00000201F.a.18.1 | M00004314B:G07 | 16837 |
| 344 | Jan. 28, 1998 | 344 | RTA00000198AF.o.02.1 | M00003748A:B07 | 68756 |
| 345 | Jan. 28, 1998 | 345 | RTA00000187AF.h.21.1 | M00001679A:F01 | 39171 |
| 346 | Jan. 28, 1998 | 346 | RTA00000197AR.k.22.1 | M00001505C:H01 | 11394 |
| 347 | Jan. 28, 1998 | 347 | RTA00000199F.b.03.2 | M00003779B:E12 | 38340 |
| 348 | Jan. 28, 1998 | 348 | RTA00000200F.n.07.2 | M00004247C:C12 | 8663 |
| 349 | Jan. 28, 1998 | 349 | RTA00000191AF.j.15.1 | M00004073B:B01 | 6308 |
| 350 | Jan. 28, 1998 | 350 | RTA00000193AR.c.7.2 | M00004241D:F11 | 9850 |
| 351 | Jan. 28, 1998 | 351 | RTA00000179AF.c.22.1 | M00001393B:B09 | 22515 |
| 352 | Jan. 28, 1998 | 352 | RTA00000197AF.p.3.1 | M00001550A:A03 | 7239 |
| 353 | Jan. 28, 1998 | 353 | RTA00000198F.a.9.1 | M00001557D:C08 | 0 |
| 354 | Jan. 28, 1998 | 354 | RTA00000198R.k.03.1 | M00001655A:F06 | 22765 |
| 355 | Jan. 28, 1998 | 355 | RTA00000184AR.b.24.1 | M00001546B:C05 | 5777 |
| 356 | Jan. 28, 1998 | 356 | RTA00000180AF.l.12.2 | M00001433B:H11 | 0 |
| 357 | Jan. 28, 1998 | 357 | RTA00000184AF.o.15.1 | M00001564D:C09 | 0 |
| 358 | Jan. 28, 1998 | 358 | RTA00000198AF.g.7.1 | M00001616C:C09 | 13386 |
| 359 | Jan. 28, 1998 | 359 | RTA00000196AF.b.17.1 | M00001348A:D04 | 12193 |
| 360 | Jan. 28, 1998 | 360 | RTA00000198F.i.5.1 | M00001638A:D10 | 39989 |
| 361 | Jan. 28, 1998 | 361 | RTA00000177AR.g.16.4 | M00001347A:B10 | 13576 |
| 362 | Jan. 28, 1998 | 362 | RTA00000197AR.c.24.1 | M00001450A:B12 | 82498 |
| 363 | Jan. 28, 1998 | 363 | RTA00000196AF.e.14.1 | M00001362C:A10 | 12850 |
| 364 | Jan. 28, 1998 | 364 | RTA00000187AF.g.13.1 | M00001676C:C11 | 2991 |
| 365 | Jan. 28, 1998 | 365 | RTA00000196F.l.20.2 | M00001410B:G05 | 22678 |
| 366 | Jan. 28, 1998 | 366 | RTA00000192AF.o.19.1 | M00004208D:H08 | 3549 |
| 367 | Jan. 28, 1998 | 367 | RTA00000196F.i.24.1 | M00001392C:D10 | 4233 |
| 368 | Jan. 28, 1998 | 368 | RTA00000198AF.k.18.1 | M00001660A:C12 | 17432 |
| 369 | Jan. 28, 1998 | 369 | RTA00000196F.m.3.1 | M00001413A:F02 | 10453 |
| 370 | Jan. 28, 1998 | 370 | RTA00000179AF.c.15.3 | M00001392D:H06 | 2995 |
| 371 | Jan. 28, 1998 | 371 | RTA00000197F.e.7.1 | M00001453D:G12 | 86969 |
| 372 | Jan. 28, 1998 | 372 | RTA00000186AF.d.23.1 | M00001623B:G07 | 22187 |
| 373 | Jan. 28, 1998 | 373 | RTA00000196F.e.12.1 | M00001361C:H11 | 10147 |
| 374 | Jan. 28, 1998 | 374 | RTA00000178AF.l.11.1 | M00001383A:G04 | 23286 |
| 375 | Jan. 28, 1998 | 375 | RTA00000177AF.m.18.1 | M00001355B:G11 | 0 |
| 376 | Jan. 28, 1998 | 376 | RTA00000177AF.m.18.3 | M00001355B:G11 | 0 |
| 377 | Jan. 28, 1998 | 377 | RTA00000178AF.m.19.1 | M00001384D:H07 | 0 |
| 378 | Jan. 28, 1998 | 378 | RTA00000181AF.k.24.3 | M00001454B:C12 | 7005 |
| 379 | Jan. 28, 1998 | 379 | RTA00000180AF.l.06.2 | M00001433A:G07 | 5625 |
| 380 | Jan. 28, 1998 | 380 | RTA00000182AF.k.24.1 | M00001485D:B10 | 5625 |
| 381 | Jan. 28, 1998 | 381 | RTA00000199AF.m.14.1 | M00003938A:B04 | 10580 |
| 382 | Jan. 28, 1998 | 382 | RTA00000200AF.j.6.1 | M00004176B:E08 | 22902 |
| 383 | Jan. 28, 1998 | 383 | RTA00000199F.f.20.2 | M00003847B:G03 | 0 |
| 384 | Jan. 28, 1998 | 384 | RTA00000196AF.h.17.1 | M00001384C:F12 | 39215 |
| 385 | Jan. 28, 1998 | 385 | RTA00000201F.c.24.1 | M00004374D:E10 | 35731 |
| 386 | Jan. 28, 1998 | 386 | RTA00000197AR.j.04.1 | M00001492D:A11 | 17209 |
| 387 | Feb. 24, 1998 | 632 | RTA00000191AF.j.14.1 | M00004073A:H12 | 1002 |
| 387 | Jan. 28, 1998 | 387 | RTA00000191AF.j.14.1 | M00004073A:H12 | 1002 |
| 388 | Jan. 28, 1998 | 388 | RTA00000185AF.n.17.1 | M00001609B:A11 | 5336 |
| 389 | Jan. 28, 1998 | 389 | RTA00000181AR.k.2.2 | M00001453C:A11 | 0 |
| 390 | Jan. 28, 1998 | 390 | RTA00000197AR.f.07.1 | M00001457C:C11 | 19261 |
| 391 | Jan. 28, 1998 | 391 | RTA00000179AF.e.20.3 | M00001396A:C03 | 4009 |
| 392 | Jan. 28, 1998 | 392 | RTA00000185AF.b.11.2 | M00001573C:D03 | 9024 |
| 393 | Jan. 28, 1998 | 393 | RTA00000188AF.b.14.1 | M00003754B:D02 | 0 |
| 394 | Jan. 28, 1998 | 394 | RTA00000198AF.p.22.1 | M00003771A:G10 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 395 | Jan. 28, 1998 | 395 | RTA00000196R.c.21.2 | M00001352C:H10 | 0 |
| 396 | Jan. 28, 1998 | 396 | RTA00000179AR.b.02.3 | M00001391B:G12 | 0 |
| 397 | Jan. 28, 1998 | 397 | RTA00000198AF.b.22.1 | M00001571B:E03 | 38956 |
| 398 | Jan. 28, 1998 | 398 | RTA00000177AR.l.13.3 | M00001353A:G12 | 8078 |
| 399 | Jan. 28, 1998 | 399 | RTA00000186AF.m.15.2 | M00001649C:B10 | 40122 |
| 400 | Jan. 28, 1998 | 400 | RTA00000186AR.e.07.3 | M00001623D:G03 | 4175 |
| 401 | Jan. 28, 1998 | 491 | RTA00000195F.e.04.1 | M00004465B:D04 | 6731 |
| 402 | Jan. 28, 1998 | 402 | RTA00000177AF.b.21.4 | M00001341A:F12 | 4443 |
| 403 | Jan. 28, 1998 | 403 | RTA00000184AF.f.13.1 | M00001550D:H02 | 3784 |
| 404 | Jan. 28, 1998 | 404 | RTA00000195AF.b.6.1 | M00001496C:G10 | 39490 |
| 405 | Jan. 28, 1998 | 405 | RTA00000197AF.b.24.1 | M00001446C:D09 | 23171 |
| 406 | Jan. 28, 1998 | 406 | RTA00000199F.f.09.2 | M00003842B:D09 | 22907 |
| 407 | Jan. 28, 1998 | 407 | RTA00000178AF.e.20.1 | M00001370D:E12 | 3135 |
| 408 | Jan. 28, 1998 | 408 | RTA00000183AR.l.15.1 | M00001535C:E01 | 39383 |
| 409 | Jan. 28, 1998 | 409 | RTA00000180AF.d.1.3 | M00001418D:B06 | 8526 |
| 410 | Jan. 28, 1998 | 410 | RTA00000201F.a.20.1 | M00004316A:G09 | 22639 |
| 411 | Jan. 28, 1998 | 411 | RTA00000179AF.j.13.3 | M00001400B:H06 | 0 |
| 412 | Feb. 24, 1998 | 678 | RTA00000195AF.c.24.1 | M00003860D:H07 | 0 |
| 412 | Jan. 28, 1998 | 412 | RTA00000195AF.c.24.1 | M00003860D:H07 | 0 |
| 413 | Jan. 28, 1998 | 413 | RTA00000200F.a.12.1 | M00004031D:B05 | 16751 |
| 414 | Jan. 28, 1998 | 414 | RTA00000185AR.b.15.1 | M00001573D:F04 | 39813 |
| 415 | Jan. 28, 1998 | 415 | RTA00000200AF.f.09.1 | M00004111C:E11 | 12863 |
| 416 | Jan. 28, 1998 | 416 | RTA00000199F.a.5.1 | M00003773B:G01 | 22134 |
| 417 | Jan. 28, 1998 | 417 | RTA00000200R.d.16.1 | M00004085A:B02 | 39875 |
| 418 | Jan. 28, 1998 | 418 | RTA00000187AR.k.01.1 | M00001679D:B05 | 78356 |
| 419 | Jan. 28, 1998 | 419 | RTA00000182AF.j.20.1 | M00001483B:D03 | 4769 |
| 420 | Jan. 28, 1998 | 420 | RTA00000181AF.c.11.1 | M00001445D:A06 | 4769 |
| 421 | Jan. 28, 1998 | 421 | RTA00000200AF.i.21.1 | M00004167D:A07 | 5316 |
| 422 | Jan. 28, 1998 | 422 | RTA00000189AF.b.12.1 | M00003829B:G03 | 17233 |
| 423 | Jan. 28, 1998 | 423 | RTA00000188AR.b.17.1 | M00003755A:B03 | 10662 |
| 424 | Jan. 28, 1998 | 424 | RTA00000187AR.j.24.1 | M00001679D:B05 | 78356 |
| 425 | Jan. 28, 1998 | 425 | RTA00000200AF.c.16.1 | M00004064D:A11 | 23433 |
| 426 | Jan. 28, 1998 | 426 | RTA00000199AF.o.19.1 | M00003980D:E09 | 36927 |
| 427 | Jan. 28, 1998 | 427 | RTA00000187AR.d.9.2 | M00001664D:G07 | 5483 |
| 428 | Jan. 28, 1998 | 428 | RTA00000185AF.b.15.2 | M00001573D:F04 | 39813 |
| 429 | Jan. 28, 1998 | 429 | RTA00000196F.i.19.1 | M00001390C:C11 | 39498 |
| 430 | Jan. 28, 1998 | 430 | RTA00000198R.k.23.1 | M00001661B:C08 | 8995 |
| 431 | Jan. 28, 1998 | 431 | RTA00000199AF.k.15.1 | M00003905C:G10 | 8275 |
| 432 | Jan. 28, 1998 | 432 | RTA00000198AF.o.05.1 | M00003750A:D01 | 26702 |
| 433 | Jan. 28, 1998 | 433 | RTA00000198R.j.18.1 | M00001653B:G07 | 22759 |
| 434 | Jan. 28, 1998 | 434 | RTA00000187AR.d.2.2 | M00001664C:H10 | 4892 |
| 435 | Jan. 28, 1998 | 435 | RTA00000182AR.c.22.1 | M00001467A:D08 | 16283 |
| 436 | Jan. 28, 1998 | 436 | RTA00000200AF.k.11.1 | M00004197C:F03 | 9796 |
| 437 | Jan. 28, 1998 | 437 | RTA00000198R.a.23.1 | M00001563B:D11 | 10700 |
| 438 | Jan. 28, 1998 | 438 | RTA00000180AR.g.03.4 | M00001425A:C11 | 9024 |
| 439 | Jan. 28, 1998 | 439 | RTA00000185AF.d.14.2 | M00001579D:G07 | 8071 |
| 440 | Jan. 28, 1998 | 440 | RTA00000177AR.f.13.4 | M00001345A:G11 | 104°0 |
| 441 | Jan. 28, 1998 | 441 | RTA00000185AF.e.6.1 | M00001583B:E10 | 0 |
| 442 | Jan. 28, 1998 | 442 | RTA00000191AF.l.9.1 | M00004081C:H06 | 0 |
| 443 | Jan. 28, 1998 | 443 | RTA00000197AR.i.17.1 | M00001490A:E11 | 3516 |
| 444 | Jan. 28, 1998 | 444 | RTA00000189AF.l.16.1 | M00003879A:G05 | 0 |
| 445 | Jan. 28, 1998 | 445 | RTA00000196AF.n.13.1 | M00001422C:F12 | 8396 |
| 446 | Jan. 28, 1998 | 446 | RTA00000182AF.a.23.3 | M00001463A:F06 | 9755 |
| 447 | Jan. 28, 1998 | 447 | RTA00000198AF.d.8.1 | M00001587A:H03 | 0 |
| 448 | Jan. 28, 1998 | 448 | RTA00000200AF.j.9.1 | M00004177C:A01 | 8608 |
| 449 | Jan. 28, 1998 | 449 | RTA00000181AF.m.22.3 | M00001455D:F09 | 9283 |
| 450 | Jan. 28, 1998 | 450 | RTA00000181AF.m.21.3 | M00001455D:F09 | 9283 |
| 451 | Jan. 28, 1998 | 451 | RTA00000200AF.b.20.1 | M00004043A:D02 | 40403 |
| 452 | Jan. 28, 1998 | 452 | RTA00000199F.d.19.2 | M00003813D:H12 | 6707 |
| 453 | Jan. 28, 1998 | 453 | RTA00000199AF.i.20.1 | M00003881A:D09 | 9544 |
| 454 | Jan. 28, 1998 | 454 | RTA00000200R.d.04.1 | M00004078A:A06 | 5506 |
| 455 | Jan. 28, 1998 | 455 | RTA00000198AF.d.12.1 | M00001589A:C01 | 21142 |
| 456 | Jan. 28, 1998 | 456 | RTA00000200AF.b.12.1 | M00004040B:F10 | 22053 |
| 457 | Jan. 28, 1998 | 457 | RTA00000191AR.l.7.2 | M00004081C:D12 | 14391 |
| 458 | Jan. 28, 1998 | 458 | RTA00000199R.d.16.1 | M00003812C:A05 | 24191 |
| 459 | Jan. 28, 1998 | 459 | RTA00000179AF.c.22.3 | M00001393B:B09 | 22515 |
| 460 | Jan. 28, 1998 | 460 | RTA00000179AF.c.15.1 | M00001392D:H06 | 2995 |
| 461 | Jan. 28, 1998 | 461 | RTA00000190AF.e.13.1 | M00003908A:H09 | 38961 |
| 462 | Jan. 28, 1998 | 462 | RTA00000196AF.n.17.1 | M00001423D:A09 | 12477 |
| 463 | Jan. 28, 1998 | 463 | RTA00000177AR.k.23.4 | M00001352D:D02 | 35550 |
| 464 | Jan. 28, 1998 | 464 | RTA00000199AF.i.14.1 | M00003917A:D02 | 22865 |
| 465 | Jan. 28, 1998 | 465 | RTA00000187AF.k.20.1 | M00001680B:C01 | 3648 |
| 466 | Jan. 28, 1998 | 466 | RTA00000177AF.p.20.1 | M00001361A:A05 | 4141 |
| 467 | Jan. 28, 1998 | 467 | RTA00000195AF.b.19.1 | M00001589A:D12 | 77678 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 468 | Jan. 28, 1998 | 468 | RTA00000198AF.a.18.1 | M00001561C:E11 | 0 |
| 469 | Jan. 28, 1998 | 469 | RTA00000190AF.n.2.1 | M00003963A:E03 | 5650 |
| 470 | Jan. 28, 1998 | 470 | RTA00000198AF.f.16.1 | M00001614A:E06 | 0 |
| 471 | Jan. 28, 1998 | 471 | RTA00000188AF.e.2.1 | M00003763B:H01 | 0 |
| 472 | Jan. 28, 1998 | 472 | RTA00000192AF.p.17.1 | M00004214C:H05 | 11451 |
| 473 | Jan. 28, 1998 | 473 | RTA00000196F.i.3.1 | M00001387A:E10 | 0 |
| 474 | Jan. 28, 1998 | 474 | RTA00000192AR.d.1.3 | M00004130D:H01 | 14507 |
| 475 | Jan. 28, 1998 | 475 | RTA00000187AR.m.3.3 | M00001682C:B12 | 17055 |
| 476 | Jan. 28, 1998 | 476 | RTA00000200R.g.15.1 | M00004135B:G01 | 22898 |
| 477 | Jan. 28, 1998 | 477 | RTA00000180AR.e.22.2 | M00001423A:G05 | 7714 |
| 478 | Jan. 28, 1998 | 478 | RTA00000192AR.o.24.2 | M00004210B:B05 | 7191 |
| 479 | Jan. 28, 1998 | 479 | RTA00000197R.l.22.1 | M00001528A:C11 | 6962 |
| 480 | Jan. 28, 1998 | 480 | RTA00000181AF.o.08.2 | M00001457C:H12 | 849 |
| 481 | Jan. 28, 1998 | 481 | RTA00000179AR.l.22.2 | M00001405B:E09 | 4314 |
| 482 | Jan. 28, 1998 | 482 | RTA00000187AF.j.7.1 | M00001679C:F01 | 78091 |
| 483 | Jan. 28, 1998 | 483 | RTA00000192AF.h.19.1 | M00004162C:A07 | 4642 |
| 484 | Jan. 28, 1998 | 484 | RTA00000199F.g.20.2 | M00003860D:A01 | 15767 |
| 485 | Jan. 28, 1998 | 485 | RTA00000196AF.c.14.1 | M00001352B:F04 | 23105 |
| 486 | Jan. 28, 1998 | 486 | RTA00000190AR.p.22.2 | M00003979A:E11 | 16368 |
| 487 | Jan. 28, 1998 | 487 | RTA00000198F.i.8.1 | M00001639A:F10 | 9807 |
| 488 | Jan. 28, 1998 | 488 | RTA00000179AR.l.22.4 | M00001405B:E09 | 4314 |
| 489 | Jan. 28, 1998 | 489 | RTA00000186AF.h.22.1 | M00001634B:C10 | 16485 |
| 490 | Jan. 28, 1998 | 490 | RTA00000198AF.n.05.1 | M00001687A:G01 | 24157 |
| 491 | Jan. 28, 1998 | 491 | RTA00000196F.k.11.1 | M00001399C:H12 | 3 |
| 492 | Jan. 28, 1998 | 492 | RTA00000198AF.b.8.1 | M00001567C:H12 | 22636 |
| 493 | Jan. 28, 1998 | 493 | RTA00000177AF.m.17.1 | M00001355B:G10 | 14391 |
| 494 | Jan. 28, 1998 | 494 | RTA00000200AF.k.1.1 | M00004188C:A09 | 40049 |
| 495 | Jan. 28, 1998 | 495 | RTA00000185AF.j.21.1 | M00001597A:E12 | 0 |
| 496 | Jan. 28, 1998 | 496 | RTA00000190AF.p.3.1 | M00003975B:F03 | 2378 |
| 497 | Jan. 28, 1998 | 497 | RTA00000198AF.o.09.1 | M00003751B:A05 | 4310 |
| 498 | Jan. 28, 1998 | 498 | RTA00000190AF.h.12.1 | M00003917C:D03 | 12977 |
| 499 | Jan. 28, 1998 | 499 | RTA00000199F.b.22.2 | M00003791C:E09 | 17018 |
| 500 | Jan. 28, 1998 | 500 | RTA00000179AR.m.07.5 | M00001405D:D11 | 0 |
| 501 | Jan. 28, 1998 | 501 | RTA00000200R.k.11.1 | M00004197C:F03 | 9796 |
| 502 | Jan. 28, 1998 | 502 | RTA00000197AF.o.23.1 | M00001549A:A09 | 12682 |
| 503 | Jan. 28, 1998 | 503 | RTA00000197AF.k.9.1 | M00001500C:C08 | 3138 |
| 504 | Jan. 28, 1998 | 504 | RTA00000198AF.g.2.1 | M00001615C:D02 | 16640 |
| 505 | Jan. 28, 1998 | 505 | RTA00000188AF.n.03.1 | M00003801B:B10 | 9443 |
| 506 | Jan. 28, 1998 | 506 | RTA00000198R.o.09.1 | M00003751B:A05 | 4310 |
| 507 | Jan. 28, 1998 | 507 | RTA00000198AF.c.5.1 | M00001573D:F10 | 53802 |
| 508 | Jan. 28, 1998 | 508 | RTA00000187AF.i.14.2 | M00001679B:H07 | 19406 |
| 509 | Jan. 28, 1998 | 509 | RTA00000183AF.p.17.1 | M00001543A:H12 | 5158 |
| 510 | Jan. 28, 1998 | 510 | RTA00000178AF.n.23.1 | M00001387B:E02 | 3298 |
| 511 | Jan. 28, 1998 | 511 | RTA00000196AF.g.10.1 | M00001376B:A02 | 12498 |
| 512 | Jan. 28, 1998 | 512 | RTA00000191AF.c.3.1 | M00003987D:D06 | 3549 |
| 513 | Jan. 28, 1998 | 513 | RTA00000197AF.h.14.1 | M00001477B:F04 | 7045 |
| 514 | Jan. 28, 1998 | 514 | RTA00000196AF.n.02.1 | M00001417D:A04 | 39260 |
| 515 | Jan. 28, 1998 | 515 | RTA00000196AF.f.18.1 | M00001370D:A12 | 14506 |
| 516 | Jan. 28, 1998 | 516 | RTA00000200AF.e.23.1 | M00004107B:A06 | 14686 |
| 517 | Jan. 28, 1998 | 517 | RTA00000184AF.e.14.1 | M00001549C:D02 | 16347 |
| 518 | Jan. 28, 1998 | 518 | RTA00000199AF.n.22.1 | M00003971A:A06 | 23064 |
| 519 | Jan. 28, 1998 | 519 | RTA00000183AF.a.24.2 | M00001499B:A11 | 10539 |
| 520 | Jan. 28, 1998 | 520 | RTA00000195AF.c.8.1 | M00001678B:H01 | 0 |
| 520 | Feb. 24, 1998 | 958 | RTA00000195AF.c.8.1 | M00001678B:H01 | 0 |
| 521 | Jan. 28, 1998 | 521 | RTA00000197AF.p.12.1 | M00001552B:G05 | 0 |
| 522 | Jan. 28, 1998 | 522 | RTA00000178AR.h.17.2 | M00001376A:C05 | 23824 |
| 523 | Jan. 28, 1998 | 523 | RTA00000198AF.d.4.1 | M00001586D:E02 | 22435 |
| 524 | Jan. 28, 1998 | 524 | RTA00000191AF.j.24.1 | M00004076B:G03 | 0 |
| 525 | Jan. 28, 1998 | 525 | RTA00000198AF.c.7.1 | M00001575D:G05 | 19181 |
| 526 | Jan. 28, 1998 | 526 | RTA00000185AF.e.20.1 | M00001585A:D06 | 5865 |
| 527 | Jan. 28, 1998 | 527 | RTA00000198R.m.23.1 | M00001684B:G03 | 38469 |
| 528 | Jan. 28, 1998 | 528 | RTA00000200F.n.09.2 | M00004249D:B08 | 12391 |
| 529 | Jan. 28, 1998 | 529 | RTA00000178AF.b.13.1 | M00001364A:E11 | 3114 |
| 530 | Jan. 28, 1998 | 530 | RTA00000185AF.d.24.2 | M00001582D:F05 | 0 |
| 531 | Jan. 28, 1998 | 531 | RTA00000195F.a.3.1 | M00001368A:A03 | 27179 |
| 532 | Jan. 28, 1998 | 532 | RTA00000177AF.o.4.1 | M00001358C:C06 | 0 |
| 533 | Jan. 28, 1998 | 533 | RTA00000177AR.m.13.4 | M00001355A:C12 | 4175 |
| 534 | Jan. 28, 1998 | 534 | RTA00000201AF.e.01.1 | M00004405D:C04 | 11397 |
| 535 | Jan. 28, 1998 | 535 | RTA00000196AF.n.19.1 | M00001423D:D12 | 6881 |
| 536 | Jan. 28, 1998 | 536 | RTA00000193AR.a.2.3 | M00004216D:D03 | 0 |
| 537 | Jan. 28, 1998 | 537 | RTA00000188AF.g.14.1 | M00003774C:D02 | 0 |
| 538 | Jan. 28, 1998 | 538 | RTA00000177AR.m.13.3 | M00001355A:C12 | 4175 |
| 539 | Jan. 28, 1998 | 539 | RTA00000197AR.b.13.1 | M00001445B:E04 | 9560 |
| 540 | Jan. 28, 1998 | 540 | RTA00000179AF.b.10.3 | M00001391D:D10 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 541 | Jan. 28, 1998 | 541 | RTA00000197AR.b.16.1 | M00001445C:A08 | 0 |
| 542 | Jan. 28, 1998 | 542 | RTA00000198R.p.12.1 | M00003763D:E10 | 8878 |
| 543 | Jan. 28, 1998 | 543 | RTA00000200AF.l.19.1 | M00004167A:H03 | 14722 |
| 544 | Jan. 28, 1998 | 544 | RTA00000196F.j.13.1 | M00001396D:B03 | 23170 |
| 545 | Jan. 28, 1998 | 545 | RTA00000196F.a.2.1 | M00001338B:E02 | 3575 |
| 546 | Jan. 28, 1998 | 546 | RTA00000197F.i.6.1 | M00001487C:D06 | 12149 |
| 547 | Jan. 28, 1998 | 547 | RTA00000196AF.g.8.1 | M00001375B:G12 | 39665 |
| 548 | Jan. 28, 1998 | 548 | RTA00000179AF.f.23.3 | M00001397B:G03 | 35258 |
| 549 | Jan. 28, 1998 | 549 | RTA00000198AF.c.16.1 | M00001579C:B11 | 26801 |
| 550 | Jan. 28, 1998 | 550 | RTA00000183AF.g.14.1 | M00001513D:A03 | 0 |
| 551 | Jan. 28, 1998 | 551 | RTA00000200AR.c.24.1 | M00004076D:D04 | 15972 |
| 552 | Jan. 28, 1998 | 552 | RTA00000193AF.b.24.1 | M00004237D:D08 | 35 |
| 553 | Jan. 28, 1998 | 553 | RTA00000201F.b.22.1 | M00004344B:H04 | 35728 |
| 554 | Jan. 28, 1998 | 554 | RTA00000186AR.e.07.4 | M00001623D:G03 | 4175 |
| 555 | Jan. 28, 1998 | 555 | RTA00000198AF.j.08.1 | M00001651B:A11 | 10983 |
| 556 | Jan. 28, 1998 | 556 | RTA00000199F.f.17.2 | M00003845D:B04 | 22905 |
| 557 | Jan. 28, 1998 | 557 | RTA00000198AF.d.9.1 | M00001587D:A10 | 8841 |
| 558 | Jan. 28, 1998 | 558 | RTA00000186AR.h.14.1 | M00001632D:H07 | 0 |
| 559 | Jan. 28, 1998 | 559 | RTA00000197AF.p.20.1 | M00001554B:B07 | 22795 |
| 560 | Jan. 28, 1998 | 560 | RTA00000184AF.i.23.3 | M00001556A:F11 | 1577 |
| 561 | Jan. 28, 1998 | 561 | RTA00000185AR.d.10.1 | M00001579C:H10 | 0 |
| 562 | Jan. 28, 1998 | 562 | RTA00000196F.j.12.1 | M00001396A:H03 | 19294 |
| 563 | Jan. 28, 1998 | 563 | RTA00000192AR.o.16.2 | M00004208B:F05 | 9061 |
| 564 | Jan. 28, 1998 | 564 | RTA00000200AF.g.18.1 | M00004138B:B11 | 1600 |
| 565 | Jan. 28, 1998 | 565 | RTA00000191AF.c.10.1 | M00003989B:F11 | 40422 |
| 566 | Jan. 28, 1998 | 566 | RTA00000195F.a.4.1 | M00001372C:G12 | 20470 |
| 567 | Jan. 28, 1998 | 567 | RTA00000177AR.m.13.1 | M00001355A:C12 | 4175 |
| 568 | Jan. 28, 1998 | 568 | RTA00000196AF.p.01.2 | M00001430A:A02 | 87143 |
| 569 | Jan. 28, 1998 | 569 | RTA00000196AF.l.23.1 | M00001412A:E04 | 12052 |
| 570 | Jan. 28, 1998 | 570 | RTA00000183AF.a.19.2 | M00001499A:A05 | 3788 |
| 571 | Jan. 28, 1998 | 571 | RTA00000198AF.b.14.1 | M00001569C:B06 | 801 |
| 572 | Jan. 28, 1998 | 572 | RTA00000181AF.l.16.2 | M00001454D:E05 | 13532 |
| 573 | Jan. 28, 1998 | 573 | RTA00000196AF.b.7.1 | M00001344A:G07 | 7774 |
| 574 | Jan. 28, 1998 | 574 | RTA00000192AF.f.3.1 | M00004146C:C11 | 5257 |
| 575 | Jan. 28, 1998 | 575 | RTA00000186AF.l.12.2 | M00001645A:C12 | 19267 |
| 576 | Jan. 28, 1998 | 576 | RTA00000196AF.c.7.1 | M00001350B:G11 | 0 |
| 577 | Jan. 28, 1998 | 577 | RTA00000190AF.a.24.2 | M00003901B:A05 | 0 |
| 578 | Jan. 28, 1998 | 578 | RTA00000180AF.g.17.1 | M00001426A:A09 | 16653 |
| 579 | Jan. 28, 1998 | 579 | RTA00000200F.i.7.1 | M00004157D:B03 | 22322 |
| 580 | Jan. 28, 1998 | 580 | RTA00000197F.a.12.1 | M00001438B:B09 | 7895 |
| 581 | Jan. 28, 1998 | 581 | RTA00000191AF.p.3.2 | M00004104B:F11 | 17 |
| 582 | Jan. 28, 1998 | 582 | RTA00000178AR.d.12.4 | M00001368A:D07 | 2476 |
| 583 | Jan. 28, 1998 | 583 | RTA00000190AR.h.12.2 | M00003917C:D03 | 12977 |
| 584 | Jan. 28, 1998 | 584 | RTA00000190AR.c.03.1 | M00003904C:A08 | 0 |
| 585 | Jan. 28, 1998 | 585 | RTA00000198AF.n.18.1 | M00001771A:A07 | 16715 |
| 586 | Jan. 28, 1998 | 586 | RTA00000199R.o.11.1 | M00003976C:A10 | 23172 |
| 587 | Jan. 28, 1998 | 587 | RTA00000199F.a.3.1 | M00003772D:E10 | 16617 |
| 588 | Jan. 28, 1998 | 588 | RTA00000191AF.b.4.1 | M00003983C:F03 | 14936 |
| 589 | Jan. 28, 1998 | 589 | RTA00000192AF.l.1.1 | M00004183C:D07 | 16392 |
| 590 | Jan. 28, 1998 | 590 | RTA00000190AF.d.2.1 | M00003906B:F12 | 2444 |
| 591 | Jan. 28, 1998 | 591 | RTA00000197AF.h.1.1 | M00001470A:H01 | 13075 |
| 592 | Jan. 28, 1998 | 592 | RTA00000186AF.e.18.1 | M00001624C:A06 | 0 |
| 593 | Jan. 28, 1998 | 593 | RTA00000196R.c.14.2 | M00001352B:F04 | 23105 |
| 594 | Jan. 28, 1998 | 594 | RTA00000181AR.e.04.3 | M00001448A:G09 | 11825 |
| 595 | Jan. 28, 1998 | 595 | RTA00000195R.a.06.1 | M00001394A:E04 | 35265 |
| 595 | Feb. 24, 1998 | 1065 | RTA00000195R.a.06.1 | M00001394A:E04 | 35265 |
| 596 | Jan. 28, 1998 | 596 | RTA00000184AF.d.9.1 | M00001548A:B11 | 6515 |
| 597 | Jan. 28, 1998 | 597 | RTA00000198F.a.4.1 | M00001557A:F01 | 9635 |
| 598 | Jan. 28, 1998 | 598 | RTA00000197F.e.10.1 | M00001454B:D08 | 13154 |
| 599 | Jan. 28, 1998 | 599 | RTA00000179AF.o.5.1 | M00001408D:D04 | 6172 |
| 600 | Jan. 28, 1998 | 600 | RTA00000177AF.g.4.1 | M00001346B:B07 | 4119 |
| 601 | Jan. 28, 1998 | 601 | RTA00000184AF.i.10.2 | M00001555A:B01 | 3744 |
| 602 | Jan. 28, 1998 | 602 | RTA00000195AF.b.21.1 | M00001595B:A09 | 39055 |
| 602 | Feb. 24, 1998 | 317 | RTA00000195AF.b.21.1 | M00001595B:A09 | 39055 |
| 603 | Jan. 28, 1998 | 603 | RTA00000183AR.d.11.3 | M00001504D:G06 | 6420 |
| 604 | Jan. 28, 1998 | 604 | RTA00000200AF.j.15.1 | M00004185D:E04 | 5849 |
| 605 | Jan. 28, 1998 | 605 | RTA00000196F.e.9.1 | M00001361A:H07 | 23300 |
| 606 | Jan. 28, 1998 | 606 | RTA00000179AR.e.01.4 | M00001395A:C09 | 2493 |
| 607 | Jan. 28, 1998 | 607 | RTA00000200AF.k.12.1 | M00004198B:D02 | 7359 |
| 608 | Jan. 28, 1998 | 608 | RTA00000192AF.p.8.1 | M00004212B:C07 | 2379 |
| 609 | Jan. 28, 1998 | 609 | RTA00000196AF.n.05.1 | M00001418B:F07 | 12531 |
| 610 | Jan. 28, 1998 | 610 | RTA00000200AF.k.2.1 | M00004188D:G08 | 35924 |
| 611 | Jan. 28, 1998 | 611 | RTA00000196F.i.13.2 | M00001408A:H04 | 0 |
| 612 | Jan. 28, 1998 | 612 | RTA00000197AR.e.22.1 | M00001456A:H02 | 78758 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 613 | Jan. 28, 1998 | 613 | RTA00000177AF.k.18.4 | M00001352C:A05 | 53729 |
| 614 | Jan. 28, 1998 | 614 | RTA00000201F.f.03.1 | M00004493B:D09 | 22633 |
| 615 | Jan. 28, 1998 | 615 | RTA00000197R.p.20.1 | M00001554B:B07 | 22795 |
| 616 | Jan. 28, 1998 | 616 | RTA00000188AF.m.07.1 | M00003798D:E03 | 23183 |
| 617 | Jan. 28, 1998 | 617 | RTA00000179AF.d.13.3 | M00001394A:F01 | 6583 |
| 618 | Jan. 28, 1998 | 618 | RTA00000192AF.a.14.1 | M00004111D:A08 | 6874 |
| 619 | Jan. 28, 1998 | 619 | RTA00000201F.g.08.1 | M00004692A:E07 | 0 |
| 620 | Jan. 28, 1998 | 620 | RTA00000201R.g.08.1 | M00004692A:E07 | 0 |
| 621 | Jan. 28, 1998 | 621 | RTA00000201R.g.08.2 | M00004692A:E07 | 0 |
| 622 | Jan. 28, 1998 | 622 | RTA00000186AR.m.14.2 | M00001649B:G12 | 9800 |
| 623 | Jan. 28, 1998 | 623 | RTA00000198R.b.24.1 | M00001571D:B11 | 19047 |
| 624 | Jan. 28, 1998 | 624 | RTA00000200F.c.15.1 | M00004275A:B03 | 7866 |
| 625 | Jan. 28, 1998 | 625 | RTA00000196AF.c.19.1 | M00001352C:G09 | 5935 |
| 626 | Jan. 28, 1998 | 626 | RTA00000185AR.d.11.1 | M00001579D:C03 | 6539 |
| 627 | Jan. 28, 1998 | 627 | RTA00000199F.h.15.2 | M00003870A:C05 | 22269 |
| 628 | Jan. 28, 1998 | 628 | RTA00000198AF.g.16.1 | M00001621D:D03 | 6602 |
| 629 | Jan. 28, 1998 | 629 | RTA00000199R.m.23.1 | M00003945A:E09 | 40166 |
| 630 | Jan. 28, 1998 | 630 | RTA00000183AR.g.03.2 | M00001512D:G09 | 3956 |
| 631 | Jan. 28, 1998 | 631 | RTA00000200AF.h.19.2 | M00004151D:E03 | 0 |
| 632 | Jan. 28, 1998 | 632 | RTA00000183AR.g.03.1 | M00001512D:G09 | 3956 |
| 633 | Jan. 28, 1998 | 633 | RTA00000197F.i.8.1 | M00001488A:E01 | 6292 |
| 634 | Jan. 28, 1998 | 634 | RTA00000192AF.j.6.1 | M00004172C:D08 | 11494 |
| 635 | Jan. 28, 1998 | 635 | RTA00000181AF.p.7.3 | M00001460A:E01 | 38773 |
| 636 | Jan. 28, 1998 | 636 | RTA00000196F.k.20.1 | M00001402B:F12 | 6324 |
| 637 | Jan. 28, 1998 | 637 | RTA00000200AF.g.15.1 | M00004135B:G01 | 22898 |
| 638 | Jan. 28, 1998 | 638 | RTA00000193AF.l.05.2 | M00004348A:A02 | 2815 |
| 639 | Jan. 28, 1998 | 639 | RTAC0000199AF.j.1.1 | M00003881C:G09 | 6006 |
| 640 | Jan. 28, 1998 | 640 | RTA00000190AF.f.5.1 | M00003909A:H04 | 5015 |
| 641 | Jan. 28, 1998 | 641 | RTA00000198F.a.10.1 | M00001558A:E11 | 6695 |
| 642 | Jan. 28, 1998 | 642 | RTA00000189AF.i.14.1 | M00003868B:G11 | 0 |
| 643 | Jan. 28, 1998 | 643 | RTA00000184AF.c.9.1 | M00001546C:G10 | 16245 |
| 644 | Jan. 28, 1998 | 644 | RTA00000197F.i.12.1 | M00001489B:A06 | 3605 |
| 645 | Jan. 28, 1998 | 645 | RTA00000177AF.k.9.1 | M00001352A:E02 | 16245 |
| 646 | Jan. 28, 1998 | 646 | RTA00000186AF.d.24.1 | M00001623C:H07 | 3114 |
| 647 | Jan. 28, 1998 | 647 | RTA00000197F.m.11.1 | M00001530B:D10 | 16488 |
| 648 | Jan. 28, 1998 | 648 | RTA00000199F.i.9.1 | M00003878C:E04 | 7 |
| 649 | Jan. 28, 1998 | 649 | RTA00000190AR.l.19.2 | M00003946A:H10 | 88204 |
| 650 | Jan. 28, 1998 | 650 | RTA00000183AR.n.17.1 | M00001539B:H06 | 9800 |
| 651 | Jan. 28, 1998 | 651 | RTA00000189AR.d.22.2 | M00003844C:B11 | 6539 |
| 652 | Jan. 28, 1998 | 652 | RTA00000178AR.m.21.4 | M00001385A:F12 | 7861 |
| 653 | Jan. 28, 1998 | 653 | RTA00000178AR.m.21.5 | M00001385A:F12 | 7861 |
| 654 | Jan. 28, 1998 | 654 | RTA00000186AF.j.21.2 | M00001639D:B07 | 22506 |
| 655 | Jan. 28, 1998 | 655 | RTA00000186AF.g.8.2 | M00001630B:A11 | 8065 |
| 656 | Jan. 28, 1998 | 656 | RTA00000178AR.h.22.3 | M00001376B:A08 | 19230 |
| 657 | Jan. 28, 1998 | 657 | RTA00000178AR.h.22.2 | M00001376B:A08 | 19230 |
| 658 | Jan. 28, 1998 | 658 | RTA00000193AF.a.1.1 | M00004216D:C03 | 16501 |
| 659 | Jan. 28, 1998 | 659 | RTA00000185AR.k.23.2 | M00001601A:E09 | 0 |
| 660 | Jan. 28, 1998 | 660 | RTA00000197AF.p.16.1 | M00001552D:G08 | 6013 |
| 661 | Jan. 28, 1998 | 661 | RTA00000198R.b.04.1 | M00001565A:H09 | 0 |
| 662 | Jan. 28, 1998 | 662 | RTA00000201R.a.15.1 | M000043128:H07 | 57347 |
| 663 | Jan. 28, 1998 | 663 | RTA00000199F.g.21.2 | M00003861C:H02 | 34826 |
| 664 | Jan. 28, 1998 | 664 | RTA00000195R.a.23.1 | M00001449C:H12 | 86432 |
| 665 | Jan. 28, 1998 | 665 | RTA00000197AF.l.22.1 | M00001528A:C11 | 6962 |
| 666 | Jan. 28, 1998 | 666 | RTA00000198F.i.10.1 | M00001640B:F03 | 12792 |
| 667 | Jan. 28, 1998 | 667 | RTA00000197AF.d.16.1 | M00001452A:E07 | 23505 |
| 668 | Jan. 28, 1998 | 668 | RTA00000178AF.i.17.1 | M00001377C:E12 | 0 |
| 669 | Jan. 28, 1998 | 669 | RTA00000192AF.c.2.1 | M00004121B:G01 | 0 |
| 670 | Jan. 28, 1998 | 670 | RTA00000186AF.p.17.3 | M00001656B:A07 | 38383 |
| 671 | Jan. 28, 1998 | 671 | RTA00000185AR.d.08.1 | M00001579C:E09 | 6562 |
| 672 | Jan. 28, 1998 | 672 | RTA00000196AF.h.09.1 | M00001382B:F12 | 8015 |
| 673 | Jan. 28, 1998 | 673 | RTA00000199F.m.3.1 | M00003931B:A11 | 0 |
| 674 | Jan. 28, 1998 | 674 | RTA00000197AR.e.24.1 | M00001456B:F10 | 39250 |
| 675 | Jan. 28, 1998 | 675 | RTA00000179AR.b.21.3 | M00001392C:D05 | 4366 |
| 676 | Jan. 28, 1998 | 676 | RTA00000197AR.m.14.1 | M00001531B:E09 | 14879 |
| 677 | Jan. 28, 1998 | 677 | RTA00000197AF.i.19.1 | M00001490B:H11 | 39554 |
| 678 | Jan. 28, 1998 | 678 | RTA00000190AF.j.3.1 | M00003922A:D02 | 2705 |
| 679 | Jan. 28, 1998 | 679 | RTA00000197AF.d.11.1 | M00001451C:E01 | 27260 |
| 680 | Jan. 28, 1998 | 680 | RTA00006177AF.f.10.1 | M00001345A:E01 | 6420 |
| 681 | Jan. 28, 1998 | 681 | RTA00000180AF.l.04.2 | M00001432D:F05 | 11159 |
| 682 | Jan. 28, 1998 | 682 | RTA00000125A.j.16.1 | M00001544A:E06 | 0 |
| 683 | Jan. 28, 1998 | 683 | RTA00000187AR.j.01.1 | M00001679C:D01 | 79028 |
| 684 | Jan. 28, 1998 | 684 | RTA00000200AR.b.11.1 | M00004040A:G12 | 12043 |
| 685 | Jan. 28, 1998 | 685 | RTA00000200F.i.9.1 | M00004159C:F09 | 36756 |
| 686 | Jan. 28, 1998 | 686 | RTA00000201F.f.07.1 | M00004497A:H03 | 51116 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 687 | Jan. 28, 1998 | 687 | RTA00000197AF.g.4.1 | M00001464B:B03 | 8821 |
| 688 | Jan. 28, 1998 | 688 | RTA00000193AF.g.3.1 | M00004050D:A06 | 5567 |
| 689 | Jan. 28, 1998 | 689 | RTA00000197AF.o.4.1 | M00001542B:C06 | 4121 |
| 690 | Jan. 28, 1998 | 690 | RTA00000198R.l.21.1 | M00601673A:A04 | 19194 |
| 691 | Jan. 28, 1998 | 691 | RTA00000195F.a.10.1 | M00001401C:H03 | 6803 |
| 692 | Jan. 28, 1998 | 692 | RTA00000199F.e.4.1 | M00003820B:C05 | 0 |
| 693 | Jan. 28, 1998 | 693 | RTA00000198F.m.12.1 | M00001679C:D05 | 4 |
| 694 | Jan. 28, 1998 | 694 | RTA00000201R.c.19.1 | M00004370A:G05 | 22357 |
| 695 | Jan. 28, 1998 | 695 | RTA00000197F.m.5.1 | M00001528C:H04 | 10872 |
| 696 | Jan. 28, 1998 | 696 | RTA00000180AR.d.16.3 | M00001419D:C10 | 11393 |
| 697 | Jan. 28, 1998 | 697 | RTA00000193AF.e.21.1 | M00004271B:B06 | 0 |
| 698 | Jan. 28, 1998 | 698 | RTA00000179AF.g.1.3 | M00001397C:A10 | 7588 |
| 699 | Jan. 28, 1998 | 699 | RTA00000178AF.a.12.1 | M00001362B:H06 | 0 |
| 700 | Jan. 28, 1998 | 700 | RTA00000183AF.i.18.2 | M00001529D:H02 | 40129 |
| 701 | Jan. 28, 1998 | 701 | RTA00000199AF.o.10.1 | M00003974C:E04 | 0 |
| 702 | Jan. 28, 1998 | 702 | RTA00000177AR.b.8.5 | M00001340B:A06 | 17062 |
| 703 | Jan. 28, 1998 | 703 | RTA00000198F.l.09.1 | M00001664B:D06 | 3611 |
| 704 | Jan. 28, 1998 | 704 | RTA00000190AF.o.12.1 | M00003972D:C09 | 3438 |
| 705 | Jan. 28, 1998 | 705 | RTA00000196F.i.5.1 | M00001387B:A06 | 0 |
| 706 | Jan. 28, 1998 | 706 | RTA00000177AF.i.6.4 | M00001350A:B08 | 0 |
| 707 | Jan. 28, 1998 | 707 | RTA00000179AF.p.15.1 | M00001411D:F05 | 5622 |
| 708 | Jan. 28, 1998 | 708 | RTA00000201F.f.06.1 | M00004496C:H03 | 23771 |
| 709 | Jan. 28, 1998 | 709 | RTA00000192AF.d.18.1 | M00004135D:G02 | 0 |
| 710 | Jan. 28, 1998 | 710 | RTA00000196AF.l.3.1 | M00001405B:D07 | 20864 |
| 711 | Jan. 28, 1998 | 711 | RTA00000198F.i.2.1 | M00001637B:E07 | 8076 |
| 712 | Jan. 28, 1998 | 712 | RTA00000201F.b.21.1 | M00004341B:G03 | 9071 |
| 713 | Jan. 28, 1998 | 713 | RTA00000198AF.g.21.1 | M00001624A:F09 | 6273 |
| 714 | Jan. 28, 1998 | 714 | RTA00000199R.g.07.1 | M00003853D:D03 | 0 |
| 715 | Jan. 28, 1998 | 715 | RTA00000197AR.k.11.1 | M00001500D:E10 | 53758 |
| 716 | Jan. 28, 1998 | 716 | RTA00000200F.p.05.1 | M00004285C:A08 | 3984 |
| 717 | Jan. 28, 1998 | 717 | RTA00000200F.o.10.2 | M00004269B:C08 | 36432 |
| 718 | Jan. 28, 1998 | 718 | RTA00000196F.l.14.2 | M00001408B:G06 | 23144 |
| 719 | Jan. 28, 1998 | 719 | RTA00000183AF.b.12.1 | M00001500A:B02 | 0 |
| 720 | Jan. 28, 1998 | 720 | RTA00000197AF.f.14.1 | M00001459B:C09 | 3732 |
| 721 | Jan. 28, 1998 | 721 | RTA00000180AF.c.4.1 | M00001417B:C04 | 5415 |
| 722 | Jan. 28, 1998 | 722 | RTA00000199R.j.24.1 | M00003895C:A10 | 0 |
| 723 | Jan. 28, 1998 | 723 | RTA00000183AF.p.24.1 | M00001543C:F01 | 3116 |
| 724 | Jan. 28, 1998 | 724 | RTA00000177AR.f.15.4 | M00001345B:E10 | 9062 |
| 725 | Jan. 28, 1998 | 725 | RTA00000197AF.b.1.1 | M00001441D:E04 | 12134 |
| 726 | Jan. 28, 1998 | 726 | RTA00000200R.f.10.1 | M00004111D:B07 | 4 |
| 727 | Jan. 28, 1998 | 727 | RTA00000184AF.n.12.2 | M00001561D:C11 | 3727 |
| 728 | Jan. 28, 1998 | 728 | RTA00000177AR.f.17.4 | M00001345C:B01 | 8594 |
| 729 | Jan. 28, 1998 | 729 | RTA00000184AF.a.19.1 | M00001544C:C06 | 2628 |
| 730 | Jan. 28, 1998 | 730 | RTA00000192AF.o.11.1 | M00004205D:F06 | 0 |
| 731 | Jan. 28, 1998 | 731 | RTA00000184F.k.02.1 | M00001557B:H10 | 5192 |
| 732 | Jan. 28, 1998 | 732 | RTA00000186AF.p.01.2 | M00001654D:G11 | 40440 |
| 733 | Jan. 28, 1998 | 733 | RTA00000200AF.d.20.1 | M00004087A:G08 | 26600 |
| 734 | Jan. 28, 1998 | 734 | RTA00000200AF.d.21.1 | M00004087C:D03 | 0 |
| 735 | Jan. 28, 1998 | 735 | RTA00000192AF.b.11.1 | M00004117A:G01 | 40014 |
| 736 | Jan. 28, 1998 | 736 | RTA00000196AF.o.13.1 | M00001428B:A09 | 0 |
| 737 | Jan. 28, 1998 | 737 | RTA00000189AR.m.9.1 | M00003880B:C08 | 2917 |
| 738 | Jan. 28, 1998 | 738 | RTA00000183AF.o.8.1 | M00001540C:B10 | 8927 |
| 739 | Jan. 28, 1998 | 739 | RTA00000181AF.p.12.3 | M00001460C:H02 | 22204 |
| 740 | Jan. 28, 1998 | 740 | RTA00000198AF.d.15.1 | M00001590C:H08 | 5997 |
| 741 | Jan. 28, 1998 | 741 | RTA00000196AF.n.22.1 | M00001424B:H04 | 9572 |
| 742 | Jan. 28, 1998 | 742 | RTA00000177AF.m.1.1 | M00001353D:D10 | 14929 |
| 743 | Jan. 28, 1998 | 743 | RTA00000178AF.k.9.1 | M00001381B:F06 | 16342 |
| 744 | Jan. 28, 1998 | 744 | RTA00000196F.m.4.1 | M00001413A:F03 | 7958 |
| 745 | Jan. 28, 1998 | 745 | RTA00000183AF.m.11.1 | M00001536D:G02 | 8927 |
| 746 | Jan. 28, 1998 | 746 | RTA00000178AF.i.01.2 | M00001376B:F03 | 4 |
| 747 | Jan. 28, 1998 | 747 | RTA00000190AF.c.6.1 | M00003904D:D10 | 4780 |
| 748 | Jan. 28, 1998 | 748 | RTA00000198AF.b.24.1 | M00001571D:B11 | 19047 |
| 749 | Jan. 28, 1998 | 749 | RTA00000178AR.i.13.4 | M00001377B:H01 | 0 |
| 750 | Jan. 28, 1998 | 750 | RTA00000198AF.a.19.1 | M00001561D:C05 | 0 |
| 751 | Jan. 28, 1998 | 751 | RTA00000179AF.c.4.3 | M00001392D:B11 | 0 |
| 752 | Jan. 28, 1998 | 752 | RTA00000192AF.o.7.1 | M00004204D:C03 | 5275 |
| 753 | Jan. 28, 1998 | 753 | RTA00000192AF.o.17.1 | M00004208D:B10 | 5275 |
| 754 | Jan. 28, 1998 | 754 | RTA00000187AF.l.11.1 | M00001681A:F03 | 4482 |
| 755 | Jan. 28, 1998 | 755 | RTA00000199F.c.21.2 | M00003803C:D09 | 5070 |
| 756 | Feb. 24, 1998 | 1 | RTA00000404F.a.02.1 | M00001589B:E12 | 9738 |
| 757 | Feb. 24, 1998 | 2 | RTA00000406F.d.16.1 | M00003875C:G02 | 15040 |
| 758 | Feb. 24, 1998 | 3 | RTA00000420F.d.18.1 | M00004105C:B05 | 63074 |
| 759 | Feb. 24, 1998 | 4 | RTA00000339F.i.20.1 | M00001438D:C06 | 4356 |
| 760 | Feb. 24, 1998 | 5 | RTA00000408F.o.12.2 | M00001572A:A10 | 78578 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 761 | Feb. 24, 1998 | 6 | RTA00000119A.j.15.1 | M00001460A:E11 | 79623 |
| 762 | Feb. 24, 1998 | 7 | RTA00000413F.d.12.1 | M00004088C:A12 | 66467 |
| 763 | Feb. 24, 1998 | 8 | RTA00000423F.i.12.1 | M00003914D:E03 | 9118 |
| 764 | Feb. 24, 1998 | 9 | RTA00000406F.n.02.1 | M00003918C:H10 | 15051 |
| 765 | Feb. 24, 1998 | 10 | RTA00000350R.c.12.1 | M00001550D:A04 | 9728 |
| 766 | Feb. 24, 1998 | 11 | RTA00000411F.k.05.1 | M00003850D:B05 | 64777 |
| 767 | Feb. 24, 1998 | 12 | RTA00000339F.b.17.1 | M00001366D:E12 | 10020 |
| 768 | Feb. 24, 1998 | 13 | RTA00000406F.f.18.1 | M00003879B:G02 | 38587 |
| 769 | Feb. 24, 1998 | 14 | RTA00000419F.b.09.1 | M00001694C:F12 | 78128 |
| 770 | Feb. 24, 1998 | 15 | RTA00000419F.c.19.1 | M00003820A:A08 | 64346 |
| 771 | Feb. 24, 1998 | 16 | RTA00000399F.a.02.1 | M00001366D:C12 | 0 |
| 772 | Feb. 24, 1998 | 17 | RTA00000411F.m.15.1 | M00003868D:B09 | 78014 |
| 773 | Feb. 24, 1998 | 18 | RTA00000420F.g.12.1 | M00004895B:G04 | 0 |
| 774 | Feb. 24, 1998 | 19 | RTA00000123A.k.23.1 | M00001533A:G05 | 80313 |
| 775 | Feb. 24, 1998 | 20 | RTA00000404F.m.04.2 | M00001641A:A11 | 22720 |
| 776 | Feb. 24, 1998 | 21 | RTA00000411F.g.08.1 | M00003822D:D04 | 45815 |
| 777 | Feb. 24, 1998 | 22 | RTA00000130A.m.15.1 | M00001622A:H12 | 81630 |
| 778 | Feb. 24, 1998 | 23 | RTA00000411F.k.20.1 | M00003854B:A07 | 64973 |
| 779 | Feb. 24, 1998 | 24 | RTA00000423F.l.09.1 | M00004118A:H08 | 9752 |
| 780 | Feb. 24, 1998 | 25 | RTA00000418F.k.05.1 | M00001637A:A06 | 73021 |
| 781 | Feb. 24, 1998 | 26 | RTA00000423F.h.18.1 | M00003876C:D02 | 37972 |
| 782 | Feb. 24, 1998 | 27 | RTA00000420F.n.19.2 | M00005259B:C01 | 0 |
| 783 | Feb. 24, 1998 | 28 | RTA00000422F.p.06.2 | M00001661A:B11 | 39282 |
| 784 | Feb. 24, 1998 | 29 | RTA00000404F.n.16.2 | M00001649C:D05 | 39095 |
| 785 | Feb. 24, 1998 | 30 | RTA00000411F.m.24.1 | M00003870B:B08 | 77568 |
| 786 | Feb. 24, 1998 | 31 | RTA00000134A.j.10.1 | M00001534A:G06 | 81383 |
| 787 | Feb. 24, 1998 | 32 | RTA00000409F.j.02.1 | M00001611B:E06 | 76417 |
| 788 | Feb. 24, 1998 | 33 | RTA00000403F.j.15.1 | M00001539B:G07 | 23840 |
| 789 | Feb. 24, 1998 | 34 | RTA00000411F.n.11.1 | M00003875A:B01 | 77276 |
| 790 | Feb. 24, 1998 | 35 | RTA00000339F.i.13.1 | M00001434A:B10 | 5970 |
| 791 | Feb. 24, 1998 | 36 | RTA00000414F.e.22.1 | M00005257D:A06 | 0 |
| 792 | Feb. 24, 1998 | 37 | RTA00000406F.o.15.1 | M00003988D:A08 | 37482 |
| 793 | Feb. 24, 1998 | 38 | RTA00000412F.g.04.2 | M00003971B:B07 | 64457 |
| 794 | Feb. 24, 1998 | 39 | RTA00000187AF.l.7.1 | M00001680D:F08 | 10539 |
| 795 | Feb. 24, 1998 | 40 | RTA00000352R.l.06.1 | M00004187D:H06 | 40343 |
| 796 | Feb. 24, 1998 | 41 | RTA00000419F.b.12.1 | M00003806B:C09 | 63148 |
| 797 | Feb. 24, 1998 | 42 | RTA00000423F.k.17.2 | M00004038A:F02 | 37512 |
| 798 | Feb. 24, 1998 | 43 | RTA00000420F.g.04.1 | M00004891B:B12 | 0 |
| 799 | Feb. 24, 1998 | 44 | RTA00000418F.k.14.1 | M00001639A:H06 | 76133 |
| 800 | Feb. 24, 1998 | 45 | RTA00000409F.l.12.1 | M00001615A:D06 | 26755 |
| 801 | Feb. 24, 1998 | 46 | RTA00000404F.c.20.1 | M00001594A:D08 | 39088 |
| 802 | Feb. 24, 1998 | 47 | RTA00000423F.g.09.1 | M00003904C:B06 | 38958 |
| 803 | Feb. 24, 1998 | 48 | RTA00000411F.b.24.1 | M00001677B:A12 | 30041 |
| 804 | Feb. 24, 1998 | 49 | RTA00000406F.d.12.1 | M00003875C:A01 | 38575 |
| 805 | Feb. 24, 1998 | 50 | RTA00000411F.f.02.1 | M00003813A:D08 | 63386 |
| 806 | Feb. 24, 1998 | 51 | RTA00000129A.n.21.1 | M00001604A:C11 | 79381 |
| 807 | Feb. 24, 1998 | 52 | RTA00000409F.m.12.1 | M00001618B:D09 | 73490 |
| 808 | Feb. 24, 1998 | 53 | RTA00000410F.c.04.1 | M00001633D:G09 | 74099 |
| 809 | Feb. 24, 1998 | 54 | RTA00000399F.o.01.1 | M00001595C:E01 | 3055 |
| 810 | Feb. 24, 1998 | 55 | RTA00000406F.m.09.1 | M00003914C:H05 | 26891 |
| 811 | Feb. 24, 1998 | 56 | RTA00000411F.b.06.1 | M00001676C:A04 | 77884 |
| 812 | Feb. 24, 1998 | 57 | RTA00000409F.l.21.1 | M00001615B:G07 | 73143 |
| 813 | Feb. 24, 1998 | 58 | RTA00000420F.m.18.1 | M00005254D:A10 | 0 |
| 814 | Feb. 24, 1998 | 59 | RTA00000346F.j.08.1 | M00003879B:A06 | 39951 |
| 815 | Feb. 24, 1998 | 60 | RTA00000413F.p.17.2 | M00005136D:G06 | 0 |
| 816 | Feb. 24, 1998 | 61 | RTA00000410F.n.07.1 | M00001662A:G01 | 78823 |
| 817 | Feb. 24, 1998 | 62 | RTA00000339F.n.10.1 | M00001453B:F08 | 13719 |
| 818 | Feb. 24, 1998 | 63 | RTA00000404F.l.20.2 | M00001639B:H05 | 38638 |
| 819 | Feb. 24, 1998 | 64 | RTA00000413F.d.18.1 | M00004090B:B04 | 65305 |
| 820 | Feb. 24, 1998 | 65 | RTA00000404F.p.04.2 | M00001652D:E05 | 39069 |
| 821 | Feb. 24, 1998 | 66 | RTA00000405F.g.19.2 | M00001673A:G08 | 37150 |
| 822 | Feb. 24, 1998 | 67 | RTA00000409F.a.22.1 | M00001583B:F02 | 75200 |
| 823 | Feb. 24, 1998 | 68 | RTA00000339F.n.03.1 | M00001449B:B03 | 0 |
| 824 | Feb. 24, 1998 | 69 | RTA00000405F.o.18.1 | M00003839A:D07 | 11016 |
| 825 | Feb. 24, 1998 | 70 | RTA00000409F.m.13.1 | M00001618B:E05 | 0 |
| 826 | Feb. 24, 1998 | 71 | RTA00000120A.d.24.1 | M00001464A:E10 | 5085 |
| 827 | Feb. 24, 1998 | 72 | RTA00000347F.a.08.1 | M00001592C:G04 | 3135 |
| 828 | Feb. 24, 1998 | 73 | RTA00000413F.p.15.2 | M00005136D:D06 | 0 |
| 829 | Feb. 24, 1998 | 74 | RTA00000408F.e.22.1 | M00001476B:F08 | 26930 |
| 830 | Feb. 24, 1998 | 75 | RTA00000350R.i.22.1 | M00001608B:A03 | 0 |
| 831 | Feb. 24, 1998 | 76 | RTA00000413F.d.16.1 | M00004088C:F01 | 63331 |
| 832 | Feb. 24, 1998 | 77 | RTA00000420F.j.22.1 | M00005173B:F01 | 0 |
| 833 | Jan. 28, 1998 | 59 | RTA00000195AF.b.13.1 | M00001560D:A03 | 12605 |
| 833 | Feb. 24, 1998 | 78 | RTA00000195AF.b.13.1 | M00001560D:A03 | 12605 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 834 | Feb. 24, 1998 | 79 | RTA00000419F.g.08.1 | M00003842C:D11 | 66700 |
| 835 | Feb. 24, 1998 | 80 | RTA00000122A.g.16.1 | M00001514A:B04 | 81366 |
| 836 | Feb. 24, 1998 | 81 | RTA00000419F.c.16.1 | M00003819D:B01 | 65254 |
| 837 | Feb. 24, 1998 | 82 | RTA00000411F.b.03.1 | M00001676B:E01 | 23634 |
| 838 | Feb. 24, 1998 | 83 | RTA00000405F.e.11.2 | M00001663D:C06 | 9331 |
| 839 | Feb. 24, 1998 | 84 | RTA00000352R.i.15.1 | M00004153B:B03 | 4363 |
| 840 | Feb. 24, 1998 | 85 | RTA00000339F.k.22.1 | M00001427C:D01 | 5556 |
| 841 | Feb. 24, 1998 | 86 | RTA00000346F.g.22.1 | M00003794D:G03 | 6371 |
| 842 | Feb. 24, 1998 | 87 | RTA00000403F.l.20.1 | M00001573A:A06 | 18267 |
| 843 | Feb. 24, 1998 | 88 | RTA00000420F.i.24.1 | M00005134B:E08 | 0 |
| 844 | Feb. 24, 1998 | 89 | RTA00000406F.c.08.1 | M00003870C:A10 | 22387 |
| 845 | Feb. 24, 1998 | 90 | RTA00000411F.a.02.1 | M00001675B:E02 | 78537 |
| 846 | Feb. 24, 1998 | 91 | RTA00000355R.e.15.1 | M00004316A:G09 | 22639 |
| 847 | Feb. 24, 1998 | 92 | RTA00000412F.l.04.1 | M00003989D:F12 | 66372 |
| 848 | Feb. 24, 1998 | 93 | RTA00000413F.p.24.1 | M00005139A:H03 | 0 |
| 849 | Feb. 24, 1998 | 94 | RTA00000406F.a.23.1 | M00003867B:D10 | 38712 |
| 850 | Feb. 24, 1998 | 95 | RTA00000423F.h.05.1 | M00003906A:F04 | 14837 |
| 851 | Feb. 24, 1998 | 96 | RTA00000120A.n.19.3 | M00001467A:H07 | 80004 |
| 852 | Feb. 24, 1998 | 97 | RTA00000403F.e.01.1 | M00001473A:C11 | 38965 |
| 853 | Feb. 24, 1998 | 98 | RTA00000411F.l.03.1 | M00003854D:A12 | 62702 |
| 854 | Feb. 24, 1998 | 99 | RTA00000420F.m.19.1 | M00005254D:B08 | 0 |
| 855 | Feb. 24, 1998 | 100 | RTA00000339F.o.23.1 | M00001473C:D09 | 7801 |
| 856 | Feb. 24, 1998 | 101 | RTA00000121A.m.2.1 | M00001507A:A11 | 81064 |
| 857 | Feb. 24, 1998 | 102 | RTA00000420F.g.06.1 | M00004891C:D04 | 0 |
| 858 | Feb. 24, 1998 | 103 | RTA00000418F.j.12.1 | M00001626C:G08 | 73316 |
| 859 | Feb. 24, 1998 | 104 | RTA00000421F.n.03.1 | M00001675C:A04 | 1638 |
| 860 | Feb. 24, 1998 | 105 | RTA00000346F.d.08.1 | M00001671A:A10 | 39955 |
| 861 | Feb. 24, 1998 | 106 | RTA00000339F.f.11.1 | M00001391C:H02 | 5832 |
| 862 | Feb. 24, 1998 | 107 | RTA00000125A.g.16.1 | M00001544A:C09 | 21497 |
| 863 | Feb. 24, 1998 | 108 | RTA00000418F.o.18.1 | M00001661B:F06 | 78676 |
| 864 | Feb. 24, 1998 | 109 | RTA00000422F.p.24.2 | M00001658A:G09 | 5823 |
| 865 | Feb. 24, 1998 | 110 | RTA00000408F.k.14.1 | M00001486B:E12 | 73856 |
| 866 | Feb. 24, 1998 | 111 | RTA00000128A.i.20.1 | M00001560A:F03 | 9900 |
| 867 | Feb. 24, 1998 | 112 | RTA00000422F.c.11.1 | M00003841D:A04 | 2643 |
| 868 | Feb. 24, 1998 | 113 | RTA00000401F.e.02.1 | M00003805B:C04 | 0 |
| 869 | Feb. 24, 1998 | 114 | RTA00000341F.m.21.1 | M00004051E:E01 | 0 |
| 870 | Feb. 24, 1998 | 115 | RTA00000418F.h.19.1 | M00001590B:C05 | 0 |
| 871 | Feb. 24, 1998 | 116 | RTA00000403F.o.15.1 | M00001582B:E12 | 39140 |
| 872 | Feb. 24, 1998 | 117 | RTA00000341F.m.13.1 | M00003987B:E12 | 26502 |
| 873 | Feb. 24, 1998 | 118 | RTA00000408F.h.03.1 | M00001479D:H03 | 78382 |
| 874 | Feb. 24, 1998 | 119 | RTA00000423F.k.05.1 | M00004036D:F02 | 37472 |
| 875 | Feb. 24, 1998 | 120 | RTA00000401F.m.02.1 | M00003907A:F01 | 1573 |
| 876 | Feb. 24, 1998 | 121 | RTA00000418F.p.19.1 | M00001677D:B01 | 78544 |
| 877 | Feb. 24, 1998 | 122 | RTA00000420F.f.06.1 | M00004115D:D08 | 64812 |
| 878 | Feb. 24, 1998 | 123 | RTA00000122A.j.18.1 | M00001516A:D05 | 81317 |
| 879 | Feb. 24, 1998 | 124 | RTA00000420F.d.05.1 | M00004092B:E05 | 64432 |
| 880 | Feb. 24, 1998 | 125 | RTA00000403F.m.18.1 | M00001576A:B09 | 39185 |
| 881 | Feb. 24, 1998 | 126 | RTA00000422F.j.20.1 | M00001653A:G07 | 22388 |
| 882 | Feb. 24, 1998 | 127 | RTA00000411F.j.05.1 | M00003841C:F06 | 40709 |
| 883 | Feb. 24, 1998 | 128 | RTA00000403F.a.04.1 | M00001448A:B12 | 23529 |
| 884 | Feb. 24, 1998 | 129 | RTA00000118A.d.24.1 | M00001416A:H02 | 81488 |
| 885 | Feb. 24, 1998 | 130 | RTA00000406F.f.12.1 | M00003879A:C11 | 21895 |
| 886 | Feb. 24, 1998 | 131 | RTA00000418F.g.22.1 | M00001585B:F01 | 74837 |
| 887 | Feb. 24, 1998 | 132 | RTA00000418F.m.05.1 | M00001650B:C10 | 73600 |
| 888 | Feb. 24, 1998 | 133 | RTA00000404F.l.20.1 | M00001639B:H05 | 38638 |
| 889 | Feb. 24, 1998 | 134 | RTA00000408F.i.08.2 | M00001482A:H05 | 75811 |
| 890 | Feb. 24, 1998 | 135 | RTA00000122A.d.5.1 | M00001513A:F05 | 81155 |
| 891 | Feb. 24, 1998 | 136 | RTA00000419F.l.12.1 | M00003901C:B01 | 75710 |
| 892 | Feb. 24, 1998 | 137 | RTA00000339R.a.06.1 | M00001346A:E04 | 58694 |
| 893 | Feb. 24, 1998 | 138 | RTA00000406F.f.03.1 | M00003878C:D08 | 38687 |
| 894 | Feb. 24, 1998 | 139 | RTA00000419F.b.19.1 | M00003809A:C01 | 65534 |
| 895 | Feb. 24, 1998 | 140 | RTA00000128A.j.6.2 | M00001560A:H10 | 5316 |
| 896 | Feb. 24, 1998 | 141 | RTA00000418F.k.19.1 | M00001639C:C02 | 74932 |
| 897 | Feb. 24, 1998 | 142 | RTA00000420F.j.19.1 | M00005140C:B10 | 0 |
| 898 | Feb. 24, 1998 | 143 | RTA00000420F.h.13.1 | M00004899D:G06 | 0 |
| 899 | Feb. 24, 1998 | 144 | RTA00000349R.f.15.1 | M00001472A:D08 | 75097 |
| 900 | Feb. 24, 1998 | 145 | RTA00000419F.g.12.1 | M00003842C:G03 | 66171 |
| 901 | Feb. 24, 1998 | 146 | RTA00000404F.n.11.2 | M00001649A:E11 | 38001 |
| 902 | Feb. 24, 1998 | 147 | RTA00000422F.c.02.1 | M00004118B:A03 | 2902 |
| 903 | Feb. 24, 1998 | 148 | RTA00000419F.n.04.1 | M00003975C:F07 | 13102 |
| 904 | Feb. 24, 1998 | 149 | RTA00000419F.o.24.1 | M00004031A:F07 | 65092 |
| 905 | Feb. 24, 1998 | 150 | RTA00000419F.k.19.1 | M00003877C:G12 | 75447 |
| 906 | Feb. 24, 1998 | 151 | RTA00000341F.c.21.1 | M00003789C:F06 | 7899 |
| 907 | Feb. 24, 1998 | 152 | RTA00000127A.i.20.1 | M00001555A:B12 | 81418 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 908 | Feb. 24, 1998 | 153 | RTA00000422F.g.22.1 | M00001585B:A06 | 22561 |
| 909 | Feb. 24, 1998 | 154 | RTA00000340F.b.21.1 | M00001533D:A08 | 8001 |
| 910 | Feb. 24, 1998 | 155 | RTA00000413F.h.13.1 | M00004107A:D01 | 65190 |
| 911 | Feb. 24, 1998 | 156 | RTA00000125A.k.1.1 | M00001545A:B12 | 0 |
| 912 | Feb. 24, 1998 | 157 | RTA00000339F.a.23.1 | M00001361B:C07 | 4022 |
| 913 | Feb. 24, 1998 | 158 | RTA00000348R.j.16.1 | M00001410A:D07 | 7005 |
| 914 | Feb. 24, 1998 | 159 | RTA00000348R.j.17.1 | M00001391D:C06 | 2641 |
| 915 | Feb. 24, 1998 | 160 | RTA00000414F.f.19.1 | M00005260B:E11 | 0 |
| 916 | Feb. 24, 1998 | 161 | RTA00000418F.n.22.1 | M00001659D:B05 | 79062 |
| 917 | Feb. 24, 1998 | 162 | RTA00000406F.l.08.1 | M00003908D:D12 | 39016 |
| 918 | Feb. 24, 1998 | 163 | RTA00000422F.l.23.1 | M00001616D:C11 | 4240 |
| 919 | Feb. 24, 1998 | 164 | RTA00000345F.k.06.1 | M00001475A:A12 | 0 |
| 920 | Feb. 24, 1998 | 165 | RTA00000409F.j.07.1 | M00001611C:H11 | 75190 |
| 921 | Feb. 24, 1998 | 166 | RTA00000418F.m.19.1 | M00001654D:A03 | 8890 |
| 922 | Feb. 24, 1998 | 167 | RTA00000399F.l.14.1 | M00001590B:G08 | 3354 |
| 923 | Feb. 24, 1998 | 168 | RTA00000411F.e.22.1 | M00003812B:D07 | 63638 |
| 924 | Feb. 24, 1998 | 169 | RTA00000347F.a.17.1 | M00001366D:C06 | 16723 |
| 925 | Feb. 24, 1998 | 170 | RTA00000422F.n.08.1 | M00001632B:E05 | 38655 |
| 926 | Feb. 24, 1998 | 171 | RTA00000404F.n.20.1 | M00001650A:C11 | 26865 |
| 927 | Feb. 24, 1998 | 172 | RTA00000420F.i.17.1 | M00005101C:B09 | 0 |
| 928 | Feb. 24, 1998 | 173 | RTA00000418F.d.13.1 | M00001570A:H01 | 74309 |
| 929 | Feb. 24, 1998 | 174 | RTA00000404F.b.02.1 | M00001591B:B12 | 38984 |
| 930 | Feb. 24, 1998 | 175 | RTA00000410F.d.09.1 | M00001635B:R01 | 76964 |
| 931 | Feb. 24, 1998 | 176 | RTA00000403F.b.10.1 | M00001455C:G07 | 73268 |
| 932 | Feb. 24, 1998 | 177 | RTA00000406F.i.12.1 | M00003903D:H11 | 39080 |
| 933 | Feb. 24, 1998 | 178 | RTA00000406F.h.08.1 | M00003901C:A08 | 6228 |
| 934 | Feb. 24, 1998 | 179 | RTA00000418F.i.19.1 | M00001596D:E03 | 79180 |
| 935 | Feb. 24, 1998 | 180 | RTA00000400F.j.19.1 | M00001653C:D10 | 4086 |
| 936 | Feb. 24, 1998 | 181 | RTA00000412F.h.21.1 | M00003974D:F02 | 64348 |
| 937 | Feb. 24, 1998 | 182 | RTA00000404F.g.14.1 | M00001614D:B08 | 8858 |
| 938 | Feb. 24, 1998 | 183 | RTA00000120A.g.18.1 | M00001465A:C12 | 81255 |
| 939 | Feb. 24, 1998 | 184 | RTA00000133A.j.13.1 | M00001507A:B02 | 16846 |
| 940 | Feb. 24, 1998 | 185 | RTA00000423F.j.05.1 | M00003903C:C05 | 37958 |
| 941 | Feb. 24, 1998 | 186 | RTA00000132A.k.6.1 | M00001464A:E07 | 81284 |
| 942 | Feb. 24, 1998 | 187 | RTA00000351R.g.11.1 | M00003779D:E08 | 3077 |
| 943 | Feb. 24, 1998 | 188 | RTA00000406F.p.04.1 | M00004030D:F11 | 37458 |
| 944 | Feb. 24, 1998 | 189 | RTA00000347F.a.13.1 | M00001402D:F02 | 22446 |
| 945 | Feb. 24, 1998 | 190 | RTA00000419F.p.23.1 | M00004039B:A05 | 64748 |
| 946 | Feb. 24, 1998 | 191 | RTA00000419F.d.17.1 | M00003828B:F09 | 64353 |
| 947 | Feb. 24, 1998 | 192 | RTA00000421F.k.15.1 | M00001613D:B03 | 2222 |
| 948 | Feb. 24, 1998 | 193 | RTA00000347F.b.10.1 | M00001546C:C07 | 8044 |
| 949 | Feb. 24, 1998 | 194 | RTA00000124A.k.5.1 | M00001538A:F12 | 80252 |
| 950 | Feb. 24, 1998 | 195 | RTA00000404F.h.22.1 | M00001619C:C07 | 18735 |
| 951 | Feb. 24, 1998 | 196 | RTA00000418F.k.10.1 | M00001639A:G07 | 74454 |
| 952 | Feb. 24, 1998 | 197 | RTA00000410F.o.05.1 | M00001669A:B02 | 75262 |
| 953 | Feb. 24, 1998 | 198 | RTA00000339R.l.14.1 | M00001452A:C07 | 19119 |
| 954 | Feb. 24, 1998 | 199 | RTA00000403F.m.13.2 | M00001575D:A10 | 39077 |
| 955 | Feb. 24, 1998 | 200 | RTA00000339F.c.02.1 | M00001381C:B08 | 12975 |
| 956 | Feb. 24, 1998 | 201 | RTA00000404F.l.09.1 | M00001638B:E12 | 39176 |
| 957 | Feb. 24, 1998 | 202 | RTA00000419F.g.22.1 | M00003845D:A09 | 64515 |
| 958 | Feb. 24, 1998 | 203 | RTA00000404F.g.21.1 | M00001615C:A11 | 37947 |
| 959 | Feb. 24, 1998 | 204 | RTA00000351R.k.19.1 | M00003841B:E03 | 936 |
| 960 | Feb. 24, 1998 | 205 | RTA00000138A.n.4.1 | M00001624A:G11 | 21920 |
| 961 | Feb. 24, 1998 | 206 | RTA00000410F.b.15.1 | M00001633C:F09 | 77100 |
| 962 | Feb. 24, 1998 | 207 | RTA00000414F.b.08.1 | M00005212C:H02 | 0 |
| 963 | Feb. 24, 1998 | 208 | RTA00000419F.j.23.1 | M00003871A:C11 | 74470 |
| 964 | Feb. 24, 1998 | 209 | RTA00000411F.j.02.1 | M00003841C:D07 | 65310 |
| 965 | Feb. 24, 1998 | 210 | RTA00000419F.p.24.1 | M00004039B:E12 | 63477 |
| 966 | Feb. 24, 1998 | 211 | RTA00000404F.a.19.1 | M00001590B:C07 | 38624 |
| 967 | Feb. 24, 1998 | 212 | RTA00000408F.k.06.1 | M00001485C:H10 | 78393 |
| 968 | Feb. 24, 1998 | 213 | RTA00000123A.f.3.1 | M00001531A:H07 | 44017 |
| 969 | Feb. 24, 1998 | 214 | RTA00000404F.h.19.1 | M00001619A:E05 | 8096 |
| 970 | Feb. 24, 1998 | 215 | RTA00000403F.j.18.1 | M00001539D:E10 | 5790 |
| 971 | Feb. 24, 1998 | 216 | RTA00000420F.i.18.1 | M00005101C:E09 | 0 |
| 972 | Feb. 24, 1998 | 217 | RTA00000399F.o.17.1 | M00001599D:A09 | 1106 |
| 973 | Feb. 24, 1998 | 218 | RTA00000346F.e.13.1 | M00001660B:D03 | 74653 |
| 974 | Feb. 24, 1998 | 219 | RTA00000419F.c.18.1 | M00003819D:B11 | 41394 |
| 975 | Feb. 24, 1998 | 220 | RTA00000413F.k.02.1 | M00004690A:G08 | 0 |
| 976 | Feb. 24, 1998 | 221 | RTA00000414F.f.13.1 | M00005259D:H08 | 0 |
| 977 | Feb. 24, 1998 | 222 | RTA00000405F.e.09.1 | M00001663C:F12 | 38978 |
| 978 | Feb. 24, 1998 | 223 | RTA00000404F.e.22.1 | M00001610A:H05 | 11344 |
| 979 | Feb. 24, 1998 | 224 | RTA00000341F.g.21.1 | M00003914C:F09 | 8823 |
| 980 | Feb. 24, 1998 | 225 | RTA00000414F.d.07.1 | M00005229D:H09 | 0 |
| 981 | Feb. 24, 1998 | 226 | RTA00000125A.k.10.1 | M00001545A:F02 | 81644 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 982 | Feb. 24, 1998 | 227 | RTA00000347F.c.06.1 | M00001444D:C01 | 18846 |
| 983 | Feb. 24, 1998 | 228 | RTA00000411F.k.19.1 | M00003852D:E08 | 64200 |
| 984 | Feb. 24, 1998 | 229 | RTA00000345F.i.09.1 | M00001450A:D08 | 27250 |
| 985 | Feb. 24, 1998 | 230 | RTA00000423F.k.01.1 | M00004034D:E09 | 40426 |
| 986 | Feb. 24, 1998 | 231 | RTA00000408F.d.06.1 | M00001458D:C11 | 78997 |
| 987 | Feb. 24, 1998 | 232 | RTA00000128A.b.20.1 | M00001558A:G09 | 79761 |
| 988 | Feb. 24, 1998 | 233 | RTA00000403F.i.08.1 | M00001485C:B10 | 6176 |
| 989 | Feb. 24, 1998 | 234 | RTA00000195AF.d.4.1 | M00003881D:D06 | 22766 |
| 989 | Jan. 28, 1998 | 185 | RTA00000195AF.d.4.1 | M00003881D:D06 | 22766 |
| 990 | Feb. 24, 1998 | 235 | RTA00000126A.o.23.1 | M00001551A:B10 | 6268 |
| 991 | Feb. 24, 1998 | 236 | RTA00000403F.h.12.1 | M00001483C:G09 | 15205 |
| 992 | Feb. 24, 1998 | 237 | RTA00000119A.j.22.1 | M00001460A:F07 | 80336 |
| 993 | Feb. 24, 1998 | 238 | RTA00000340F.j.12.1 | M00001624A:B06 | 3277 |
| 994 | Feb. 24, 1998 | 239 | RTA00000346F.j.02.1 | M00003832B:E01 | 5294 |
| 995 | Feb. 24, 1998 | 240 | RTA00000126A.n.7.2 | M00001551A:D06 | 79557 |
| 996 | Feb. 24, 1998 | 241 | RTA00000339F.d.13.1 | M00001395C:F11 | 0 |
| 997 | Feb. 24, 1998 | 242 | RTA00000404F.j.08.1 | M00001629B:B08 | 39066 |
| 998 | Feb. 24, 1998 | 243 | RTA00000410F.c.14.1 | M00001634A:H05 | 77809 |
| 999 | Feb. 24, 1998 | 244 | RTA00000120A.g.23.1 | M00001465A:E10 | 81189 |
| 1000 | Feb. 24, 1998 | 245 | RTA00000195AF.d.20.1 | M00004117A:D11 | 37574 |
| 1000 | Jan. 28, 1998 | 87 | RTA00000195AF.d.20.1 | M00004117A:D11 | 37574 |
| 1001 | Feb. 24, 1998 | 246 | RTA00000414F.c.14.1 | M00005218A:G05 | 0 |
| 1002 | Feb. 24, 1998 | 247 | RTA00000412F.j.17.1 | M00003982C:G04 | 64071 |
| 1003 | Feb. 24, 1998 | 248 | RTA00000404F.k.24.1 | M00001636A:C03 | 15256 |
| 1004 | Feb. 24, 1998 | 249 | RTA00000119A.j.10.1 | M00001460A:C10 | 79646 |
| 1005 | Feb. 24, 1998 | 250 | RTA00000410F.o.12.1 | M00001669A:G12 | 77376 |
| 1006 | Feb. 24, 1998 | 251 | RTA00000119A.i.9.1 | M00001457A:G03 | 0 |
| 1007 | Feb. 24, 1998 | 252 | RTA00000412F.g.24.1 | M00003973C:C03 | 28741 |
| 1008 | Feb. 24, 1998 | 253 | RTA00000400F.f.18.1 | M00001637A:E10 | 3764 |
| 1009 | Feb. 24, 1998 | 254 | RTA00000341F.i.15.1 | M00003986B:A08 | 5294 |
| 1010 | Feb. 24, 1998 | 255 | RTA00000419F.o.16.1 | M00003989C:G05 | 62867 |
| 1011 | Feb. 24, 1998 | 256 | RTA00000404F.m.03.2 | M00001640A:H02 | 11799 |
| 1012 | Feb. 24, 1998 | 257 | RTA00000411F.c.17.1 | M00001678D:G03 | 77664 |
| 1013 | Feb. 24, 1998 | 258 | RTA00000406F.k.15.1 | M00003907C:C04 | 38549 |
| 1014 | Feb. 24, 1998 | 259 | RTA00000406F.a.02.1 | M00003855C:F10 | 37744 |
| 1015 | Feb. 24, 1998 | 260 | RTA00000414F.e.08.1 | M00005236A:E04 | 0 |
| 1016 | Feb. 24, 1998 | 261 | RTA00000341F.b.06.1 | M00003794A:E12 | 17008 |
| 1017 | Feb. 24, 1998 | 262 | RTA00000409F.n.14.1 | M00001621B:G05 | 78190 |
| 1018 | Feb. 24, 1998 | 263 | RTA00000410F.p.17.1 | M00001674D:C10 | 47425 |
| 1019 | Feb. 24, 1998 | 264 | RTA00000345F.j.08.1 | M00001451B:A04 | 16731 |
| 1020 | Feb. 24, 1998 | 265 | RTA00000340F.k.16.1 | M00001647B:C09 | 13157 |
| 1021 | Feb. 24, 1998 | 266 | RTA00000419F.g.15.1 | M00003844D:A07 | 32519 |
| 1022 | Feb. 24, 1998 | 267 | RTA00000423F.a.19.1 | M00001676D:A02 | 21396 |
| 1023 | Feb. 24, 1998 | 268 | RTA00000403F.e.23.1 | M00001476A:D11 | 9626 |
| 1024 | Feb. 24, 1998 | 269 | RTA00000422F.e.08.1 | M00001573A:E01 | 39020 |
| 1025 | Feb. 24, 1998 | 270 | RTA00000411F.d.15.1 | M00001692A:B06 | 74890 |
| 1026 | Feb. 24, 1998 | 271 | RTA00000414F.e.16.1 | M00005236B:H10 | 0 |
| 1027 | Feb. 24, 1998 | 272 | RTA00000411F.l.15.1 | M00003857C:F11 | 66704 |
| 1028 | Feb. 24, 1998 | 273 | RTA00000400F.a.11.1 | M00001612B:D11 | 0 |
| 1029 | Feb. 24, 1998 | 274 | RTA00000405F.e.08.1 | M00001663C:F10 | 37916 |
| 1030 | Feb. 24, 1998 | 275 | RTA00000353R.j.24.1 | M00001428B:D01 | 23089 |
| 1031 | Feb. 24, 1998 | 276 | RTA00000423F.a.18.1 | M00001675A:G10 | 26761 |
| 1032 | Feb. 24, 1998 | 277 | RTA00000418F.o.06.1 | M00001660C:D11 | 75930 |
| 1033 | Feb. 24, 1998 | 278 | RTA00000404F.c.10.1 | M00001593B:E11 | 23534 |
| 1034 | Feb. 24, 1998 | 279 | RTA00000418F.i.21.1 | M00001596D:E10 | 78728 |
| 1035 | Feb. 24, 1998 | 280 | RTA00000418F.p.15.1 | M00001671C:C11 | 31066 |
| 1036 | Feb. 24, 1998 | 281 | RTA00000411F.l.13.1 | M00003857C:C09 | 43114 |
| 1037 | Feb. 24, 1998 | 282 | RTA00000407F.a.24.1 | M00004083A:E08 | 37560 |
| 1038 | Feb. 24, 1998 | 283 | RTA00000346F.n.06.1 | M00004139C:A12 | 12439 |
| 1039 | Feb. 24, 1998 | 284 | RTA00000412F.l.21.1 | M00004029C:G10 | 65183 |
| 1040 | Feb. 24, 1998 | 285 | RTA00000413F.i.02.1 | M00004110D:A10 | 65857 |
| 1041 | Feb. 24, 1998 | 286 | RTA00000404F.i.19.1 | M00001625B:C10 | 38698 |
| 1042 | Feb. 24, 1998 | 287 | RTA00000410F.n.09.1 | M00001662C:A04 | 11736 |
| 1043 | Feb. 24, 1998 | 288 | RTA00000403F.a.11.1 | M00001448C:F10 | 73109 |
| 1044 | Feb. 24, 1998 | 289 | RTA00000420F.n.08.1 | M00005257A:H11 | 0 |
| 1045 | Feb. 24, 1998 | 290 | RTA00000411F.k.16.1 | M00003852C:B06 | 64759 |
| 1046 | Feb. 24, 1998 | 291 | RTA00000405F.c.01.1 | M00001657D:A04 | 19236 |
| 1047 | Feb. 24, 1998 | 292 | RTA00000423F.i.18.1 | M00003918A:D08 | 14996 |
| 1048 | Feb. 24, 1998 | 293 | RTA00000403F.l.04.1 | M00001571C:A04 | 39278 |
| 1049 | Feb. 24, 1998 | 294 | RTA00000405F.l.17.1 | M00003805A:F02 | 17225 |
| 1050 | Feb. 24, 1998 | 295 | RTA00000406F.a.07.1 | M00003856C:H09 | 26607 |
| 1051 | Feb. 24, 1998 | 296 | RTA00000347F.d.06.1 | M00001457C:F02 | 39122 |
| 1052 | Feb. 24, 1998 | 297 | RTA00000419F.b.18.1 | M00003808D:D08 | 67034 |
| 1053 | Feb. 24, 1998 | 298 | RTA00000406F.h.07.1 | M00003901B:H04 | 38003 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1054 | Feb. 24, 1998 | 299 | RTA00000405F.l.15.1 | M00001694A:E03 | 19575 |
| 1055 | Feb. 24, 1998 | 300 | RTA00000406F.g.17.1 | M00003881B:F10 | 37979 |
| 1056 | Feb. 24, 1998 | 301 | RTA00000401F.m.23.1 | M00003914C:C02 | 2801 |
| 1057 | Feb. 24, 1998 | 302 | RTA00000356R.f.18.1 | M00004692A:H10 | 0 |
| 1058 | Feb. 24, 1998 | 303 | RTA00000130A.h.22.1 | M00001617A:D06 | 80933 |
| 1059 | Feb. 24, 1998 | 304 | RTA00000403F.n.18.2 | M00001577D:H06 | 8811 |
| 1060 | Feb. 24, 1998 | 305 | RTA00000418F.p.06.1 | M00001664A:F08 | 32628 |
| 1061 | Feb. 24, 1998 | 306 | RTA00000404F.d.13.1 | M00001595D:A04 | 39036 |
| 1062 | Feb. 24, 1998 | 307 | RTA00000420F.l.12.2 | M00005230B:H09 | 0 |
| 1063 | Feb. 24, 1998 | 308 | RTA00000353R.d.11.1 | M00004692A:H08 | 0 |
| 1064 | Feb. 24, 1998 | 309 | RTA00000340F.n.01.1 | M00001679A:G06 | 39081 |
| 1065 | Feb. 24, 1998 | 310 | RTA00000419F.d.06.1 | M00003820B:D07 | 65496 |
| 1066 | Feb. 24, 1998 | 311 | RTA00000419F.n.09.1 | M00003977C:A06 | 66070 |
| 1067 | Feb. 24, 1998 | 312 | RTA00000399F.i.08.1 | M00001575D:B10 | 38927 |
| 1068 | Feb. 24, 1998 | 313 | RTA00000406F.g.07.1 | M00003880C:E11 | 37925 |
| 1069 | Feb. 24, 1998 | 314 | RTA00000423F.g.13.1 | M00003905A:E07 | 38028 |
| 1070 | Feb. 24, 1998 | 315 | RTA00000419F.p.12.1 | M00004037A:E04 | 13767 |
| 1071 | Feb. 24, 1998 | 316 | RTA00000414F.a.02.1 | M00005178D:H04 | 0 |
| 1072 | Feb. 24, 1998 | 317 | RTA00000195AF.b.21.1 | M00001595B:A09 | 39055 |
| 1072 | Jan. 28, 1998 | 602 | RTA00000195AF.b.21.1 | M00001595B:A09 | 39055 |
| 1073 | Feb. 24, 1998 | 318 | RTA00000403F.h.05.1 | M00001482D:A04 | 39096 |
| 1074 | Feb. 24, 1998 | 319 | RTA00000420F.b.21.1 | M00004088D:B10 | 65057 |
| 1075 | Feb. 24, 1998 | 320 | RTA00000422F.p.07.2 | M00001661A:E06 | 39024 |
| 1076 | Feb. 24, 1998 | 321 | RTA00000339F.c.21.1 | M00001389C:A08 | 5325 |
| 1077 | Feb. 24, 1998 | 322 | RTA00000339F.c.24.1 | M00001364B:B06 | 5516 |
| 1078 | Feb. 24, 1998 | 323 | RTA00000421F.n.19.1 | M00001679A:D10 | 16409 |
| 1079 | Feb. 24, 1998 | 324 | RTA00000340F.p.17.1 | M00003750C:H05 | 0 |
| 1080 | Feb. 24, 1998 | 325 | RTA00000345F.k.21.1 | M0b001464B:C11 | 40204 |
| 1081 | Feb. 24, 1998 | 326 | RTA00000419F.b.15.1 | M00003806D:D11 | 43969 |
| 1082 | Feb. 24, 1998 | 327 | RTA00000405F.a.11.1 | M00001655A:B11 | 39124 |
| 1083 | Feb. 24, 1998 | 328 | RTA00000423F.k.19.2 | M00003985D:E10 | 17615 |
| 1084 | Feb. 24, 1998 | 329 | RTA00000413F.e.16.1 | M00004093C:C02 | 63836 |
| 1085 | Feb. 24, 1998 | 330 | RTA00000403F.i.04.1 | M00001485B:D09 | 8930 |
| 1086 | Feb. 24, 1998 | 331 | RTA00000404F.o.18.2 | M00001651C:C05 | 39110 |
| 1087 | Feb. 24, 1998 | 332 | RTA00000409F.j.24.1 | M00001611B:A09 | 76967 |
| 1088 | Feb. 24, 1998 | 333 | RTA00000399F.f.11.1 | M00001487C:F01 | 40167 |
| 1089 | Feb. 24, 1998 | 334 | RTA00000408F.p.05.1 | M00001575B:B02 | 9649 |
| 1090 | Feb. 24, 1998 | 335 | RTA00000413F.d.02.1 | M00004087B:A12 | 66172 |
| 1091 | Feb. 24, 1998 | 336 | RTA00000340F.n.13.1 | M00001688D:B10 | 17055 |
| 1092 | Feb. 24, 1998 | 337 | RTA00000340F.p.04.1 | M00001679D:B02 | 78533 |
| 1093 | Feb. 24, 1998 | 338 | RTA00000411F.c.05.1 | M00001677B:H06 | 73368 |
| 1094 | Feb. 24, 1998 | 339 | RTA00000403F.g.10.1 | M00001481A:G06 | 20211 |
| 1095 | Feb. 24, 1998 | 340 | RTA00000408F.l.13.1 | M00001530A:B12 | 4423 |
| 1096 | Feb. 24, 1998 | 341 | RTA00000412F.g.20.2 | M00003972C:F08 | 25018 |
| 1097 | Feb. 24, 1998 | 342 | RTA00000404F.i.02.1 | M00001619D:D10 | 39015 |
| 1098 | Feb. 24, 1998 | 343 | RTA00000422F.g.21.1 | M00001583A:F07 | 17232 |
| 1099 | Feb. 24, 1998 | 344 | RTA00000403F.m.15.2 | M00001575D:D12 | 26901 |
| 1100 | Feb. 24, 1998 | 345 | RTA00000412F.h.23.2 | M00003974D:H04 | 65118 |
| 1101 | Feb. 24, 1998 | 346 | RTA00000418F.j.08.1 | M00001626C:C11 | 73382 |
| 1102 | Feb. 24, 1998 | 347 | RTA00000125A.n.4.1 | M00001546A:D08 | 81984 |
| 1103 | Feb. 24, 1998 | 348 | RTA00000412F.l.19.1 | M00004029C:C05 | 65825 |
| 1104 | Feb. 24, 1998 | 349 | RTA00000404F.m.10.2 | M00001641D:E02 | 779 |
| 1105 | Feb. 24, 1998 | 350 | RTA00000129A.p.3.1 | M00001604A:B08 | 32644 |
| 1106 | Feb. 24, 1998 | 351 | RTA00000340F.p.20.1 | M00003752B:C02 | 17008 |
| 1107 | Feb. 24, 1998 | 352 | RTA00000411F.a.10.1 | M00001675C:G01 | 73073 |
| 1108 | Feb. 24, 1998 | 353 | RTA00000409F.n.17.1 | M00001621C:C10 | 76725 |
| 1109 | Feb. 24, 1998 | 354 | RTA00000404F.c.03.2 | M00001592C:F11 | 39198 |
| 1110 | Feb. 24, 1998 | 355 | RTA00000420F.a.19.1 | M00004076A:D12 | 34192 |
| 1111 | Feb. 24, 1998 | 356 | RTA00000409F.m.24.1 | M00001620D:H02 | 3942 |
| 1112 | Feb. 24, 1998 | 357 | RTA00000406F.n.16.1 | M00003972A:G09 | 5660 |
| 1113 | Feb. 24, 1998 | 358 | RTA00000414F.e.06.1 | M00005235A:A03 | 0 |
| 1114 | Feb. 24, 1998 | 359 | RTA00000420F.d.12.1 | M00004096D:H03 | 64095 |
| 1115 | Feb. 24, 1998 | 360 | RTA00000409F.j.19.1 | M00001613A:F03 | 73792 |
| 1116 | Feb. 24, 1998 | 361 | RTA00000422F.d.16.1 | M00001570C:G03 | 39133 |
| 1117 | Feb. 24, 1998 | 362 | RTA00000418F.m.16.1 | M00001653B:E06 | 74986 |
| 1118 | Feb. 24, 1998 | 363 | RTA00000405F.c.11.1 | M00001659A:D12 | 39068 |
| 1119 | Feb. 24, 1998 | 364 | RTA00000404F.k.22.1 | M00001635D:C12 | 39084 |
| 1120 | Feb. 24, 1998 | 365 | RTA00000418F.k.07.1 | M00001637A:F10 | 75067 |
| 1121 | Feb. 24, 1998 | 366 | RTA00000403F.c.10.1 | M00001456D:F05 | 75261 |
| 1122 | Feb. 24, 1998 | 367 | RTA00000401F.o.06.1 | M00004029C:C12 | 2679 |
| 1123 | Feb. 24, 1998 | 368 | RTA00000346F.o.08.1 | M00004149C:B02 | 0 |
| 1124 | Feb. 24, 1998 | 369 | RTA00000410F.m.05.1 | M00001657B:B04 | 74964 |
| 1125 | Feb. 24, 1998 | 370 | RTA00000405F.i.20.1 | M00001677A:G11 | 38532 |
| 1126 | Feb. 24, 1998 | 371 | RTA00000403F.j.17.1 | M00001539D:B10 | 38563 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1127 | Feb. 24, 1998 | 372 | RTA00000408F.p.24.1 | M00001579A:E03 | 74286 |
| 1128 | Feb. 24, 1998 | 373 | RTA00000418F.k.18.1 | M00001639C:A10 | 75385 |
| 1129 | Feb. 24, 1998 | 374 | RTA00000422F.m.04.1 | M00001615B:A09 | 38702 |
| 1130 | Feb. 24, 1998 | 375 | RTA00000405F.g.16.2 | M00001672D:D04 | 9021 |
| 1131 | Feb. 24, 1998 | 376 | RTA00000400F.k.22.1 | M00001656A:B07 | 2512 |
| 1132 | Feb. 24, 1998 | 377 | RTA00000346F.i.01.1 | M00003797A:D06 | 22260 |
| 1133 | Feb. 24, 1998 | 378 | RTA00000403F.a.07.1 | M00001448B:F09 | 73559 |
| 1134 | Feb. 24, 1998 | 379 | RTA00000349R.j.07.1 | M00001529B:C04 | 2642 |
| 1135 | Feb. 24, 1998 | 380 | RTA00000403F.b.19.1 | M00001456B:A06 | 22327 |
| 1136 | Feb. 24, 1998 | 381 | RTA00000418F.m.23.1 | M00001654D:F11 | 77195 |
| 1137 | Feb. 24, 1998 | 382 | RTA00000341F.h.10.1 | M00003901B:G11 | 0 |
| 1138 | Feb. 24, 1998 | 383 | RTA00000404F.i.18.1 | M00001621C:H12 | 21912 |
| 1139 | Feb. 24, 1998 | 384 | RTA00000422F.i.14.1 | M00001487A:F10 | 39300 |
| 1140 | Feb. 24, 1998 | 385 | RTA00000418F.m.14.1 | M00001651B:E06 | 75711 |
| 1141 | Feb. 24, 1998 | 386 | RTA00000406F.o.12.1 | M00003986D:D02 | 37459 |
| 1142 | Feb. 24, 1998 | 387 | RTA00000411F.a.15.1 | M00001675D:B08 | 73812 |
| 1143 | Feb. 24, 1998 | 388 | RTA00000411F.a.07.1 | M00001675C:C03 | 74547 |
| 1144 | Feb. 24, 1998 | 389 | RTA00000411F.c.02.1 | M00001677B:B04 | 72852 |
| 1145 | Feb. 24, 1998 | 390 | RTA00000355R.a.14.1 | M00004187D:G09 | 10207 |
| 1146 | Feb. 24, 1998 | 391 | RTA00000130A.h.16.1 | M00001617A:A08 | 80761 |
| 1147 | Feb. 24, 1998 | 392 | RTA00000410F.p.23.1 | M00001675B:C01 | 73948 |
| 1148 | Feb. 24, 1998 | 393 | RTA00000418F.m.24.1 | M00001654D:F12 | 77114 |
| 1149 | Feb. 24, 1998 | 394 | RTA00000420F.m.02.1 | M00005233A:G08 | 0 |
| 1150 | Feb. 24, 1998 | 395 | RTA00000408F.j.19.2 | M00001485C:C08 | 73752 |
| 1151 | Feb. 24, 1998 | 396 | RTA00000406F.e.21.1 | M00003877D:G05 | 9090 |
| 1152 | Feb. 24, 1998 | 397 | RTA00000118A.d.17.1 | M00001416A:D09 | 81921 |
| 1153 | Feb. 24, 1998 | 398 | RTA00000407F.b.04.1 | M00004086D:B09 | 63221 |
| 1154 | Feb. 24, 1998 | 399 | RTA00000411F.e.07.1 | M00003810C:A03 | 65008 |
| 1155 | Feb. 24, 1998 | 400 | RTA00000403F.f.08.1 | M00001477A:G07 | 19107 |
| 1156 | Feb. 24, 1998 | 401 | RTA00000132A.c.11.1 | M00001454A:G03 | 87278 |
| 1157 | Feb. 24, 1998 | 402 | RTA00000420F.e.16.1 | M00004110A:E04 | 63639 |
| 1158 | Feb. 24, 1998 | 403 | RTA00000403F.d.22.1 | M00001473A:A07 | 10692 |
| 1159 | Feb. 24, 1998 | 404 | RTA00000404F.b.11.1 | M00001591D:F06 | 39079 |
| 1160 | Feb. 24, 1998 | 405 | RTA00000418F.k.17.1 | M00001639C:A09 | 75390 |
| 1161 | Feb. 24, 1998 | 406 | RTA00000129A.k.12.1 | M00001601A:A06 | 79322 |
| 1162 | Feb. 24, 1998 | 407 | RTA00000340R.m.07.1 | M00001679D:F02 | 78415 |
| 1163 | Feb. 24, 1998 | 408 | RTA00000405F.d.14.1 | M00001662A:C12 | 35209 |
| 1164 | Feb. 24, 1998 | 409 | RTA00000406F.f.11.1 | M00003879A:B08 | 38601 |
| 1165 | Feb. 24, 1998 | 410 | RTA00000120A.h.5.1 | M00001465A:G06 | 80344 |
| 1166 | Feb. 24, 1998 | 411 | RTA0000C420F.m.12.1 | M00005234D:B04 | 0 |
| 1167 | Feb. 24, 1998 | 412 | RTA00000411F.g.06.1 | M00003822D:C06 | 66065 |
| 1168 | Feb. 24, 1998 | 413 | RTA00000408F.d.16.1 | M00001459B:D03 | 76318 |
| 1169 | Feb. 24, 1998 | 414 | RTA00000120A.p.18.1 | M00001468A:C05 | 6478 |
| 1170 | Feb. 24, 1998 | 415 | RTA00000340R.f.05.1 | M00001569B:G11 | 3202 |
| 1171 | Feb. 24, 1998 | 416 | RTA00000404F.c.19.1 | M00001594A:D06 | 39026 |
| 1172 | Feb. 24, 1998 | 417 | RTA00000423F.l.02.1 | M00003978C:A03 | 5639 |
| 1173 | Feb. 24, 1998 | 418 | RTA00000410F.a.01.1 | M00001631D:B10 | 73354 |
| 1174 | Feb. 24, 1998 | 419 | RTA00000408F.h.08.1 | M00001480A:D03 | 74575 |
| 1175 | Feb. 24, 1998 | 420 | RTA00000422F.b.16.1 | M00003813B:A11 | 17045 |
| 1176 | Feb. 24, 1998 | 421 | RTA00000419F.f.10.1 | M00003835D:G06 | 66193 |
| 1177 | Feb. 24, 1998 | 422 | RTA00000418F.l.04.1 | M00001641C:D02 | 74140 |
| 1178 | Feb. 24, 1998 | 423 | RTA00000410F.a.16.1 | M00001633A:E06 | 73548 |
| 1179 | Feb. 24, 1998 | 424 | RTA00000138A.e.13.1 | M00001605A:E06 | 79608 |
| 1180 | Feb. 24, 1998 | 425 | RTA00000130A.b.5.1 | M00001605A:E09 | 79579 |
| 1181 | Feb. 24, 1998 | 426 | RTA00000408F.j.15.2 | M00001485B:F05 | 74759 |
| 1182 | Feb. 24, 1998 | 427 | RTA00000410F.m.20.1 | M00001660B:E03 | 74285 |
| 1183 | Feb. 24, 1998 | 428 | RTA00000422F.f.14.1 | M00001478B:D07 | 2036 |
| 1184 | Feb. 24, 1998 | 429 | RTA00000422F.c.17.1 | M00004099D:F01 | 1360 |
| 1185 | Feb. 24, 1998 | 430 | RTA00000419F.e.04.1 | M00003831C:G05 | 62963 |
| 1186 | Feb. 24, 1998 | 431 | RTA00000399F.j.15.1 | M00001578C:G06 | 1261 |
| 1187 | Feb. 24, 1998 | 432 | RTA00000418F.g.05.1 | M00001579C:H06 | 73075 |
| 1188 | Feb. 24, 1998 | 433 | RTA00000419F.n.02.1 | M00003958B:H08 | 65963 |
| 1189 | Feb. 24, 1998 | 434 | RTA00000348R.b.16.1 | M00001347B:H04 | 6510 |
| 1190 | Feb. 24, 1998 | 435 | RTA00000340F.b.02.1 | M00001503C:G05 | 10185 |
| 1191 | Feb. 24, 1998 | 436 | RTA00000119A.m.15.1 | M00001461A:E05 | 80989 |
| 1192 | Feb. 24, 1998 | 437 | RTA00000403F.m.20.2 | M00001576A:F11 | 707 |
| 1193 | Feb. 24, 1998 | 438 | RTA00000195R.d.09.1 | M00003981B:B04 | 8537 |
| 1194 | Feb. 24, 1998 | 439 | RTA00000413F.g.23.1 | M00004103B:E09 | 40700 |
| 1195 | Feb. 24, 1998 | 440 | RTA00000403F.a.18.1 | M00001448D:F12 | 75726 |
| 1196 | Feb. 24, 1998 | 441 | RTA00000404F.m.20.2 | M00001647A:H08 | 39144 |
| 1197 | Feb. 24, 1998 | 442 | RTA00000347F.b.02.1 | M00001450A:A02 | 39304 |
| 1198 | Feb. 24, 1998 | 443 | RTA00000414F.f.15.1 | M00005260A:A12 | 0 |
| 1199 | Feb. 24, 1998 | 444 | RTA00000419F.h.04.1 | M00003846A:D03 | 65034 |
| 1200 | Feb. 24, 1998 | 445 | RTA00000408F.d.12.1 | M00001459B:A12 | 75782 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1201 | Feb. 24, 1998 | 446 | RTA00000133A.m.19.2 | M00001512A:G05 | 80167 |
| 1202 | Feb. 24, 1998 | 447 | RTA00000423F.b.04.3 | M00001675D:E10 | 6311 |
| 1203 | Feb. 24, 1998 | 448 | RTA00000127A.a.3.1 | M00001552A:H10 | 13232 |
| 1204 | Feb. 24, 1998 | 449 | RTA00000411F.j.16.1 | M00003843A:E08 | 17237 |
| 1205 | Feb. 24, 1998 | 450 | RTA00000118A.a.23.1 | M00001395A:H02 | 3500 |
| 1206 | Feb. 24, 1998 | 451 | RTA00000126A.o.22.1 | M00001551A:A11 | 81752 |
| 1207 | Feb. 24, 1998 | 452 | RTA00000419F.n.13.1 | M00003977D:A06 | 66026 |
| 1208 | Feb. 24, 1998 | 453 | RTA00000130A.h.13.1 | M00001617A:A01 | 80790 |
| 1209 | Feb. 24, 1998 | 454 | RTA00000418F.n.19.1 | M00001659C:F02 | 28761 |
| 1210 | Feb. 24, 1998 | 455 | RTA00000399F.d.23.1 | M00001481B:A07 | 3310 |
| 1211 | Feb. 24, 1998 | 456 | RTA00000413F.o.06.1 | M00005100A:B02 | 0 |
| 1212 | Feb. 24, 1998 | 457 | RTA00000411F.m.19.1 | M00003868D:D11 | 74924 |
| 1213 | Feb. 24, 1998 | 458 | RTA00000130A.a.19.1 | M00001605A:A06 | 0 |
| 1214 | Feb. 24, 1998 | 459 | RTA00000419F.k.06.1 | M00003871D:A10 | 78493 |
| 1215 | Feb. 24, 1998 | 460 | RTA00000341F.j.12.1 | M00003987C:G03 | 12195 |
| 1216 | Feb. 24, 1998 | 461 | RTA00000412F.d.16.1 | M00003906B:H06 | 26829 |
| 1217 | Feb. 24, 1998 | 462 | RTA00000119A.j.23.1 | M00001460A:G07 | 79835 |
| 1218 | Feb. 24, 1998 | 463 | RTA00000403F.o.22.1 | M00001583A:D01 | 25076 |
| 1219 | Feb. 24, 1998 | 464 | RTA00000195AF.c.12.1 | M00003818B:G12 | 37582 |
| 1219 | Jan. 28, 1998 | 300 | RTA00000195AF.c.12.1 | M00003818B:G12 | 37582 |
| 1220 | Feb. 24, 1998 | 465 | RTA00000350R.p.18.1 | M00001676B:F05 | 11460 |
| 1221 | Feb. 24, 1998 | 466 | RTA00000406F.i.24.1 | M00003904D:B12 | 12767 |
| 1222 | Feb. 24, 1998 | 467 | RTA00000123A.n.13.2 | M00001534A:D03 | 39167 |
| 1223 | Feb. 24, 1998 | 468 | RTA00000423F.c.19.1 | M00001680B:E10 | 40472 |
| 1224 | Feb. 24, 1998 | 469 | RTA00000405F.g.24.1 | M00001673D:D06 | 39076 |
| 1225 | Feb. 24, 1998 | 470 | RTA00000411F.j.06.1 | M00003841C:H08 | 63545 |
| 1226 | Feb. 24, 1998 | 471 | RTA00000419F.c.11.1 | M00003817B:C04 | 65504 |
| 1227 | Feb. 24, 1998 | 472 | RTA00000135A.f.14.2 | M00001542A:G12 | 79969 |
| 1228 | Feb. 24, 1998 | 473 | RTA00000403F.a.05.1 | M00001448A:E11 | 18808 |
| 1229 | Feb. 24, 1998 | 474 | RTA00000405F.e.17.1 | M00001669A:C10 | 38662 |
| 1230 | Feb. 24, 1998 | 475 | RTA00000411F.d.05.1 | M00001681C:A08 | 75812 |
| 1231 | Feb. 24, 1998 | 476 | RTA00000345F.h.01.1 | M00001441B:D11 | 10834 |
| 1232 | Feb. 24, 1998 | 477 | RTA00000418F.d.03.1 | M00001567B:G11 | 76824 |
| 1233 | Feb. 24, 1998 | 478 | RTA00000418F.h.08.1 | M00001589B:E07 | 76401 |
| 1234 | Feb. 24, 1998 | 479 | RTA00000418F.m.10.1 | M00001651A:H11 | 79110 |
| 1235 | Feb. 24, 1998 | 480 | RTA00000411F.i.15.1 | M00003837C:G08 | 31612 |
| 1236 | Feb. 24, 1998 | 481 | RTA00000413F.i.23.1 | M00004118B:F01 | 63073 |
| 1237 | Feb. 24, 1998 | 482 | RTA00000411F.e.24.1 | M00003813A:B02 | 64781 |
| 1238 | Feb. 24, 1998 | 483 | RTA00000406F.g.22.1 | M00003881D:C12 | 38590 |
| 1239 | Feb. 24, 1998 | 484 | RTA00000126A.n.13.2 | M00001551A:H06 | 79735 |
| 1240 | Feb. 24, 1998 | 485 | RTA00000419F.a.02.1 | M00001678A:F05 | 77993 |
| 1241 | Feb. 24, 1998 | 486 | RTA00000346F.l.13.1 | M00003980B:C11 | 7542 |
| 1242 | Feb. 24, 1998 | 487 | RTA00000420F.g.05.1 | M00004891B:D01 | 0 |
| 1243 | Feb. 24, 1998 | 488 | RTA00000339F.k.23.1 | M00001429D:H12 | 0 |
| 1244 | Feb. 24, 1998 | 489 | RTA00000406F.j.19.1 | M00003906A:F12 | 1685 |
| 1245 | Feb. 24, 1998 | 490 | RTA00000120A.d.15.1 | M00001464A:B02 | 80533 |
| 1246 | Feb. 24, 1998 | 491 | RTA00000418F.f.21.1 | M00001579B:F04 | 75157 |
| 1247 | Feb. 24, 1998 | 492 | RTA00000340F.o.18.1 | M00001669D:C03 | 4261 |
| 1248 | Feb. 24, 1998 | 493 | RTA00000129A.d.1.2 | M00001587A:F05 | 80058 |
| 1249 | Feb. 24, 1998 | 494 | RTA00000419F.k.12.1 | M00003876C:F02 | 0 |
| 1250 | Feb. 24, 1998 | 495 | RTA00000400F.o.21.1 | M00001669C:C08 | 16259 |
| 1251 | Feb. 24, 1998 | 496 | RTA00000419F.m.20.1 | M00003914A:B07 | 76720 |
| 1252 | Feb. 24, 1998 | 497 | RTA00000350R.f.21.1 | M00001610C:E07 | 22110 |
| 1253 | Feb. 24, 1998 | 498 | RTA00000406F.e.15.1 | M00003877C:A11 | 39074 |
| 1254 | Feb. 24, 1998 | 499 | RTA00000126A.p.18.2 | M00001552A:E10 | 80881 |
| 1255 | Feb. 24, 1998 | 500 | RTA00000411F.c.10.1 | M00001678D:B11 | 73117 |
| 1256 | Feb. 24, 1998 | 501 | RTA00000414F.f.05.1 | M00005257D:H11 | 0 |
| 1257 | Feb. 24, 1998 | 502 | RTA00000341F.d.08.1 | M00003824C:D07 | 0 |
| 1258 | Feb. 24, 1998 | 503 | RTA00000420F.m.08.1 | M00005233B:D04 | 0 |
| 1259 | Feb. 24, 1998 | 504 | RTA00000413F.d.05.1 | M00004087C:A01 | 64788 |
| 1260 | Feb. 24, 1998 | 505 | RTA00000121A.o.3.1 | M00001511A:A02 | 81437 |
| 1261 | Feb. 24, 1998 | 506 | RTA00000403F.f.09.1 | M00001477B:C02 | 0 |
| 1262 | Feb. 24, 1998 | 507 | RTA00000420F.e.02.1 | M00004107B:D07 | 40259 |
| 1263 | Feb. 24, 1998 | 508 | RTA00000420F.i.20.1 | M00005101C:E12 | 0 |
| 1264 | Feb. 24, 1998 | 509 | RTA00000349R.g.10.1 | M00001495B:B08 | 5777 |
| 1265 | Feb. 24, 1998 | 510 | RTA00000131A.g.16.2 | M00001449A:F01 | 0 |
| 1266 | Feb. 24, 1998 | 511 | RTA00000341F.b.13.1 | M00003762B:H09 | 0 |
| 1267 | Feb. 24, 1998 | 512 | RTA00000414F.c.16.1 | M00005228A:B03 | 0 |
| 1268 | Feb. 24, 1998 | 513 | RTA00000126A.k.7.2 | M00001550A:E07 | 79866 |
| 1269 | Feb. 24, 1998 | 514 | RTA00000404F.e.13.1 | M00001608D:E09 | 12046 |
| 1270 | Feb. 24, 1998 | 515 | RTA00000419F.l.03.1 | M00003879A:D02 | 79060 |
| 1271 | Feb. 24, 1998 | 516 | RTA00000339F.f.20.1 | M00001399A:C03 | 6494 |
| 1272 | Feb. 24, 1998 | 517 | RTA00000P18A.a.2.1 | M00001395A:A12 | 38067 |
| 1273 | Feb. 24, 1998 | 518 | RTA00000410F.m.18.1 | M00001660B:A09 | 76365 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1274 | Feb. 24, 1998 | 519 | RTA00000404F.l.10.1 | M00001638B:F10 | 23136 |
| 1275 | Feb. 24, 1998 | 520 | RTA00000406F.c.20.1 | M00003871D:G06 | 38578 |
| 1276 | Feb. 24, 1998 | 521 | RTA00000413F.b.14.1 | M00004078A:C11 | 66591 |
| 1277 | Feb. 24, 1998 | 522 | RTA00000406F.c.18.1 | M00003871C:F12 | 14368 |
| 1278 | Feb. 24, 1998 | 523 | RTA00000418F.j.09.1 | M00001626C:D12 | 76352 |
| 1279 | Feb. 24, 1998 | 524 | RTA00000419F.f.23.1 | M00003840D:H10 | 65002 |
| 1280 | Feb. 24, 1998 | 525 | RTA00000348R.d.24.1 | M00001349B:G05 | 5774 |
| 1281 | Feb. 24, 1998 | 526 | RTA00000411F.a.05.1 | M00001675B:H03 | 76699 |
| 1282 | Feb. 24, 1998 | 527 | RTA00000419F.m.21.1 | M00003914A:E04 | 77947 |
| 1283 | Feb. 24, 1998 | 528 | RTA00000405F.n.16.1 | M00003825B:B10 | 21503 |
| 1284 | Feb. 24, 1998 | 529 | RTA00000422F.o.19.2 | M00001655C:E01 | 13084 |
| 1285 | Feb. 24, 1998 | 530 | RTA00000408F.n.02.2 | M00001539A:E01 | 76993 |
| 1286 | Feb. 24, 1998 | 531 | RTA00000345F.n.12.1 | M00001528A:C04 | 7337 |
| 1287 | Feb. 24, 1998 | 532 | RTA00000403F.a.24.1 | M00001455B:A09 | 24128 |
| 1288 | Feb. 24, 1998 | 533 | RTA00000423F.e.11.1 | M00003809B:E10 | 2566 |
| 1289 | Feb. 24, 1998 | 534 | RTA00000126A.g.7.1 | M00001548A:H04 | 1902 |
| 1290 | Feb. 24, 1998 | 535 | RTA00000119A.g.7.1 | M00001454A:F11 | 83580 |
| 1291 | Feb. 24, 1998 | 536 | RTA00000411F.i.02.1 | M00003835B:H11 | 66975 |
| 1292 | Feb. 24, 1998 | 537 | RTA00000408F.l.09.1 | M00001530A:A09 | 75487 |
| 1293 | Feb. 24, 1998 | 538 | RTA00000423F.g.04.1 | M00003903D:C12 | 23012 |
| 1294 | Feb. 24, 1998 | 539 | RTA00000346F.m.15.1 | M00004037B:C04 | 13553 |
| 1295 | Feb. 24, 1998 | 540 | RTA00000418F.i.18.1 | M00001595C:B05 | 78024 |
| 1296 | Feb. 24, 1998 | 541 | RTA00000411F.h.15.1 | M00003832A:A09 | 65160 |
| 1297 | Feb. 24, 1998 | 542 | RTA00000410F.i.19.1 | M00001641B:C10 | 78988 |
| 1298 | Feb. 24, 1998 | 543 | RTA00000419F.k.24.1 | M00003878C:G08 | 75596 |
| 1299 | Feb. 24, 1998 | 544 | RTA00000420F.l.21.2 | M00005232A:H12 | 0 |
| 1300 | Feb. 24, 1998 | 545 | RTA00000420F.e.15.1 | M00004110A:A10 | 20190 |
| 1301 | Feb. 24, 1998 | 546 | RTA00000409F.i.09.1 | M00001610B:C07 | 75279 |
| 1302 | Feb. 24, 1998 | 547 | RTA00000419F.h.02.1 | M00003845D:G08 | 63985 |
| 1303 | Feb. 24, 1998 | 548 | RTA00000413F.b.12.1 | M00004077B:H11 | 64932 |
| 1304 | Feb. 24, 1998 | 549 | RTA00000121A.h.18.1 | M00001471A:B04 | 16376 |
| 1305 | Feb. 24, 1998 | 550 | RTA00000411F.n.20.1 | M00003875C:A09 | 75816 |
| 1306 | Feb. 24, 1998 | 551 | RTA00000340F.b.05.1 | M00001513A:G07 | 0 |
| 1307 | Feb. 24, 1998 | 552 | RTA00000411F.n.12.1 | M00003875A:C04 | 73308 |
| 1308 | Feb. 24, 1998 | 553 | RTA00000408F.j.12.2 | M00001485B:C03 | 18226 |
| 1309 | Feb. 24, 1998 | 554 | RTA00000409F.i.03.1 | M00001610A:E09 | 75968 |
| 1310 | Feb. 24, 1998 | 555 | RTA00000133A.d.22.1 | M00001469A:G11 | 11797 |
| 1311 | Feb. 24, 1998 | 556 | RTA00000400F.i.11.1 | M00001649C:H10 | 2587 |
| 1312 | Feb. 24, 1998 | 557 | RTA00000409F.j.05.1 | M00001611C:C12 | 74128 |
| 1313 | Feb. 24, 1998 | 558 | RTA00000419F.m.04.1 | M00003906C:C05 | 74367 |
| 1314 | Feb. 24, 1998 | 559 | RTA00000418F.k.03.1 | M00001634D:G11 | 78901 |
| 1315 | Feb. 24, 1998 | 560 | RTA00000419F.d.16.1 | M00003828B:E07 | 64357 |
| 1316 | Feb. 24, 1998 | 561 | RTA00000420F.e.10.1 | M00004108D:G04 | 65899 |
| 1317 | Feb. 24, 1998 | 562 | RTA00000401F.j.17.1 | M00003901B:C05 | 5483 |
| 1318 | Feb. 24, 1998 | 563 | RTA00000406F.b.08.1 | M00003867D:A06 | 18258 |
| 1319 | Feb. 24, 1998 | 564 | RTA00000418F.k.08.1 | M00001639A:C03 | 18259 |
| 1320 | Feb. 24, 1998 | 565 | RTA00000420F.k.17.2 | M00005217B:A06 | 0 |
| 1321 | Feb. 24, 1998 | 566 | RTA00000414F.d.05.1 | M00005229D:H03 | 0 |
| 1322 | Feb. 24, 1998 | 567 | RTA00000410F.c.02.1 | M00001633D:D12 | 75055 |
| 1323 | Feb. 24, 1998 | 568 | RTA00000403F.m.03.1 | M00001573D:D10 | 39179 |
| 1324 | Feb. 24, 1998 | 569 | RTA00000403F.h.18.1 | M00001484C:A04 | 39241 |
| 1325 | Feb. 24, 1998 | 570 | RTA00000405F.n.13.1 | M00003824A:G10 | 23810 |
| 1326 | Feb. 24, 1998 | 571 | RTA00000355F.c.14.1 | M00004314B:G07 | 16837 |
| 1327 | Feb. 24, 1998 | 572 | RTA00000422F.l.03.1 | M00001610D:D05 | 39147 |
| 1328 | Feb. 24, 1998 | 573 | RTA00000414F.c.23.1 | M00005229B:G12 | 0 |
| 1329 | Feb. 24, 1998 | 574 | RTA00000403F.o.14.1 | M00001579D:H09 | 38971 |
| 1330 | Feb. 24, 1998 | 575 | RTA00000345F.a.18.1 | M00001351C:B06 | 5517 |
| 1331 | Feb. 24, 1998 | 576 | RTA00000401F.d.15.2 | M00001693C:C12 | 5297 |
| 1332 | Feb. 24, 1998 | 577 | RTA00000419F.e.11.1 | M00003833B:C12 | 36780 |
| 1333 | Feb. 24, 1998 | 578 | RTA00000127A.f.11.1 | M00001554A:A08 | 81463 |
| 1334 | Feb. 24, 1998 | 579 | RTA00000413F.m.16.1 | M00004898C:F03 | 0 |
| 1335 | Feb. 24, 1998 | 580 | RTA00000403F.o.07.1 | M00001579C:A01 | 39037 |
| 1336 | Feb. 24, 1998 | 581 | RTA00000403F.d.19.1 | M00001472C:A01 | 39243 |
| 1337 | Feb. 24, 1998 | 582 | RTA00000414F.e.14.1 | M00005236B:F10 | 0 |
| 1338 | Feb. 24, 1998 | 583 | RTA00000406F.i.17.1 | M00003904B:C03 | 37902 |
| 1339 | Feb. 24, 1998 | 584 | RTA00000418F.d.22.1 | M00001573B:C06 | 75324 |
| 1340 | Feb. 24, 1998 | 585 | RTA00000340R.o.12.1 | M00003746C:E02 | 53732 |
| 1341 | Feb. 24, 1998 | 586 | RTA00000125A.g.24.1 | M00001544A:F05 | 80397 |
| 1342 | Feb. 24, 1998 | 587 | RTA00000130A.o.21.1 | M00001623A:F04 | 80218 |
| 1343 | Feb. 24, 1998 | 588 | RTA00000420F.a.23.1 | M00004078B:F12 | 42158 |
| 1344 | Feb. 24, 1998 | 589 | RTA00000411F.m.18.1 | M00003868D:D09 | 75629 |
| 1345 | Feb. 24, 1998 | 590 | RTA00000407F.b.22.1 | M00004108B:B02 | 37487 |
| 1346 | Feb. 24, 1998 | 591 | RTA00000409F.a.16.1 | M00001583A:A05 | 73990 |
| 1347 | Feb. 24, 1998 | 592 | RTA00000421F.p.18.1 | M00003877B:H10 | 750 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1348 | Feb. 24, 1998 | 593 | RTA00000341F.k.12.1 | M00004103C:D04 | 62985 |
| 1349 | Feb. 24, 1998 | 594 | RTA00000129A.c.18.2 | M00001587A:B10 | 37216 |
| 1350 | Feb. 24, 1998 | 595 | RTA00000410F.d.10.1 | M00001635B:H02 | 77561 |
| 1351 | Feb. 24, 1998 | 596 | RTA00000351R.i.03.1 | M00003846B:D06 | 6874 |
| 1352 | Feb. 24, 1998 | 597 | RTA00000135A.l.1.2 | M00001545A:B10 | 39426 |
| 1353 | Feb. 24, 1998 | 598 | RTA00000420F.b.18.1 | M00004086D:G08 | 66136 |
| 1354 | Feb. 24, 1998 | 599 | RTA00000401F.k.14.1 | M00003903A:H09 | 211 |
| 1355 | Feb. 24, 1998 | 600 | RTA00000406F.m.04.1 | M00003914B:A11 | 14959 |
| 1356 | Feb. 24, 1998 | 601 | RTA00000403F.o.13.1 | M00001579D:F04 | 39049 |
| 1357 | Feb. 24, 1998 | 602 | RTA00000411F.f.06.1 | M00003813B:E09 | 64186 |
| 1358 | Feb. 24, 1998 | 603 | RTA00000399F.o.19.1 | M00001607A:F11 | 2594 |
| 1359 | Feb. 24, 1998 | 604 | RTA00000351R.c.13.1 | M00003747D:C05 | 11476 |
| 1360 | Feb. 24, 1998 | 605 | RTA00000403F.c.14.1 | M00001457D:A07 | 0 |
| 1361 | Feb. 24, 1998 | 606 | RTA00000420F.l.20.2 | M00005232A:C10 | 0 |
| 1362 | Feb. 24, 1998 | 607 | RTA00000420F.d.16.1 | M00004103D:F10 | 64485 |
| 1363 | Feb. 24, 1998 | 608 | RTA00000404F.i.12.1 | M00001620D:G11 | 39001 |
| 1364 | Feb. 24, 1998 | 609 | RTA00000404F.o.10.2 | M00001651B:B12 | 16785 |
| 1365 | Feb. 24, 1998 | 610 | RTA00000419F.d.07.1 | M00003820B:D10 | 21421 |
| 1366 | Feb. 24, 1998 | 611 | RTA00000404F.p.02.2 | M00001652D:A06 | 39097 |
| 1367 | Feb. 24, 1998 | 612 | RTA00000125A.k.14.1 | M00001545A:G05 | 79457 |
| 1368 | Feb. 24, 1998 | 613 | RTA00000122A.j.22.1 | M00001516A:F06 | 81151 |
| 1369 | Feb. 24, 1998 | 614 | RTA00000406F.i.13.1 | M00003904A:C04 | 37904 |
| 1370 | Feb. 24, 1998 | 615 | RTA00000135A.b.23.1 | M00001538A:D12 | 35241 |
| 1371 | Feb. 24, 1998 | 616 | RTA00006423F.c.11.1 | M00001677D:B02 | 0 |
| 1372 | Feb. 24, 1998 | 617 | RTA00000423F.f.23.1 | M00003816C:E09 | 15390 |
| 1373 | Feb. 24, 1998 | 618 | RTA00000423F.l.04.1 | M00004039B:G08 | 14320 |
| 1374 | Feb. 24, 1998 | 619 | RTA00000420F.b.04.1 | M00004081A:E02 | 63820 |
| 1375 | Feb. 24, 1998 | 620 | RTA00000420F.a.07.1 | M00004072C:F08 | 63405 |
| 1376 | Feb. 24, 1998 | 621 | RTA00000408F.i.18.2 | M00001482C:D02 | 74410 |
| 1377 | Feb. 24, 1998 | 622 | RTA00000404F.l.07.1 | M00001637C:C06 | 10798 |
| 1378 | Feb. 24, 1998 | 623 | RTA00000341F.j.05.1 | M00003963D:B05 | 36177 |
| 1379 | Feb. 24, 1998 | 624 | RTA00000420F.a.16.1 | M00004075D:C10 | 63345 |
| 1380 | Feb. 24, 1998 | 625 | RTA00000126A.h.22.2 | M00001549A:F01 | 0 |
| 1381 | Feb. 24, 1998 | 626 | RTA00000410F.j.01.1 | M00001641B:F12 | 73399 |
| 1382 | Feb. 24, 1998 | 627 | RTA00000408F.p.21.1 | M00001579A:C03 | 77930 |
| 1383 | Feb. 24, 1998 | 628 | RTA00000412F.d.19.1 | M00003907B:C03 | 75743 |
| 1384 | Feb. 24, 1998 | 629 | RTA00000352R.c.04.1 | M00003924A:D08 | 71976 |
| 1385 | Feb. 24, 1998 | 630 | RTA00000413F.f.19.1 | M00004100B:C07 | 65189 |
| 1386 | Feb. 24, 1998 | 631 | RTA00000411F.e.03.1 | M00001694D:C12 | 73648 |
| 1387 | Feb. 24, 1998 | 632 | RTA00000191AF.j.14.1 | M00004073A:H12 | 1002 |
| 1387 | Jan. 28, 1998 | 387 | RTA00000191AF.j.14.1 | M00004073A:H12 | 1002 |
| 1388 | Feb. 24, 1998 | 633 | RTA00000341F.d.02.1 | M00003797A:G03 | 4706 |
| 1389 | Feb. 24, 1998 | 634 | RTA00000418F.c.04.1 | M00001487B:A11 | 41587 |
| 1390 | Feb. 24, 1998 | 635 | RTA00000418F.o.17.1 | M00001661B:F03 | 79069 |
| 1391 | Feb. 24, 1998 | 636 | RTA00000418F.e.21.1 | M00001577B:A03 | 74773 |
| 1392 | Feb. 24, 1998 | 637 | RTA00000419F.d.14.1 | M00003828A:D05 | 64945 |
| 1393 | Feb. 24, 1998 | 638 | RTA00000418F.b.09.1 | M00001478B:H08 | 19700 |
| 1394 | Feb. 24, 1998 | 639 | RTA00000414F.d.09.1 | M00005231C:B01 | 0 |
| 1395 | Feb. 24, 1998 | 640 | RTA00000405F.f.02.1 | M00001669B:G02 | 38665 |
| 1396 | Feb. 24, 1998 | 641 | RTA00000410F.j.20.1 | M00001642D:G10 | 73601 |
| 1397 | Feb. 24, 1998 | 642 | RTA00000341F.h.19.1 | M00003916C:C05 | 0 |
| 1398 | Feb. 24, 1998 | 643 | RTA00000420F.l.14.2 | M00005230D:F06 | 0 |
| 1399 | Feb. 24, 1998 | 644 | RTA00000119A.j.9.1 | M00001460A:B12 | 82060 |
| 1400 | Feb. 24, 1998 | 645 | RTA00000422F.p.12.2 | M00001661C:F10 | 9840 |
| 1401 | Feb. 24, 1998 | 646 | RTA00000421F.m.14.1 | M00001642A:F03 | 3524 |
| 1402 | Feb. 24, 1998 | 647 | RTA00000418F.b.23.1 | M00001485A:C05 | 28767 |
| 1403 | Feb. 24, 1998 | 648 | RTA00000340F.i.13.1 | M00001624B:B10 | 79299 |
| 1404 | Feb. 24, 1998 | 649 | RTA00000412F.g.03.1 | M00003971B:A10 | 64740 |
| 1405 | Feb. 24, 1998 | 650 | RTA00000122A.g.17.1 | M00001514A:B08 | 32655 |
| 1406 | Feb. 24, 1998 | 651 | RTA00000403F.g.11.1 | M00001481A:H08 | 24238 |
| 1407 | Feb. 24, 1998 | 652 | RTA00000419F.n.12.1 | M00003977D:A03 | 66086 |
| 1408 | Feb. 24, 1998 | 653 | RTA00000352R.m.12.1 | M00004212B:C07 | 2379 |
| 1409 | Feb. 24, 1998 | 654 | RTA00000421F.a.05.1 | M00001570C:G06 | 5278 |
| 1410 | Feb. 24, 1998 | 655 | RTA00000351R.p.14.1 | M00003915C:H04 | 13166 |
| 1411 | Feb. 24, 1998 | 656 | RTA00000403F.e.08.1 | M00001473B:B11 | 19126 |
| 1412 | Feb. 24, 1998 | 657 | RTA00000124A.k.20.1 | M00001538A:C08 | 80913 |
| 1413 | Feb. 24, 1998 | 658 | RTA00000121A.n.2.1 | M00001511A:A05 | 33585 |
| 1414 | Feb. 24, 1998 | 659 | RTA00000422F.m.24.1 | M00001641D:C04 | 39159 |
| 1415 | Feb. 24, 1998 | 660 | RTA00000408F.e.24.2 | M00001476:C11 | 75002 |
| 1416 | Feb. 24, 1998 | 661 | RTA00000341F.l.16.1 | M00003986D:C08 | 8479 |
| 1417 | Feb. 24, 1998 | 662 | RTA00000339F.o.07.1 | M00001473D:G01 | 2566 |
| 1418 | Feb. 24, 1998 | 663 | RTA00000403F.b.12.1 | M00001455D:A06 | 78775 |
| 1419 | Feb. 24, 1998 | 664 | RTA00000404F.a.09.1 | M00001589C:E06 | 38985 |
| 1420 | Feb. 24, 1998 | 665 | RTA00000419F.p.20.1 | M00004039A:C03 | 9458 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1421 | Feb. 24, 1998 | 666 | RTA00000403F.o.19.1 | M00001582D:F02 | 78615 |
| 1422 | Feb. 24, 1998 | 667 | RTA00000405F.h.07.2 | M00001674A:G11 | 4984 |
| 1423 | Feb. 24, 1998 | 668 | RTA00000408F.m.05.2 | M00001530C:G10 | 23384 |
| 1424 | Feb. 24, 1998 | 669 | RTA00000410F.b.10.1 | M00001633C:B09 | 74504 |
| 1425 | Feb. 24, 1998 | 670 | RTA0G000131A.i.6.1 | M00001450A:B08 | 0 |
| 1426 | Feb. 24, 1998 | 671 | RTA00000413F.h.12.1 | M00004107A:A12 | 66929 |
| 1427 | Feb. 24, 1998 | 672 | RTA00000406F.k.14.1 | M00003907C:C02 | 38651 |
| 1428 | Feb. 24, 1998 | 673 | RTA00000406F.d.09.1 | M00003875B:F12 | 38591 |
| 1429 | Feb. 24, 1998 | 674 | RTA00000411F.f.17.1 | M00003814B:F12 | 65661 |
| 1430 | Feb. 24, 1998 | 675 | RTA00000411F.k.10.1 | M00003850D:H11 | 64506 |
| 1431 | Feb. 24, 1998 | 676 | RTA00000411F.g.21.1 | M00003823D:G05 | 64500 |
| 1432 | Feb. 24, 1998 | 677 | RTA00000119A.h.24.1 | M00001457A:C05 | 82266 |
| 1433 | Jan. 28, 1998 | 412 | RTA00000195AF.c.24.1 | M00003860D:H07 | 0 |
| 1433 | Feb. 24, 1998 | 678 | RTA00000195AF.c.24.1 | M00003860D:H07 | 0 |
| 1434 | Feb. 24, 1998 | 679 | RTA00000408F.m.22.2 | M00001539A:C12 | 72949 |
| 1435 | Feb. 24, 1998 | 680 | RTA00000345F.e.11.1 | M00001391C:C04 | 4392 |
| 1436 | Feb. 24, 1998 | 681 | RTA00000120A.c.24.1 | M00001464A:D03 | 34278 |
| 1437 | Feb. 24, 1998 | 682 | RTA00000410F.i.17.1 | M00001641B:B01 | 78147 |
| 1438 | Feb. 24, 1998 | 683 | RTA00000403F.j.21.1 | M00001540D:E02 | 24723 |
| 1439 | Feb. 24, 1998 | 684 | RTA00000339F.k.20.1 | M00001426D:D12 | 6662 |
| 1440 | Feb. 24, 1998 | 685 | RTA00000129A.a.13.2 | M00001582A:A03 | 79780 |
| 1441 | Feb. 24, 1998 | 686 | RTA00000129A.k.21.1 | M00001601A:E12 | 82067 |
| 1442 | Feb. 24, 1998 | 687 | RTA00000350R.g.10.1 | M00001587C:C10 | 9026 |
| 1443 | Feb. 24, 1998 | 688 | RTA00000413F.d.23.1 | M00004090B:H06 | 66030 |
| 1444 | Feb. 24, 1998 | 689 | RTA00000419F.p.03.1 | M00004035A:G10 | 1937 |
| 1445 | Feb. 24, 1998 | 690 | RTA00000341F.b.05.1 | M00003793D:A11 | 0 |
| 1446 | Feb. 24, 1998 | 691 | RTA00000354R.n.08.1 | M00003835A:A09 | 8802 |
| 1447 | Feb. 24, 1998 | 692 | RTA00000411F.d.10.1 | M00001681D:C12 | 76445 |
| 1448 | Feb. 24, 1998 | 693 | RTA00000404F.b.19.1 | M00001592B:A04 | 39281 |
| 1449 | Feb. 24, 1998 | 694 | RTA00000418F.c.07.1 | M00601529D:C05 | 73245 |
| 1450 | Feb. 24, 1998 | 695 | RTA00000418F.j.15.1 | M00001632C:H07 | 74855 |
| 1451 | Feb. 24, 1998 | 696 | RTA00000404F.p.12.2 | M00001653B:C06 | 0 |
| 1452 | Feb. 24, 1998 | 697 | RTA00000412F.d.14.1 | M00003905D:C08 | 76757 |
| 1453 | Feb. 24, 1998 | 698 | RTA00000413F.b.16.1 | M00004078A:E05 | 65126 |
| 1454 | Feb. 24, 1998 | 699 | RTA00000340F.l.05.1 | M00001644B:D06 | 38935 |
| 1455 | Feb. 24, 1998 | 700 | RTA00000350R.m.14.1 | M00001644C:B07 | 39171 |
| 1456 | Feb. 24, 1998 | 701 | RTA00000418F.l.11.1 | M00001641C:H07 | 77158 |
| 1457 | Feb. 24, 1998 | 702 | RTA00000130A.d.5.1 | M00001605A:H03 | 82051 |
| 1458 | Feb. 24, 1998 | 703 | RTA00000339F.n.05.1 | M00001449D:B01 | 39648 |
| 1459 | Feb. 24, 1998 | 704 | RTA00000355R.a.12.1 | M00004159C:F09 | 36756 |
| 1460 | Feb. 24, 1998 | 705 | RTA00000407F.a.23.1 | M00004081C:A10 | 23489 |
| 1461 | Feb. 24, 1998 | 706 | RTA00000403F.a.09.1 | M00001448B:H05 | 77820 |
| 1462 | Feb. 24, 1998 | 707 | RTA00000403F.h.11.1 | M00001483B:D04 | 39219 |
| 1463 | Feb. 24, 1998 | 708 | RTA00000406F.j.13.1 | M00003905B:B08 | 38688 |
| 1464 | Feb. 24, 1998 | 709 | RTA00000352R.p.09.1 | M00004228C:H03 | 16915 |
| 1465 | Feb. 24, 1998 | 710 | RTA00G00413F.g.24.1 | M00004104D:A04 | 65481 |
| 1466 | Feb. 24, 1998 | 711 | RTA00000404F.l.03.2 | M00001636B:G11 | 40272 |
| 1467 | Feb. 24, 1998 | 712 | RTA00000407F.b.18.1 | M00004102C:D09 | 37569 |
| 1468 | Feb. 24, 1998 | 713 | RTA00000414F.b.10.1 | M00005212D:D09 | 0 |
| 1469 | Feb. 24, 1998 | 714 | RTA00000420F.a.08.1 | M00004073A:D10 | 19473 |
| 1470 | Feb. 24, 1998 | 715 | RTA00000418F.b.01.1 | M00001475C:G11 | 76040 |
| 1471 | Feb. 24, 1998 | 716 | RTA00000420F.l.03.2 | M00005217D:F12 | 0 |
| 1472 | Feb. 24, 1998 | 717 | RTA00000404F.i.22.1 | M00001625C:G05 | 39082 |
| 1473 | Feb. 24, 1998 | 718 | RTA00000124A.k.23.1 | M00001538A:D03 | 81350 |
| 1474 | Feb. 24, 1998 | 719 | RTA00000404F.e.11.1 | M00001608C:E11 | 38991 |
| 1475 | Feb. 24, 1998 | 720 | RTA00000129A.d.2.4 | M00001587A:G06 | 80119 |
| 1476 | Feb. 24, 1998 | 721 | RTA00000422F.k.14.1 | M00001649D:A08 | 0 |
| 1477 | Feb. 24, 1998 | 722 | RTA00000411F.l.22.1 | M00003858B:G05 | 64439 |
| 1478 | Feb. 24, 1998 | 723 | RTA00000419F.o.15.1 | M00003989C:D03 | 32487 |
| 1479 | Feb. 24, 1998 | 724 | RTA00000119A.m.17.1 | M00001461A:F05 | 79536 |
| 1480 | Feb. 24, 1998 | 725 | RTA00000410F.b.07.1 | M00001633C:A05 | 78916 |
| 1481 | Feb. 24, 1998 | 726 | RTA00000420F.b.19.1 | M00004088D:A11 | 36873 |
| 1482 | Feb. 24, 1998 | 727 | RTA00000414F.d.02.1 | M00005229B:H06 | 0 |
| 1483 | Feb. 24, 1998 | 728 | RTA00000411F.b.21.1 | M00001677B:A02 | 10051 |
| 1484 | Feb. 24, 1998 | 729 | RTA00000403F.m.20.1 | M00001576A:F11 | 707 |
| 1485 | Feb. 24, 1998 | 730 | RTA00000356R.c.16.1 | M00004294C:C08 | 16915 |
| 1486 | Feb. 24, 1998 | 731 | RTA00000119A.d.17.1 | M00001453A:B01 | 0 |
| 1487 | Feb. 24, 1998 | 732 | RTA00000412F.h.11.1 | M00003974B:B11 | 63175 |
| 1488 | Feb. 24, 1998 | 733 | RTA00000405F.d.18.1 | M00001662C:B02 | 10494 |
| 1489 | Feb. 24, 1998 | 734 | RTA00000414F.e.09.1 | M00005236A:G10 | 0 |
| 1490 | Feb. 24, 1998 | 735 | RTA00000420F.a.11.1 | M00004073C:D04 | 66460 |
| 1491 | Feb. 24, 1998 | 736 | RTA00000120A.c.7.1 | M00001462A:D03 | 80985 |
| 1492 | Feb. 24, 1998 | 737 | RTA00000404F.e.15.1 | M00001609B:C09 | 39101 |
| 1493 | Feb. 24, 1998 | 738 | RTA00000422F.n.20.1 | M00001669B:B12 | 38676 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1494 | Feb. 24, 1998 | 739 | RTA00000423F.h.20.1 | M00003914A:G06 | 38639 |
| 1495 | Feb. 24, 1998 | 740 | RTA00000399F.l.19.1 | M00001590D:G07 | 40145 |
| 1496 | Feb. 24, 1998 | 741 | RTA00000414F.b.12.1 | M00005212D:H01 | 0 |
| 1497 | Feb. 24, 1998 | 742 | RTA00000410F.b.18.1 | M00001633D:H11 | 76701 |
| 1498 | Feb. 24, 1998 | 743 | RTA00000345F.i.08.1 | M00001449D:G10 | 0 |
| 1499 | Feb. 24, 1998 | 744 | RTA00000423F.g.15.1 | M00003905A:F09 | 35173 |
| 1500 | Feb. 24, 1998 | 745 | RTA00000413F.b.04.1 | M00004076D:H07 | 66427 |
| 1501 | Feb. 24, 1998 | 746 | RTA00000345F.e.02.1 | M00001395A:E03 | 0 |
| 1502 | Feb. 24, 1998 | 747 | RTA00000413F.n.24.1 | M00004960C:E10 | 0 |
| 1503 | Feb. 24, 1998 | 748 | RTA00000346F.f.11.1 | M00003793C:D09 | 38528 |
| 1504 | Feb. 24, 1998 | 749 | RTA00000351R.i.13.1 | M00003858D:F12 | 0 |
| 1505 | Feb. 24, 1998 | 750 | RTA00000403F.c.05.1 | M00001456C:C11 | 74935 |
| 1506 | Feb. 24, 1998 | 751 | RTA00000422F.i.02.1 | M00001456C:B12 | 76436 |
| 1507 | Feb. 24, 1998 | 752 | RTA00000410F.a.08.1 | M00001632A:B10 | 73324 |
| 1508 | Feb. 24, 1998 | 753 | RTA00000345F.o.13.1 | M00001546B:F12 | 11500 |
| 1509 | Feb. 24, 1998 | 754 | RTA00000419F.e.02.1 | M00003830C:A03 | 65010 |
| 1510 | Feb. 24, 1998 | 755 | RTA00000423F.d.17.1 | M00001663A:C11 | 20630 |
| 1511 | Feb. 24, 1998 | 756 | RTA00000403F.g.13.1 | M00001481B:D09 | 38718 |
| 1512 | Feb. 24, 1998 | 757 | RTA00000423F.h.13.1 | M00003871A:B09 | 14398 |
| 1513 | Feb. 24, 1998 | 758 | RTA00000407F.a.01.1 | M00004039A:H11 | 12501 |
| 1514 | Feb. 24, 1998 | 759 | RTA00000399F.o.06.1 | M00001595D:G03 | 13574 |
| 1515 | Feb. 24, 1998 | 760 | RTA00000423F.d.04.1 | M00001694A:B12 | 11307 |
| 1516 | Feb. 24, 1998 | 761 | RTA00000411F.f.14.1 | M00003814B:C12 | 62984 |
| 1517 | Feb. 24, 1998 | 762 | RTA00000411F.c.04.1 | M00001677B:E06 | 76858 |
| 1518 | Feb. 24, 1998 | 763 | RTA00000135A.m.18.1 | M00001545A:C03 | 19255 |
| 1519 | Feb. 24, 1998 | 764 | RTA00000413F.c.17.1 | M00004085B:B05 | 36831 |
| 1520 | Feb. 24, 1998 | 765 | RTA00000137A.j.15.4 | M00001559A:C08 | 4213 |
| 1521 | Feb. 24, 1998 | 766 | RTA00000404F.j.01.1 | M00001625D:G10 | 26859 |
| 1522 | Feb. 24, 1998 | 767 | RTA00000138A.p.10.1 | M00001644A:H01 | 81625 |
| 1523 | Feb. 24, 1998 | 768 | RTA00000121A.k.5.1 | M00001507A:E04 | 17530 |
| 1524 | Feb. 24, 1998 | 769 | RTA00000340F.i.10.1 | M00001618A:F10 | 38561 |
| 1525 | Feb. 24, 1998 | 770 | RTA00000421F.f.05.1 | M00001477B:E02 | 5266 |
| 1526 | Feb. 24, 1998 | 771 | RTA00000423F.h.07.1 | M00003911B:F08 | 37933 |
| 1527 | Feb. 24, 1998 | 772 | RTA00000413F.e.04.1 | M00004090C:C07 | 64176 |
| 1528 | Feb. 24, 1998 | 773 | RTA00000406F.h.03.1 | M00003901B:A09 | 38585 |
| 1529 | Feb. 24, 1998 | 774 | RTA00000403F.e.24.1 | M00001476B:D10 | 16432 |
| 1530 | Feb. 24, 1998 | 775 | RTA00000405F.c.22.1 | M00001660C:B06 | 39053 |
| 1531 | Feb. 24, 1998 | 776 | RTA00000403F.i.11.1 | M00001485D:E05 | 23535 |
| 1532 | Feb. 24, 1998 | 777 | RTA00000419F.g.02.1 | M00003842A:A03 | 62839 |
| 1533 | Feb. 24, 1998 | 778 | RTA00000347F.e.05.1 | M00001578D:C04 | 39814 |
| 1534 | Feb. 24, 1998 | 779 | RTA00000408F.l.16.1 | M00001530A:F12 | 73468 |
| 1535 | Feb. 24, 1998 | 780 | RTA00000405F.l.11.1 | M00001693D:E08 | 2055 |
| 1536 | Feb. 24, 1998 | 781 | RTA00000423F.f.09.1 | M00003808C:A05 | 64823 |
| 1537 | Feb. 24, 1998 | 782 | RTA00000419F.k.03.1 | M00003871C:B05 | 40822 |
| 1538 | Feb. 24, 1998 | 783 | RTA00000406F.b.02.1 | M00003867B:G08 | 38744 |
| 1539 | Feb. 24, 1998 | 784 | RTA00000418F.o.14.1 | M00001661B:B05 | 33524 |
| 1540 | Feb. 24, 1998 | 785 | RTA00000404F.l.03.1 | M00001636B:G11 | 40272 |
| 1541 | Feb. 24, 1998 | 786 | RTA00000404F.b.09.1 | M00001591D:C07 | 39166 |
| 1542 | Feb. 24, 1998 | 787 | RTA00000345F.i.24.1 | M00001449C:C05 | 0 |
| 1543 | Feb. 24, 1998 | 788 | RTA00000419F.i.04.1 | M00003860B:F11 | 65791 |
| 1544 | Feb. 24, 1998 | 789 | RTA00000423F.b.13.1 | M00001676C:E07 | 20619 |
| 1545 | Feb. 24, 1998 | 790 | RTA00000345F.n.08.1 | M00001517A:B11 | 0 |
| 1546 | Feb. 24, 1998 | 791 | RTA00000399F.n.15.1 | M00001594D:C03 | 3213 |
| 1547 | Feb. 24, 1998 | 792 | RTA00000406F.k.11.1 | M00003907B:D05 | 38715 |
| 1548 | Feb. 24, 1998 | 793 | RTA00000414F.e.21.1 | M00005257C:G01 | 0 |
| 1549 | Feb. 24, 1998 | 794 | RTA00000406F.c.06.1 | M00003870C:A01 | 37924 |
| 1550 | Feb. 24, 1998 | 795 | RTA00000418F.n.07.1 | M00001658B:A07 | 76316 |
| 1551 | Feb. 24, 1998 | 796 | RTA00000419F.n.15.1 | M00003977D:D04 | 63484 |
| 1552 | Feb. 24, 1998 | 797 | RTA00000408F.n.06.2 | M00001539A:H12 | 76642 |
| 1553 | Feb. 24, 1998 | 798 | RTA00000420F.c.04.1 | M00004089A:B08 | 65007 |
| 1554 | Feb. 24, 1998 | 799 | RTA00000411F.j.15.1 | M00003843A:E04 | 66871 |
| 1555 | Feb. 24, 1998 | 800 | RTA00000403F.m.12.1 | M00001575D:A02 | 16933 |
| 1556 | Feb. 24, 1998 | 801 | RTA00000128A.m.23.1 | M00001561A:D01 | 81441 |
| 1557 | Feb. 24, 1998 | 802 | RTA00000406F.g.03.1 | M00003880B:D11 | 38690 |
| 1558 | Feb. 24, 1998 | 803 | RTA00000405F.h.05.2 | M00001674A:G07 | 75706 |
| 1559 | Feb. 24, 1998 | 804 | RTA00000129A.n.24.1 | M00001604A:C07 | 81409 |
| 1560 | Feb. 24, 1998 | 805 | RTA00000406F.j.08.1 | M00003905B:C06 | 6688 |
| 1561 | Feb. 24, 1998 | 806 | RTA00000345F.f.08.1 | M00001413B:H09 | 0 |
| 1562 | Feb. 24, 1998 | 807 | RTA00000418F.n.11.1 | M00001658D:G12 | 78977 |
| 1563 | Feb. 24, 1998 | 808 | RTA00000418F.p.08.1 | M00001669D:D06 | 73983 |
| 1564 | Feb. 24, 1998 | 809 | RTA00000420F.i.23.1 | M00005134A:D11 | 0 |
| 1565 | Feb. 24, 1998 | 810 | RTA00000120A.h.9.1 | M00001465A:B12 | 80736 |
| 1566 | Feb. 24, 1998 | 811 | RTA00000413F.a.12.1 | M00004072D:F09 | 63403 |
| 1567 | Feb. 24, 1998 | 812 | RTA00000412F.o.05.1 | M00004034A:A01 | 63575 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1568 | Feb. 24, 1998 | 813 | RTA00000346F.o.06.1 | M00004136D:B02 | 4937 |
| 1569 | Feb. 24, 1998 | 814 | RTA00000408F.l.24.1 | M00001530B:G09 | 34263 |
| 1570 | Feb. 24, 1998 | 815 | RTA00000403F.a.17.1 | M00001448D:E12 | 13686 |
| 1571 | Feb. 24, 1998 | 816 | RTA00000354R.n.04.1 | M00003808C:B05 | 22049 |
| 1572 | Feb. 24, 1998 | 817 | RTA00000420F.l.08.2 | M00005228C:C05 | 0 |
| 1573 | Feb. 24, 1998 | 818 | RTA00000406F.h.05.1 | M00003901B:C03 | 38542 |
| 1574 | Feb. 24, 1998 | 819 | RTA00000410F.b.24.1 | M00001633D:D09 | 75104 |
| 1575 | Feb. 24, 1998 | 820 | RTA00000423F.d.11.1 | M00001678C:C06 | 38950 |
| 1576 | Feb. 24, 1998 | 821 | RTA00000420F.h.16.1 | M00004927A:E06 | 0 |
| 1577 | Feb. 24, 1998 | 822 | RTA00000419F.o.21.1 | M00004031A:E01 | 10336 |
| 1578 | Feb. 24, 1998 | 823 | RTA00000119A.k.1.1 | M00001460A:H11 | 81282 |
| 1579 | Feb. 24, 1998 | 824 | RTA00000420F.f.07.1 | M00004119A:C09 | 66312 |
| 1580 | Feb. 24, 1998 | 825 | RTA00000404F.k.22.2 | M00001635D:C12 | 39084 |
| 1581 | Feb. 24, 1998 | 826 | RTA00000422F.e.07.1 | M00001579C:G05 | 38964 |
| 1582 | Feb. 24, 1998 | 827 | RTA00000410F.f.12.1 | M00001637C:E03 | 73883 |
| 1583 | Feb. 24, 1998 | 828 | RTA00000419F.n.05.1 | M00003976C:D06 | 63713 |
| 1584 | Feb. 24, 1998 | 829 | RTA00000411F.m.11.1 | M00003867A:D12 | 73196 |
| 1585 | Feb. 24, 1998 | 830 | RTA00000347F.b.08.1 | M00001541B:E05 | 17591 |
| 1586 | Feb. 24, 1998 | 831 | RTA00000420F.d.21.1 | M00004107B:B04 | 65313 |
| 1587 | Feb. 24, 1998 | 832 | RTA00000403F.o.10.2 | M00001579C:G05 | 38964 |
| 1588 | Feb. 24, 1998 | 833 | RTA00000420F.j.20.1 | M00005140D:C06 | 0 |
| 1589 | Feb. 24, 1998 | 834 | RTA00000407F.b.11.1 | M00004090C:C10 | 0 |
| 1590 | Feb. 24, 1998 | 835 | RTA00000413F.c.10.1 | M00004083B:C01 | 65600 |
| 1591 | Feb. 24, 1998 | 836 | RTA00000411F.b.17.1 | M00001676B:B02 | 72893 |
| 1592 | Feb. 24, 1998 | 837 | RTA00000420F.h.01.1 | M00004897C:D06 | 0 |
| 1593 | Feb. 24, 1998 | 838 | RTA00000408F.k.19.1 | M00001487C:G03 | 77593 |
| 1594 | Feb. 24, 1998 | 839 | RTA00000414F.b.01.1 | M00005212B:A02 | 0 |
| 1595 | Feb. 24, 1998 | 840 | RTA00000420F.b.20.1 | M00004088D:B05 | 0 |
| 1596 | Feb. 24, 1998 | 841 | RTA00000119A.i.8.1 | M00001457A:G12 | 82593 |
| 1597 | Feb. 24, 1998 | 842 | RTA00000401F.n.23.1 | M00003982A:B06 | 1552 |
| 1598 | Feb. 24, 1998 | 843 | RTA00000418F.g.03.1 | M00001579C:E06 | 78737 |
| 1599 | Feb. 24, 1998 | 844 | RTA00000411F.a.09.1 | M00001675C:F01 | 78629 |
| 1600 | Feb. 24, 1998 | 845 | RTA00000348R.b.04.1 | M00001342B:E01 | 1890 |
| 1601 | Feb. 24, 1998 | 846 | RTA00000419F.j.11.1 | M00003868C:C07 | 73183 |
| 1602 | Feb. 24, 1998 | 847 | RTA00000403F.l.11.1 | M00001571D:F05 | 25073 |
| 1603 | Feb. 24, 1998 | 848 | RTA00000404F.n.18.2 | M00001649C:E11 | 37169 |
| 1604 | Feb. 24, 1998 | 849 | RTA00000122A.n.16.1 | M00001517A:G08 | 80553 |
| 1605 | Feb. 24, 1998 | 850 | RTA00000420F.c.07.1 | M00004089A:E02 | 65555 |
| 1606 | Feb. 24, 1998 | 851 | RTA00000423F.d.07.1 | M00001678B:B12 | 0 |
| 1607 | Feb. 24, 1998 | 852 | RTA00000414F.f.03.1 | M00005257D:G07 | 0 |
| 1608 | Feb. 24, 1998 | 853 | RTA00000408F.j.13.2 | M00001485B:D10 | 42275 |
| 1609 | Feb. 24, 1998 | 854 | RTA00000345F.a.07.1 | M00001338C:E10 | 0 |
| 1610 | Feb. 24, 1998 | 855 | RTA00000423F.a.01.1 | M00001659C:F10 | 39103 |
| 1611 | Feb. 24, 1998 | 856 | RTA00000408F.d.02.1 | M00001458D:A01 | 79169 |
| 1612 | Feb. 24, 1998 | 857 | RTA00000404F.e.09.1 | M00001608B:A09 | 39121 |
| 1613 | Feb. 24, 1998 | 858 | RTA00000341F.e.20.1 | M00003891D:B10 | 67422 |
| 1614 | Feb. 24, 1998 | 859 | RTA00000419F.m.22.1 | M00003914A:G09 | 75600 |
| 1615 | Feb. 24, 1998 | 860 | RTA00000419F.m.23.1 | M00003958B:E11 | 64263 |
| 1616 | Feb. 24, 1998 | 861 | RTA00000419F.b.06.1 | M00001694B:B08 | 76728 |
| 1617 | Feb. 24, 1998 | 862 | RTA00000414F.c.07.1 | M00005216A:H01 | 0 |
| 1618 | Feb. 24, 1998 | 863 | RTA00000406F.p.08.1 | M00004032C:B02 | 37573 |
| 1619 | Feb. 24, 1998 | 864 | RTA00000129A.n.17.1 | M00001604A:A09 | 79811 |
| 1620 | Feb. 24, 1998 | 865 | RTA00000414F.c.03.1 | M00005216A:D09 | 0 |
| 1621 | Feb. 24, 1998 | 866 | RTA00000407F.b.08.1 | M00004088D:B03 | 37513 |
| 1622 | Feb. 24, 1998 | 867 | RTA000G0339F.l.21.1 | M00001455D:D11 | 9781 |
| 1623 | Feb. 24, 1998 | 868 | RTA00000406F.i.08.1 | M00003903C:E12 | 37946 |
| 1624 | Feb. 24, 1998 | 869 | RTA00000403F.h.07.1 | M00001482D:H11 | 26856 |
| 1625 | Feb. 24, 1998 | 870 | RTA00000418F.n.24.1 | M00001659D:C09 | 73153 |
| 1626 | Feb. 24, 1998 | 871 | RTA00000403F.f.23.1 | M00001479C:E01 | 39223 |
| 1627 | Feb. 24, 1998 | 872 | RTA00000409F.l.20.1 | M00001615B:G01 | 74394 |
| 1628 | Feb. 24, 1998 | 873 | RTA00000418F.l.06.1 | M00001641C:F01 | 73317 |
| 1629 | Feb. 24, 1998 | 874 | RTA00000346F.o.22.1 | M00004300C:H09 | 7381 |
| 1630 | Feb. 24, 1998 | 875 | RTA00000129A.k.22.1 | M00001601A:E02 | 79639 |
| 1631 | Feb. 24, 1998 | 876 | RTA00000423F.d.16.1 | M00001678D:C11 | 39173 |
| 1632 | Feb. 24, 1998 | 877 | RTA00000418F.m.22.1 | M00001654D:E12 | 74567 |
| 1633 | Feb. 24, 1998 | 878 | RTA00000413F.c.12.1 | M00004083B:G03 | 65334 |
| 1634 | Feb. 24, 1998 | 879 | RTA00000409F.b.19.1 | M00001584D:H02 | 14479 |
| 1635 | Feb. 24, 1998 | 880 | RTA00000418F.g.20.1 | M00001585B:C03 | 74626 |
| 1636 | Feb. 24, 1998 | 881 | RTA00000413F.d.15.1 | M00004088C:E04 | 64943 |
| 1637 | Feb. 24, 1998 | 882 | RTA00000355R.c.03.1 | M00004244C:G07 | 3986 |
| 1638 | Feb. 24, 1998 | 883 | RTA00000406F.c.09.1 | M00003870C:E10 | 5671 |
| 1639 | Feb. 24, 1998 | 884 | RTA00000412F.c.10.1 | M00003903C:C04 | 76372 |
| 1640 | Feb. 24, 1998 | 885 | RTA00000122A.j.17.1 | M00001516A:D02 | 62736 |
| 1641 | Feb. 24, 1998 | 886 | RTA00000420F.m.15.1 | M00005235B:F10 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1642 | Feb. 24, 1998 | 887 | RTA00000339F.p.06.1 | M00001484A:A10 | 4880 |
| 1643 | Feb. 24, 1998 | 888 | RTA00000339R.c.04.1 | M00001362D:H01 | 1805 |
| 1644 | Feb. 24, 1998 | 889 | RTA00000346F.b.16.1 | M00001615C:G05 | 16485 |
| 1645 | Feb. 24, 1998 | 890 | RTA00000418F.j.19.1 | M00001634D:D02 | 78399 |
| 1646 | Feb. 24, 1998 | 891 | RTA00000137A.p.12.1 | M00001587A:B01 | 80614 |
| 1647 | Feb. 24, 1998 | 892 | RTA00000339F.m.17.1 | M00001453B:H12 | 20854 |
| 1648 | Feb. 24, 1998 | 893 | RTA0000041BF.p.10.1 | M00001669D:F05 | 75323 |
| 1649 | Feb. 24, 1998 | 894 | RTA00000408F.k.12.1 | M00001486B:D07 | 77246 |
| 1650 | Feb. 24, 1998 | 895 | RTA00000137A.j.11.4 | M00001559A:A11 | 79752 |
| 1651 | Feb. 24, 1998 | 896 | RTA00000423F.l.20.1 | M00004105C:E09 | 12580 |
| 1652 | Feb. 24, 1998 | 897 | RTA00000419F.n.24.1 | M00003980A:F04 | 65995 |
| 1653 | Feb. 24, 1998 | 898 | RTA00000418F.l.03.1 | M00001641C:C06 | 79058 |
| 1654 | Feb. 24, 1998 | 899 | RTA00000406F.h.10.1 | M00003901C:F09 | 22732 |
| 1655 | Feb. 24, 1998 | 900 | RTA00000419F.m.13.1 | M00003908A:F12 | 79052 |
| 1656 | Feb. 24, 1998 | 901 | RTA00000418F.j.14.1 | M00001632C:B10 | 32623 |
| 1657 | Feb. 24, 1998 | 902 | RTA00000403F.a.10.1 | M00001448C:E11 | 73952 |
| 1658 | Feb. 24, 1998 | 903 | RTA00000420F.a.21.1 | M00004078B:C11 | 66241 |
| 1659 | Feb. 24, 1998 | 904 | RTA00000127A.e.6.1 | M00001553A:E07 | 5885 |
| 1660 | Feb. 24, 1998 | 905 | RTA00000405F.g.21.2 | M00001673B:F07 | 38966 |
| 1661 | Feb. 24, 1998 | 906 | RTA00000405F.g.21.1 | M00001673B:F07 | 38966 |
| 1662 | Feb. 24, 1998 | 907 | RTA00000419F.m.06.1 | M00003906C:D06 | 75749 |
| 1663 | Feb. 24, 1998 | 908 | RTA00000423F.g.03.1 | M00003905C:G11 | 38007 |
| 1664 | Feb. 24, 1998 | 909 | RTA00000420F.i.04.1 | M00004959D:H12 | 0 |
| 1665 | Feb. 24, 1998 | 910 | RTA00000418F.f.03.1 | M00001577B:F10 | 78911 |
| 1666 | Feb. 24, 1998 | 911 | RTA00000406F.p.13.1 | M00004034C:G02 | 8584 |
| 1667 | Feb. 24, 1998 | 912 | RTA00000404F.g.13.1 | M00001614C:E06 | 9436 |
| 1668 | Feb. 24, 1998 | 913 | RTA00000120A.c.20.1 | M00001464C:B07 | 43235 |
| 1669 | Feb. 24, 1998 | 914 | RTA00000138A.m.15.1 | M00001624A:A03 | 41603 |
| 1670 | Feb. 24, 1998 | 915 | RTA00000408F.f.14.2 | M00001476D:F03 | 73024 |
| 1671 | Feb. 24, 1998 | 916 | RTA00000418F.p.20.1 | M00001677D:B07 | 78023 |
| 1672 | Feb. 24, 1998 | 917 | RTA00000423F.e.21.1 | M00003806B:G05 | 66961 |
| 1673 | Feb. 24, 1998 | 918 | RTA00000419F.j.22.1 | M00003871A:A02 | 73525 |
| 1674 | Feb. 24, 1998 | 919 | RTA00000410F.d.18.1 | M00001635D:D05 | 75458 |
| 1675 | Feb. 24, 1998 | 920 | RTA00000403F.b.24.1 | M00001456B:G01 | 78838 |
| 1676 | Feb. 24, 1998 | 921 | RTA00000422F.j.02.1 | M00001594D:B08 | 10368 |
| 1677 | Feb. 24, 1998 | 922 | RTA00000410F.e.09.1 | M00001636A:F08 | 76093 |
| 1678 | Feb. 24, 1998 | 923 | RTA00000126A.d.19.1 | M00001548A:G01 | 79474 |
| 1679 | Feb. 24, 1998 | 924 | RTA00000354R.m.02.1 | M00003890B:C08 | 12766 |
| 1680 | Feb. 24, 1998 | 925 | RTA00000353R.h.10.1 | M00001390C:C11 | 39498 |
| 1681 | Feb. 24, 1998 | 926 | RTA00000399F.k.20.1 | M00001505C:D10 | 3003 |
| 1682 | Feb. 24, 1998 | 927 | RTA00000411F.d.21.1 | M00001692B:E01 | 74794 |
| 1683 | Feb. 24, 1998 | 928 | RTA00000340F.m.04.1 | M00001679B:H07 | 19406 |
| 1684 | Feb. 24, 1998 | 929 | RTA00000411F.n.09.1 | M00003875A:A07 | 78962 |
| 1685 | Feb. 24, 1998 | 930 | RTA00000127A.h.22.2 | M00001554A:E04 | 13155 |
| 1686 | Feb. 24, 1998 | 931 | RTA00000420F.e.09.1 | M00004108D:E07 | 66325 |
| 1687 | Feb. 24, 1998 | 932 | RTA00000405F.p.03.1 | M00003844A:A11 | 11346 |
| 1688 | Feb. 24, 1998 | 933 | RTA00000419F.a.18.1 | M00001680A:B02 | 78484 |
| 1689 | Feb. 24, 1998 | 934 | RTA00000414F.e.01.1 | M00005233D:H07 | 0 |
| 1690 | Feb. 24, 1998 | 935 | RTA00000420F.i.07.1 | M00004960A:B08 | 0 |
| 1691 | Feb. 24, 1998 | 936 | RTA00000121A.n.23.1 | M00001511A:G01 | 26981 |
| 1692 | Feb. 24, 1998 | 937 | RTA00000121A.n.15.1 | M00001511A:G08 | 40849 |
| 1693 | Feb. 24, 1998 | 938 | RTA00000403F.i.23.1 | M00001487B:E10 | 11364 |
| 1694 | Feb. 24, 1998 | 939 | RTA00000405F.a.03.1 | M00001654C:E04 | 39065 |
| 1695 | Feb. 24, 1998 | 940 | RTA00000414F.f.17.1 | M00005260A:F04 | 0 |
| 1696 | Feb. 24, 1998 | 941 | RTA00000419F.p.08.1 | M00004036D:B04 | 65560 |
| 1697 | Feb. 24, 1998 | 942 | RTA00000126A.n.6.2 | M00001551A:D04 | 79917 |
| 1698 | Feb. 24, 1998 | 943 | RTA00000413F.c.03.1 | M00004081D:H09 | 64527 |
| 1699 | Feb. 24, 1998 | 944 | RTA00000422F.k.24.1 | M00001610C:E06 | 39118 |
| 1700 | Feb. 24, 1998 | 945 | RTA00000412F.c.17.1 | M00003905A:A06 | 75620 |
| 1701 | Feb. 24, 1998 | 946 | RTA00000414F.b.07.1 | M00005212C:D02 | 0 |
| 1702 | Feb. 24, 1998 | 947 | RTA00000347F.g.08.1 | M00004096B:F05 | 23121 |
| 1703 | Feb. 24, 1998 | 948 | RTA00000419F.o.06.1 | M00003986C:D09 | 64643 |
| 1704 | Feb. 24, 1998 | 949 | RTA00000340R.j.07.1 | M00001654C:D05 | 38954 |
| 1705 | Feb. 24, 1998 | 950 | RTA00000423F.j.02.1 | M00003903B:C02 | 38617 |
| 1706 | Feb. 24, 1998 | 951 | RTA00000419F.c.04.1 | M00003815C:D12 | 63749 |
| 1707 | Feb. 24, 1998 | 952 | RTA00000411F.a.01.1 | M00001675B:D02 | 74524 |
| 1708 | Feb. 24, 1998 | 953 | RTA00000406F.f.05.1 | M00003878C:F06 | 22961 |
| 1709 | Feb. 24, 1998 | 954 | RTA00000410F.n.05.1 | M00001662A:C07 | 77830 |
| 1710 | Feb. 24, 1998 | 955 | RTA00000404F.e.06.1 | M00001607D:F06 | 39315 |
| 1711 | Feb. 24, 1998 | 956 | RTA00000423F.l.06.1 | M00004062A:H06 | 38136 |
| 1712 | Feb. 24, 1998 | 957 | RTA00000411F.c.03.1 | M00001677B:B06 | 79280 |
| 1713 | Feb. 24, 1998 | 958 | RTA00000195AF.c.8.1 | M00001678B:H01 | 0 |
| 1713 | Jan. 28, 1998 | 520 | RTA00000195AF.c.8.1 | M00001678B:H01 | 0 |
| 1714 | Feb. 24, 1998 | 959 | RTA00000340F.g.20.1 | M00001609D:G10 | 4089 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1715 | Feb. 24, 1998 | 960 | RTA00000404F.l.19.2 | M00001639B:H01 | 16196 |
| 1716 | Feb. 24, 1998 | 961 | RTA00000420F.n.21.2 | M00005259B:D12 | 0 |
| 1717 | Feb. 24, 1998 | 962 | RTA00000404F.p.05.2 | M00001652D:E09 | 1896 |
| 1718 | Feb. 24, 1998 | 963 | RTA00000405F.l.07.1 | M00001693C:E09 | 38636 |
| 1719 | Feb. 24, 1998 | 964 | RTA00000423F.l.15.1 | M00004075B:G09 | 11219 |
| 1720 | Feb. 24, 1998 | 965 | RTA00000411F.n.06.1 | M00003871D:E11 | 73886 |
| 1721 | Feb. 24, 1998 | 966 | RTA00000422F.k.15.1 | M00001594A:G09 | 19253 |
| 1722 | Feb. 24, 1998 | 967 | RTA00000406F.h.16.1 | M00003902B:D06 | 38618 |
| 1723 | Feb. 24, 1998 | 968 | RTA00000419F.f.24.1 | M00003841B:E06 | 18717 |
| 1724 | Feb. 24, 1998 | 969 | RTA00000411F.d.18.1 | M00001692A:G06 | 76063 |
| 1725 | Feb. 24, 1998 | 970 | RTA00000414F.e.15.1 | M00005236B:G03 | 0 |
| 1726 | Feb. 24, 1998 | 971 | RTA00000411F.i.11.1 | M00003837C:E05 | 66849 |
| 1727 | Feb. 24, 1998 | 972 | RTA00000408F.d.15.1 | M00001459B:C1 | 78467 |
| 1728 | Feb. 24, 1998 | 973 | RTA00000339F.b.22.1 | M00001373D:B03 | 6867 |
| 1729 | Feb. 24, 1998 | 974 | RTA00000340F.h.07.1 | M00001608D:D11 | 19254 |
| 1730 | Feb. 24, 1998 | 975 | RTA00000411F.n.02.1 | M00003870B:F04 | 78049 |
| 1731 | Feb. 24, 1998 | 976 | RTA00000419F.b.17.1 | M00003808D:D04 | 63261 |
| 1732 | Feb. 24, 1998 | 977 | RTA00000350R.p.12.1 | M00001657C:C07 | 0 |
| 1733 | Feb. 24, 1998 | 978 | RTA00000130A.e.20.1 | M00001606A:H09 | 79502 |
| 1734 | Feb. 24, 1998 | 979 | RTA00000345F.b.17.1 | M00001362C:H11 | 945 |
| 1735 | Feb. 24, 1998 | 980 | RTA00000411F.i.13.1 | M00003837C:F10 | 66138 |
| 1736 | Feb. 24, 1998 | 981 | RTA00000420F.e.20.1 | M00004110B:A07 | 64762 |
| 1737 | Feb. 24, 1998 | 982 | RTA00000126A.p.23.2 | M00001552A:F06 | 80915 |
| 1738 | Feb. 24, 1998 | 983 | RTA00000423F.f.11.1 | M00003809A:H04 | 0 |
| 1739 | Feb. 24, 1998 | 984 | RTA00000406F.g.08.1 | M00003880C:H03 | 37963 |
| 1740 | Feb. 24, 1998 | 985 | RTA00000409F.a.08.1 | M00001582D:B01 | 74978 |
| 1741 | Feb. 24, 1998 | 986 | RTA00000406F.d.24.1 | M00003876B:C05 | 37997 |
| 1742 | Feb. 24, 1998 | 987 | RTA00000422F.b.22.1 | M00004117B:A12 | 2368 |
| 1743 | Feb. 24, 1998 | 988 | RTA00000407F.a.22.1 | M00004081A:G01 | 15570 |
| 1744 | Feb. 24, 1998 | 989 | RTA00000418F.i.12.1 | M00001592A:E02 | 78971 |
| 1745 | Feb. 24, 1998 | 990 | RTA00000121A.h.19.1 | M00001471A:D04 | 80334 |
| 1746 | Feb. 24, 1998 | 991 | RTA00000419F.b.10.1 | M00001694C:G04 | 78566 |
| 1747 | Feb. 24, 1998 | 992 | RTA00000406F.m.10.1 | M00003914D:B02 | 38004 |
| 1748 | Feb. 24, 1998 | 993 | RTA00000406F.o.05.1 | M00003985B:G04 | 37894 |
| 1749 | Feb. 24, 1998 | 994 | RTA00000408F.b.04.2 | M00001455A:F04 | 39933 |
| 1750 | Feb. 24, 1998 | 995 | RTA00000411F.k.04.1 | M00003850D:A05 | 65407 |
| 1751 | Feb. 24, 1998 | 996 | RTA00000423F.j.03.1 | M00003903B:D03 | 5391 |
| 1752 | Feb. 24, 1998 | 997 | RTA00000134A.l.9.1 | M00001535A:D10 | 81814 |
| 1753 | Feb. 24, 1998 | 998 | RTA00000341F.g.22.1 | M00003914D:D10 | 0 |
| 1754 | Feb. 24, 1998 | 999 | RTA00000418F.k.04.1 | M00001637A:A03 | 75864 |
| 1755 | Feb. 24, 1998 | 1000 | RTA00000351R.j.21.1 | M00003859D:C05 | 31604 |
| 1756 | Feb. 24, 1998 | 1001 | RTA00000413F.p.07.2 | M00005102C:D03 | 0 |
| 1757 | Feb. 24, 1998 | 1002 | RTA00000419F.p.18.1 | M00004038D:G06 | 63002 |
| 1758 | Feb. 24, 1998 | 1003 | RTA00000420F.k.08.2 | M00005176C:C09 | 0 |
| 1759 | Feb. 24, 1998 | 1004 | RTA00000419F.a.24.1 | M00001680B:D02 | 79290 |
| 1760 | Feb. 24, 1998 | 1005 | RTA00000339F.e.17.1 | M00001397D:G08 | 7568 |
| 1761 | Feb. 24, 1998 | 1006 | RTA00000129A.e.14.1 | M00001587A:F08 | 80053 |
| 1762 | Feb. 24, 1998 | 1007 | RTA00000404F.a.01.1 | M00001589B:B08 | 19251 |
| 1763 | Feb. 24, 1998 | 1008 | RTA00000414F.f.07.1 | M00005250C:B05 | 0 |
| 1764 | Feb. 24, 1998 | 1009 | RTA00000399F.o.24.1 | M00001607D:A11 | 2272 |
| 1765 | Feb. 24, 1998 | 1010 | RTA00000408F.n.16.2 | M00001540C:B03 | 73720 |
| 1766 | Feb. 24, 1998 | 1011 | RTA00000400F.c.04.1 | M00001618A:F08 | 6445 |
| 1767 | Feb. 24, 1998 | 1012 | RTA00000403F.g.06.1 | M00001480C:A05 | 10505 |
| 1768 | Feb. 24, 1998 | 1013 | RTA00000404F.b.18.1 | M00001592A:H05 | 13669 |
| 1769 | Feb. 24, 1998 | 1014 | RTA00000412F.l.14.1 | M00004029B:F01 | 62792 |
| 1770 | Feb. 24, 1998 | 1015 | RTA00000129A.b.6.2 | M00001582A:H01 | 39111 |
| 1771 | Feb. 24, 1998 | 1016 | RTA00000406F.n.12.1 | M00003960A:G07 | 37517 |
| 1772 | Feb. 24, 1998 | 1017 | RTA00000418F.e.03.1 | M00001573B:G08 | 73442 |
| 1773 | Feb. 24, 1998 | 1018 | RTA00000413F.j.21.1 | M00004688A:A02 | 0 |
| 1774 | Feb. 24, 1998 | 1019 | RTA00000403F.g.03.1 | M00001479D:G06 | 23537 |
| 1775 | Feb. 24, 1998 | 1020 | RTA00000412F.p.06.1 | M00004038B:H10 | 65485 |
| 1776 | Feb. 24, 1998 | 1021 | RTA00000419F.b.21.1 | M00003809A:F01 | 65366 |
| 1777 | Feb. 24, 1998 | 1022 | RTA00000401F.j.15.1 | M00003901A:C09 | 3061 |
| 1778 | Feb. 24, 1998 | 1023 | RTA00000404F.f.12.1 | M00001611B:A05 | 39209 |
| 1779 | Feb. 24, 1998 | 1024 | RTA00000351R.j.16.1 | M00003857B:F07 | 64773 |
| 1780 | Feb. 24, 1998 | 1025 | RTA00000118A.j.24.1 | M00001450A:B03 | 18 |
| 1781 | Feb. 24, 1998 | 1026 | RTA00000419F.f.18.1 | M00003839D:E11 | 64047 |
| 1782 | Feb. 24, 1998 | 1027 | RTA00000423F.i.16.1 | M00003907D:A12 | 38604 |
| 1783 | Feb. 24, 1998 | 1028 | RTA00000346F.d.12.1 | M00001676B:B09 | 11777 |
| 1784 | Feb. 24, 1998 | 1029 | RTA00000411F.f.04.1 | M00003813A:G04 | 64526 |
| 1785 | Feb. 24, 1998 | 1030 | RTA00000125A.c.17.1 | M00001542A:E04 | 80619 |
| 1786 | Feb. 24, 1998 | 1031 | RTA00000404F.g.08.1 | M00001613D:H10 | 38980 |
| 1787 | Feb. 24, 1998 | 1032 | RTA00000423F.c.13.1 | M00001678A:A11 | 39059 |
| 1788 | Feb. 24, 1998 | 1033 | RTA00000414F.e.19.1 | M00005257C:E05 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1789 | Feb. 24, 1998 | 1034 | RTA00000124A.f.16.3 | M00001536A:F11 | 47430 |
| 1790 | Feb. 24, 1998 | 1035 | RTA00000404F.k.15.1 | M00001634A:B04 | 8225 |
| 1791 | Feb. 24, 1998 | 1036 | RTA00000339F.k.08.1 | M00001439B:A10 | 8133 |
| 1792 | Feb. 24, 1998 | 1037 | RTA00000339F.l.12.1 | M00001450A:G11 | 7711 |
| 1793 | Feb. 24, 1998 | 1038 | RTA00000406F.b.01.1 | M00003867B:G07 | 39006 |
| 1794 | Feb. 24, 1998 | 1039 | RTA00000407F.c.08.1 | M00004118D:B05 | 37549 |
| 1795 | Feb. 24, 1998 | 1040 | RTA00000348R.o.12.1 | M00001433C:F10 | 2263 |
| 1796 | Feb. 24, 1998 | 1041 | RTA00000403F.b.05.1 | M00001455B:E07 | 74300 |
| 1797 | Feb. 24, 1998 | 1042 | RTA00000339F.g.10.1 | M00001400C:D02 | 6327 |
| 1798 | Feb. 24, 1998 | 1043 | RTA00000423F.b.17.1 | M00001662B:F06 | 8200 |
| 1799 | Feb. 24, 1998 | 1044 | RTA00000419F.n.11.1 | M00003977C:B03 | 66477 |
| 1800 | Feb. 24, 1998 | 1045 | RTA00000408F.j.05.2 | M00001483C:G06 | 73878 |
| 1801 | Feb. 24, 1998 | 1046 | RTA00000346F.j.06.1 | M00003879A:A02 | 5767 |
| 1802 | Feb. 24, 1998 | 1047 | RTA00000419F.c.14.1 | M00003819B:G01 | 65727 |
| 1803 | Feb. 24, 1998 | 1048 | RTA00000413F.o.07.2 | M00005100A:C01 | 0 |
| 1804 | Feb. 24, 1998 | 1049 | RTA00000405F.f.05.1 | M00001669C:D09 | 14359 |
| 1805 | Feb. 24, 1998 | 1050 | RTA00000405F.f.05.2 | M00001669C:D09 | 14359 |
| 1806 | Feb. 24, 1998 | 1051 | RTA00000346F.h.24.1 | M00003797A:C11 | 4379 |
| 1807 | Feb. 24, 1998 | 1052 | RTA00000420F.b.02.1 | M00004081A:A08 | 64013 |
| 1808 | Feb. 24, 1998 | 1053 | RTA00000413F.b.24.1 | M00004080A:F01 | 65117 |
| 1809 | Feb. 24, 1998 | 1054 | RTA00000412F.d.08.1 | M00003905C:B02 | 75328 |
| 1810 | Feb. 24, 1998 | 1055 | RTA00000346F.a.04.1 | M00001607B:C05 | 5382 |
| 1811 | Feb. 24, 1998 | 1056 | RTA00000419F.m.18.1 | M00003908C:G09 | 76014 |
| 1812 | Feb. 24, 1998 | 1057 | RTA00000419F.l.24.1 | M00003904D:B10 | 74628 |
| 1813 | Feb. 24, 1998 | 1058 | RTA00000408F.c.06.1 | M00001456D:E08 | 78619 |
| 1814 | Feb. 24, 1998 | 1059 | RTA00000405F.h.21.2 | M00001675C:D12 | 39072 |
| 1815 | Feb. 24, 1998 | 1060 | RTA00000346F.g.02.1 | M00003792A:B10 | 6901 |
| 1816 | Feb. 24, 1998 | 1061 | RTA00000405F.g.05.2 | M00001671D:E10 | 38987 |
| 1817 | Feb. 24, 1998 | 1062 | RTA00000411F.f.20.1 | M00003816C:C01 | 63501 |
| 1818 | Feb. 24, 1998 | 1063 | RTA00000132A.n.7.1 | M00001466A:F08 | 0 |
| 1819 | Feb. 24, 1998 | 1064 | RTA00000420F.d.19.1 | M00004105C:C08 | 43146 |
| 1820 | Jan. 28, 1998 | 595 | RTA00000195R.a.06.1 | M00001394A:E04 | 35265 |
| 1820 | Feb. 24, 1998 | 1065 | RTA00000195R.a.06.1 | M00001394A:E04 | 35265 |
| 1821 | Feb. 24, 1998 | 1066 | RTA00000123A.f.2.1 | M00001531A:H03 | 80379 |
| 1822 | Feb. 24, 1998 | 1067 | RTA00000411F.j.11.1 | M00003841D:F06 | 66154 |
| 1823 | Feb. 24, 1998 | 1068 | RTA00000341F.f.03.1 | M00003850A:F06 | 0 |
| 1824 | Feb. 24, 1998 | 1069 | RTA00000346F.k.05.1 | M00003904C:A08 | 0 |
| 1825 | Feb. 24, 1998 | 1070 | RTA00000346F.n.22.1 | M00004137A:D06 | 0 |
| 1826 | Feb. 24, 1998 | 1071 | RTA00000404F.k.18.2 | M00001635A:C06 | 5475 |
| 1827 | Feb. 24, 1998 | 1072 | RTA00000419F.j.03.1 | M00003868B:G06 | 77578 |
| 1828 | Feb. 24, 1998 | 1073 | RTA00000418F.a.10.1 | M00001475B:C04 | 15245 |
| 1829 | Feb. 24, 1998 | 1074 | RTA00000423F.h.11.1 | M00003867C:E11 | 38977 |
| 1830 | Feb. 24, 1998 | 1075 | RTA00000413F.b.17.1 | M00004078A:F07 | 21704 |
| 1831 | Feb. 24, 1998 | 1076 | RTA00000423F.k.09.1 | M00004035B:H09 | 26630 |
| 1832 | Feb. 24, 1998 | 1077 | RTA00000414F.e.11.1 | M00005236B:A12 | 0 |
| 1833 | Feb. 24, 1998 | 1078 | RTA00000423F.f.03.1 | M00003829C:D10 | 63852 |
| 1834 | Feb. 24, 1998 | 1079 | RTA00000419F.e.10.1 | M00003833B:B03 | 63225 |
| 1835 | Feb. 24, 1998 | 1080 | RTA00000351R.g.06.1 | M00003771D:G05 | 0 |
| 1836 | Feb. 24, 1998 | 1081 | RTA00000403F.d.02.1 | M00001458D:D01 | 39224 |
| 1837 | Feb. 24, 1998 | 1082 | RTA00000137A.o.22.1 | M00001587A:D01 | 0 |
| 1838 | Feb. 24, 1998 | 1083 | RTA00000418F.j.20.1 | M00001634D:D04 | 77101 |
| 1839 | Feb. 24, 1998 | 1084 | RTA00000403F.o.22.2 | M00001583A:D01 | 25076 |
| 1840 | Feb. 24, 1998 | 1085 | RTA00000403F.n.22.1 | M00001578B:B05 | 26775 |
| 1841 | Feb. 24, 1998 | 1086 | RTA00000403F.n.22.2 | M00001578B:B05 | 26775 |
| 1842 | Feb. 24, 1998 | 1087 | RTA00000401F.o.13.1 | M00004040C:A01 | 3220 |
| 1843 | Feb. 24, 1998 | 1088 | RTA00000339R.b.02.1 | M00001344B:F12 | 0 |
| 1844 | Feb. 24, 1998 | 1089 | RTA00000406F.j.21.1 | M00003906A:H07 | 17822 |
| 1845 | Feb. 24, 1998 | 1090 | RTA00000405F.g.22.1 | M00001673C:A02 | 527 |
| 1846 | Feb. 24, 1998 | 1091 | RTA00000356R.h.05.1 | M00004107C:C02 | 35052 |
| 1847 | Feb. 24, 1998 | 1092 | RTA00000125A.c.2.1 | M00001542A:F06 | 40148 |
| 1848 | Feb. 24, 1998 | 1093 | RTA00000340F.i.15.1 | M00001629C:E07 | 26815 |
| 1849 | Feb. 24, 1998 | 1094 | RTA00000405F.h.03.2 | M00001673D:F10 | 20633 |
| 1850 | Feb. 24, 1998 | 1095 | RTA00000345F.c.12.1 | M00001376A:C05 | 23824 |
| 1851 | Feb. 24, 1998 | 1096 | RTA00000421F.a.06.1 | M00001589C:A11 | 2385 |
| 1852 | Feb. 24, 1998 | 1097 | RTA00000412F.o.03.1 | M00004033D:D07 | 65039 |
| 1853 | Feb. 24, 1998 | 1098 | RTA00000409F.d.16.1 | M00001590C:F10 | 76090 |
| 1854 | Feb. 24, 1998 | 1099 | RTA00000400F.m.16.1 | M00001660B:E04 | 3307 |
| 1855 | Feb. 24, 1998 | 1100 | RTA00000414F.a.12.1 | M00005210A:E06 | 0 |
| 1856 | Feb. 24, 1998 | 1101 | RTA00000408F.j.17.2 | M00001485B:H03 | 78935 |
| 1857 | Feb. 24, 1998 | 1102 | RTA00000126A.j.15.2 | M00001549A:H11 | 40425 |
| 1858 | Feb. 24, 1998 | 1103 | RTA00000346F.a.16.1 | M00001593A:B07 | 12082 |
| 1859 | Feb. 24, 1998 | 1104 | RTA00000126A.b.10.1 | M00001547A:F06 | 0 |
| 1860 | Feb. 24, 1998 | 1105 | RTA00000340F.p.18.1 | M00003751C:A04 | 287 |
| 1861 | Feb. 24, 1998 | 1106 | RTA00000410F.b.17.1 | M00001633C:H05 | 77458 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1862 | Feb. 24, 1998 | 1107 | RTA00000419F.l.22.1 | M00003903D:C06 | 78444 |
| 1863 | Feb. 24, 1998 | 1108 | RTA00000346F.c.16.1 | M00001652B:G10 | 9579 |
| 1864 | Feb. 24, 1998 | 1109 | RTA00000422F.f.22.1 | M00001584A:G03 | 38703 |
| 1865 | Feb. 24, 1998 | 1110 | RTA00000404F.j.24.1 | M00001631D:G05 | 39067 |
| 1866 | Feb. 24, 1998 | 1111 | RTA00000406F.m.20.1 | M00003918C:C12 | 38038 |
| 1867 | Feb. 24, 1998 | 1112 | RTA00000418F.c.05.1 | M00001487B:F02 | 76475 |
| 1868 | Feb. 24, 1998 | 1113 | RTA00000418F.p.21.1 | M00001677D:F03 | 78068 |
| 1869 | Feb. 24, 1998 | 1114 | RTA00000340F.f.22.1 | M00001594B:F12 | 1720 |
| 1870 | Feb. 24, 1998 | 1115 | RTA00000340F.i.08.1 | M00001615B:F07 | 12005 |
| 1871 | Feb. 24, 1998 | 1116 | RTA00000410F.o.04.1 | M00001664D:F04 | 79018 |
| 1872 | Feb. 24, 1998 | 1117 | RTA00000411F.l.16.1 | M00003857C:G01 | 16122 |
| 1873 | Feb. 24, 1998 | 1118 | RTA00000411F.j.03.1 | M00003841C:F01 | 66263 |
| 1874 | Feb. 24, 1998 | 1119 | RTA00000126A.k.24.1 | M00001550A:F07 | 39428 |
| 1875 | Feb. 24, 1998 | 1120 | RTA00000353R.l.23.1 | M00001418B:F07 | 12531 |
| 1876 | Feb. 24, 1998 | 1121 | RTA00000120A.m.10.3 | M00001467A:B03 | 81376 |
| 1877 | Feb. 24, 1998 | 1122 | RTA00000419F.f.16.1 | M00003839D:E02 | 64679 |
| 1878 | Feb. 24, 1998 | 1123 | RTA00000408F.c.23.1 | M00001458C:D10 | 42261 |
| 1879 | Feb. 24, 1998 | 1124 | RTA00000123A.h.22.1 | M00001532A:C01 | 17124 |
| 1880 | Feb. 24, 1998 | 1125 | RTA00000118A.n.5.1 | M00001451A:C10 | 0 |
| 1881 | Feb. 24, 1998 | 1126 | RTA00000136A.h.6.1 | M00001550A:D09 | 81620 |
| 1882 | Feb. 24, 1998 | 1127 | RTA00000401F.g.22.1 | M00003871A:G09 | 1147 |
| 1883 | Feb. 24, 1998 | 1128 | RTA00000423F.a.02.3 | M00001656B:A08 | 39210 |
| 1884 | Feb. 24, 1998 | 1129 | RTA00000401F.m.07.1 | M00003907D:F11 | 2893 |
| 1885 | Feb. 24, 1998 | 1130 | RTA00000354R.p.01.1 | M00004104C:H12 | 0 |
| 1886 | Feb. 24, 1998 | 1131 | RTA00000418F.e.20.1 | M00001576C:G05 | 73741 |
| 1887 | Feb. 24, 1998 | 1132 | RTA00000119A.c.12.1 | M00001453A:D08 | 4882 |
| 1888 | Feb. 24, 1998 | 1133 | RTA00000405F.l.03.1 | M00001692D:B01 | 38580 |
| 1889 | Feb. 24, 1998 | 1134 | RTA00000418F.m.02.1 | M00001650A:A12 | 74550 |
| 1890 | Feb. 24, 1998 | 1135 | RTA00000346F.o.16.1 | M00004358D:C02 | 176 |
| 1891 | Feb. 24, 1998 | 1136 | RTA00000406F.c.05.1 | M00003870A:H01 | 22077 |
| 1892 | Feb. 24, 1998 | 1137 | RTA00000345F.d.03.1 | M00001376B:A08 | 19230 |
| 1893 | Feb. 24, 1998 | 1138 | RTA00000411F.k.21.1 | M00003854B:D04 | 65349 |
| 1894 | Feb. 24, 1998 | 1139 | RTA00000404F.h.20.1 | M00001619B:A09 | 15564 |
| 1895 | Feb. 24, 1998 | 1140 | RTA00000339F.c.05.1 | M00001365A:H10 | 3908 |
| 1896 | Feb. 24, 1998 | 1141 | RTA00000347F.f.08.1 | M00003972D:H02 | 5948 |
| 1897 | Feb. 24, 1998 | 1142 | RTA00000418F.i.06.1 | M00001591B:B06 | 75155 |
| 1898 | Feb. 24, 1998 | 1143 | RTA00000423F.a.03.1 | M00001656B:D05 | 26796 |
| 1899 | Feb. 24, 1998 | 1144 | RTA00000345F.j.09.1 | M00001451B:F01 | 13 |
| 1900 | Feb. 24, 1998 | 1145 | RTA00000423F.k.21.2 | M00003984D:B08 | 37499 |
| 1901 | Feb. 24, 1998 | 1146 | RTA00000347F.h.02.1 | M00004072D:H12 | 562 |
| 1902 | Feb. 24, 1998 | 1147 | RTA00000404F.c.18.1 | M00001594A:C01 | 38982 |
| 1903 | Feb. 24, 1998 | 1148 | RTA00000345F.d.23.1 | M00001390D:E03 | 5862 |
| 1904 | Feb. 24, 1998 | 1149 | RTA00000339F.b.02.1 | M00001344B:F12 | 0 |
| 1905 | Feb. 24, 1998 | 1150 | RTA00000411F.g.24.1 | M00003825B:B11 | 65233 |
| 1906 | Feb. 24, 1998 | 1151 | RTA00000405F.g.18.2 | M00001672D:E08 | 5255 |
| 1907 | Feb. 24, 1998 | 1152 | RTA00000405F.m.07.1 | M00003809B:B02 | 37733 |
| 1908 | Feb. 24, 1998 | 1153 | RTA00000411F.j.07.1 | M00003841C:H11 | 66963 |
| 1909 | Feb. 24, 1998 | 1154 | RTA00000403F.m.09.2 | M00001575B:G01 | 26814 |
| 1910 | Feb. 24, 1998 | 1155 | RTA00000353R.h.04.1 | M00001375B:C06 | 17123 |
| 1911 | Feb. 24, 1998 | 1156 | RTA00000408F.f.10.2 | M00001476D:C05 | 75309 |
| 1912 | Feb. 24, 1998 | 1157 | RTA00000422F.m.18.1 | M00001647B:E04 | 23829 |
| 1913 | Feb. 24, 1998 | 1158 | RTA00000405F.o.03.1 | M00003829C:H05 | 37575 |
| 1914 | Feb. 24, 1998 | 1159 | RTA00000413F.b.18.1 | M00004078C:F04 | 39873 |
| 1915 | Feb. 24, 1998 | 1160 | RTA00000400F.g.02.1 | M00001638B:E03 | 1508 |
| 1916 | Feb. 24, 1998 | 1161 | RTA00000346F.m.05.1 | M00003983B:C08 | 5644 |
| 1917 | Feb. 24, 1998 | 1162 | RTA00000408F.c.10.1 | M00001458A:A11 | 18247 |
| 1918 | Feb. 24, 1998 | 1163 | RTA00000341F.b.14.1 | M00003763A:C01 | 5992 |
| 1919 | Feb. 24, 1998 | 1164 | RTA00000405F.m.21.1 | M00003815C:C06 | 24218 |
| 1920 | Feb. 24, 1998 | 1165 | RTA00000408F.c.08.1 | M00001456D:G11 | 73473 |
| 1921 | Feb. 24, 1998 | 1166 | RTA00000347F.h.01.1 | M00004040A:G12 | 12043 |
| 1922 | Feb. 24, 1998 | 1167 | RTA00000410F.c.06.1 | M00001633D:H06 | 77784 |
| 1923 | Feb. 24, 1998 | 1168 | RTA00000421F.b.06.1 | M00001567A:B09 | 2113 |
| 1924 | Feb. 24, 1998 | 1169 | RTA00000405F.b.08.1 | M00001656B:E01 | 39182 |
| 1925 | Feb. 24, 1998 | 1170 | RTA00000409F.l.24.1 | M00001616C:A02 | 73174 |
| 1926 | Feb. 24, 1998 | 1171 | RTA00000406F.j.06.1 | M00003905A:F10 | 38952 |
| 1927 | Feb. 24, 1998 | 1172 | RTA00000423F.h.03.1 | M00003875D:D09 | 37903 |
| 1928 | Feb. 24, 1998 | 1173 | RTA00000339R.b.07.1 | M00001360A:G10 | 6826 |
| 1929 | Feb. 24, 1998 | 1174 | RTA00000121A.k.22.1 | M00001507A:C05 | 79523 |
| 1930 | Feb. 24, 1998 | 1175 | RTA00000414F.b.04.1 | M00005212B:E01 | 0 |
| 1931 | Feb. 24, 1998 | 1176 | RTA00000411F.m.06.1 | M00003858D:G06 | 24195 |
| 1932 | Feb. 24, 1998 | 1177 | RTA00000126A.b.9.1 | M00001547A:F11 | 81279 |
| 1933 | Feb. 24, 1998 | 1178 | RTA00000400F.f.11.1 | M00001636A:E07 | 4088 |
| 1934 | Feb. 24, 1998 | 1179 | RTA00000341F.o.12.1 | M00004144A:F04 | 2883 |
| 1935 | Feb. 24, 1998 | 1180 | RTA00000404F.l.05.1 | M00001636D:F09 | 38671 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 1936 | Feb. 24, 1998 | 1181 | RTA00000346F.f.14.1 | M00003800B:F03 | 16998 |
| 1937 | Feb. 24, 1998 | 1182 | RTA00000346F.d.21.1 | M00001670B:G12 | 6641 |
| 1938 | Feb. 24, 1998 | 1183 | RTA00000346F.j.21.1 | M00003879D:A08 | 3095 |
| 1939 | Feb. 24, 1998 | 1184 | RTA00000345F.h.08.1 | M00001419D:C10 | 11393 |
| 1940 | Feb. 24, 1998 | 1185 | RTA00000413F.b.20.1 | M00004079D:G08 | 66063 |
| 1941 | Feb. 24, 1998 | 1186 | RTA00060419F.p.10.1 | M00004036D:B09 | 41448 |
| 1942 | Feb. 24, 1998 | 1187 | RTA00000120A.c.19.1 | M00001464A:B03 | 81016 |
| 1943 | Feb. 24, 1998 | 1188 | RTA00000341F.o.18.1 | M00004169D:B11 | 37189 |
| 1944 | Feb. 24, 1998 | 1189 | RTA00000339F.o.18.1 | M00001469B:B01 | 6641 |
| 1945 | Feb. 24, 1998 | 1190 | RTA00000405F.g.02.2 | M00001671B:G05 | 10567 |
| 1946 | Feb. 24, 1998 | 1191 | RTA00000340F.i.05.1 | M00001614B:E08 | 0 |
| 1947 | Feb. 24, 1998 | 1192 | RTA00000406F.m.17.1 | M00003918A:F09 | 0 |
| 1948 | Feb. 24, 1998 | 1193 | RTA00000411F.k.14.1 | M00003851A:C10 | 63987 |
| 1949 | Feb. 24, 1998 | 1194 | RTA00000420F.e.05.1 | M00004107D:E12 | 63908 |
| 1950 | Feb. 24, 1998 | 1195 | RTA00000422F.e.23.1 | M00001567D:B03 | 19246 |
| 1951 | Feb. 24, 1998 | 1196 | RTA00000413F.l.18.1 | M00004895D:G07 | 0 |
| 1952 | Feb. 24, 1998 | 1197 | RTA00000128A.j.10.1 | M00001560A:H06 | 80085 |
| 1953 | Feb. 24, 1998 | 1198 | RTA00000412F.f.10.2 | M00003959A:A03 | 65405 |
| 1954 | Feb. 24, 1998 | 1199 | RTA00000401F.j.23.1 | M00003901C:D03 | 570 |
| 1955 | Feb. 24, 1998 | 1200 | RTA00000422F.k.17.1 | M00001652A:A01 | 38955 |
| 1956 | Feb. 24, 1998 | 1201 | RTA00000409F.m.02.1 | M00001616C:A11 | 9157 |
| 1957 | Feb. 24, 1998 | 1202 | RTA00000347F.h.10.1 | M00004206A:E02 | 22779 |
| 1958 | Feb. 24, 1998 | 1203 | RTA00000413F.e.10.1 | M00004092C:B03 | 31033 |
| 1959 | Feb. 24, 1998 | 1204 | RTA00000419F.l.02.1 | M00003879A:C01 | 75736 |
| 1960 | Feb. 24, 1998 | 1205 | RTA00000419F.k.05.1 | M00003871C:E04 | 11757 |
| 1961 | Feb. 24, 1998 | 1206 | RTA00000418F.b.20.1 | M00001484D:G05 | 73560 |
| 1962 | Feb. 24, 1998 | 1207 | RTA00000401F.j.21.1 | M00003901B:F10 | 0 |
| 1963 | Feb. 24, 1998 | 1208 | RTA00000347F.e.24.1 | M00003823B:F07 | 8188 |
| 1964 | Feb. 24, 1998 | 1209 | RTA00000408F.n.05.2 | M00001539A:H02 | 77883 |
| 1965 | Feb. 24, 1998 | 1210 | RTA00000419F.o.09.1 | M00003987B:F08 | 66396 |
| 1966 | Feb. 24, 1998 | 1211 | RTA00000399F.f.14.1 | M00001487D:C11 | 11483 |
| 1967 | Feb. 24, 1998 | 1212 | RTA00000349R.o.03.1 | M00001551D:H07 | 23006 |
| 1968 | Feb. 24, 1998 | 1213 | RTA00000135A.a.23.1 | M00001537A:H05 | 27054 |
| 1969 | Feb. 24, 1998 | 1214 | RTA00000339F.j.07.1 | M00001428D:B10 | 5673 |
| 1970 | Feb. 24, 1998 | 1215 | RTA00000422F.o.08.2 | M00001659D:D03 | 26832 |
| 1971 | Feb. 24, 1998 | 1216 | RTA00000404F.e.07.1 | M00001608A:D03 | 9034 |
| 1972 | Feb. 24, 1998 | 1217 | RTA00000410F.j.17.1 | M00001642D:F02 | 72912 |
| 1973 | Feb. 24, 1998 | 1218 | RTA00000418F.m.18.1 | M00001653B:G10 | 76479 |
| 1974 | Feb. 24, 1998 | 1219 | RTA00000347F.e.20.1 | M00003771B:E05 | 39911 |
| 1975 | Feb. 24, 1998 | 1220 | RTA00000419F.e.23.1 | M00003834B:G04 | 65772 |
| 1976 | Feb. 24, 1998 | 1221 | RTA00000403F.o.17.1 | M00001582D:A02 | 23085 |
| 1977 | Feb. 24, 1998 | 1222 | RTA00000423F.e.13.1 | M00003848A:C09 | 10998 |
| 1978 | Feb. 24, 1998 | 1223 | RTA00000347F.a.14.1 | M00001429D:F11 | 7421 |
| 1979 | Feb. 24, 1998 | 1224 | RTA00000122A.h.24.1 | M00001514A:A12 | 48 |
| 1980 | Feb. 24, 1998 | 1225 | RTA00000346F.j.13.1 | M00003841C:E04 | 5337 |
| 1981 | Feb. 24, 1998 | 1226 | RTA00000414F.c.12.1 | M00005218A:F09 | 0 |
| 1982 | Feb. 24, 1998 | 1227 | RTA00000411F.g.05.1 | M00003822D:B10 | 64664 |
| 1983 | Feb. 24, 1998 | 1228 | RTA00000404F.h.10.1 | M00001618A:A03 | 37148 |
| 1984 | Feb. 24, 1998 | 1229 | RTA00000422F.n.14.1 | M00001642C:G02 | 26787 |
| 1985 | Feb. 24, 1998 | 1230 | RTA00000399F.j.14.1 | M00001578C:F05 | 16942 |
| 1986 | Feb. 24, 1998 | 1231 | RTA00000120A.m.13.3 | M00001467A:C10 | 80608 |
| 1987 | Feb. 24, 1998 | 1232 | RTA00000412F.i.03.1 | M00003975D:C06 | 65617 |
| 1988 | Feb. 24, 1998 | 1233 | RTA00000418F.l.02.1 | M00001641C:C05 | 39316 |
| 1989 | Feb. 24, 1998 | 1234 | RTA00000352R.c.20.1 | M00003982A:B12 | 7339 |
| 1990 | Feb. 24, 1998 | 1235 | RTA00000411F.j.04.1 | M00003841C:F03 | 66219 |
| 1991 | Feb. 24, 1998 | 1236 | RTA00000414F.b.06.1 | M00005212C:C03 | 0 |
| 1992 | Feb. 24, 1998 | 1237 | RTA00000414F.c.24.1 | M00005229B:H04 | 0 |
| 1993 | Feb. 24, 1998 | 1238 | RTA00000420F.g.09.1 | M00004895B:E12 | 0 |
| 1994 | Feb. 24, 1998 | 1239 | RTA00000340F.o.22.1 | M00001673B:B07 | 7356 |
| 1995 | Feb. 24, 1998 | 1240 | RTA00000404F.a.18.1 | M00001590B:B02 | 36267 |
| 1996 | Feb. 24, 1998 | 1241 | RTA00000408F.l.14.1 | M00001530A:E10 | 12001 |
| 1997 | Feb. 24, 1998 | 1242 | RTA00000405F.d.10.1 | M00001661C:F11 | 39000 |
| 1998 | Feb. 24, 1998 | 1243 | RTA00000404F.j.19.1 | M00001630D:H10 | 0 |
| 1999 | Feb. 24, 1998 | 1244 | RTA00000418F.h.23.1 | M00001591A:B05 | 75153 |
| 2000 | Feb. 24, 1998 | 1245 | RTA00000422F.k.22.1 | M00001592C:E05 | 4098 |
| 2001 | Feb. 24, 1998 | 1246 | RTA00000418F.j.11.1 | M00001626C:E04 | 73853 |
| 2002 | Feb. 24, 1998 | 1247 | RTA00000408F.o.13.1 | M00001572A:B05 | 74895 |
| 2003 | Feb. 24, 1998 | 1248 | RTA00000419F.o.07.1 | M00003986C:E09 | 14059 |
| 2004 | Feb. 24, 1998 | 1249 | RTA00000419F.n.17.1 | M00003978D:G04 | 63186 |
| 2005 | Feb. 24, 1998 | 1250 | RTA00000403F.f.15.1 | M00001477D:F10 | 22768 |
| 2006 | Feb. 24, 1998 | 1251 | RTA00000408F.d.03.1 | M00001458D:A02 | 22768 |
| 2007 | Feb. 24, 1998 | 1252 | RTA00000400F.g.08.1 | M00001639A:C11 | 1275 |
| 2008 | Feb. 24, 1998 | 1253 | RTA00000346F.f.02.1 | M00003772C:B12 | 62757 |
| 2009 | Feb. 24, 1998 | 1254 | RTA00000341F.p.11.1 | M00004159C:G12 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2010 | Feb. 24, 1998 | 1255 | RTA00000413F.i.21.1 | M00004118B:B04 | 64066 |
| 2011 | Feb. 24, 1998 | 1256 | RTA00000401F.k.19.1 | M00003903D:D10 | 799 |
| 2012 | Feb. 24, 1998 | 1257 | RTA00000419F.h.21.1 | M00003856C:B08 | 64828 |
| 2013 | Feb. 24, 1998 | 1258 | RTA00000403F.p.05.2 | M00001583D:B08 | 24528 |
| 2014 | Feb. 24, 1998 | 1259 | RTA00000420F.l.19.2 | M00005231A:H04 | 0 |
| 2015 | Feb. 24, 1998 | 1260 | RTA00000422F.f.18.1 | M00001583D:B08 | 24528 |
| 2016 | Feb. 24, 1998 | 1261 | RTA00000404F.m.17.2 | M00001643B:E05 | 0 |
| 2017 | Feb. 24, 1998 | 1262 | RTA0D000122A.h.4.1 | M00001514A:G03 | 33576 |
| 2018 | Feb. 24, 1998 | 1263 | RTA00000341F.i.22.1 | M00003911A:F10 | 7825 |
| 2019 | Feb. 24, 1998 | 1264 | RTA00000345F.e.13.1 | M00001392C:D05 | 4366 |
| 2020 | Feb. 24, 1998 | 1265 | RTA00000340F.d.07.1 | M00001532D:A06 | 0 |
| 2021 | Feb. 24, 1998 | 1266 | RTA00000121A.a.2.1 | M00001468A:H10 | 81843 |
| 2022 | Mar. 24, 1998 | 1 | RTA00000527F.g.13.1 | M00003845D:A04 | 36035 |
| 2023 | Mar. 24, 1998 | 2 | RTA00000523F.d.19.1 | M00003824A:A06 | 26489 |
| 2024 | Mar. 24, 1998 | 3 | RTA00000528F.b.23.1 | M00001479C:F10 | 1605 |
| 2025 | Mar. 24, 1998 | 4 | RTA00000426F.h.11.1 | M00003905B:H05 | 75479 |
| 2026 | Mar. 24, 1998 | 5 | RTA00000426F.p.04.1 | M000040298:H08 | 34149 |
| 2027 | Mar. 24, 1998 | 6 | RTA00000523F.l.10.1 | M00005134B:E01 | 0 |
| 2028 | Mar. 24, 1998 | 7 | RTA00000523F.o.20.1 | M00005177B:H02 | 0 |
| 2029 | Mar. 24, 1998 | 8 | RTA00000428F.b.06.1 | M00005228A:A09 | 0 |
| 2030 | Mar. 24, 1998 | 9 | RTA00000522F.b.22.1 | M00001573B:H12 | 75181 |
| 2031 | Mar. 24, 1998 | 10 | RTA00000527F.f.12.1 | M00003829D:D12 | 5945 |
| 2032 | Mar. 24, 1998 | 11 | RTA00000427F.l.11.1 | M00005139A:F01 | 0 |
| 2033 | Mar. 24, 1998 | 12 | RTA00000522F.a.23.1 | M00001570C:A05 | 38613 |
| 2034 | Mar. 24, 1998 | 13 | RTA00000528F.m.16.1 | M00003845D:C03 | 4468 |
| 2035 | Mar. 24, 1998 | 14 | RTA00000523F.b.02.1 | M00003806C:A06 | 65163 |
| 2036 | Mar. 24, 1998 | 15 | RTA00000425F.j.14.1 | M00001639D:C12 | 73397 |
| 2037 | Mar. 24, 1998 | 16 | RTA00000426F.m.22.1 | M00003983A:G02 | 30002 |
| 2038 | Mar. 24, 1998 | 17 | RTA00000527F.p.06.1 | M00004029B:G10 | 1292 |
| 2039 | Mar. 24, 1998 | 18 | RTA00000522F.e.16.1 | M00001590A:C08 | 75283 |
| 2040 | Mar. 24, 1998 | 19 | RTA00000527F.j.02.2 | M00003856A:B07 | 4896 |
| 2041 | Mar. 24, 1998 | 20 | RTA00000522F.o.06.1 | M00001659D:A09 | 26860 |
| 2042 | Mar. 24, 1998 | 21 | RTA00000523F.h.17.1 | M00003852A:B03 | 65586 |
| 2043 | Mar. 24, 1998 | 22 | RTA00000527F.k.15.1 | M00003982A:G03 | 22688 |
| 2044 | Mar. 24, 1998 | 23 | RTA00000522F.p.07.1 | M00001670A:C11 | 76888 |
| 2045 | Mar. 24, 1998 | 24 | RTA00000522F.n.08.1 | M00001656A:D10 | 76343 |
| 2046 | Mar. 24, 1998 | 25 | RTA00000425F.c.06.1 | M00001585D:D11 | 78041 |
| 2047 | Mar. 24, 1998 | 26 | RTA00000427F.b.23.1 | M00003973D:F08 | 64297 |
| 2048 | Mar. 24, 1998 | 27 | RTA00000527F.p.02.1 | M00004029B:A01 | 36844 |
| 2049 | Mar. 24, 1998 | 28 | RTA00000427F.d.08.1 | M00003980C:E12 | 63967 |
| 2050 | Mar. 24, 1998 | 29 | RTA00000524F.b.03.1 | M00005212A:D10 | 0 |
| 2051 | Mar. 24, 1998 | 30 | RTA00000426F.m.07.1 | M00004028A:G03 | 63504 |
| 2052 | Mar. 24, 1998 | 31 | RTA00000427F.c.10.1 | M00003976B:E06 | 65478 |
| 2053 | Mar. 24, 1998 | 32 | RTA00000424F.n.14.1 | M00001584D:C11 | 73008 |
| 2054 | Mar. 24, 1998 | 33 | RTA00000524F.b.21.1 | M00005216C:B09 | 0 |
| 2055 | Mar. 24, 1998 | 34 | RTA00000424F.m.15.1 | M00001612D:F06 | 73759 |
| 2056 | Mar. 24, 1998 | 35 | RTA00000426F.f.11.1 | M00003823C:B01 | 63102 |
| 2057 | Mar. 24, 1998 | 36 | RTA00000428F.a.16.1 | M00005212D:F08 | 0 |
| 2058 | Mar. 24, 1998 | 37 | RTA00000426F.f.20.1 | M00003854C:F01 | 65134 |
| 2059 | Mar. 24, 1998 | 38 | RTA00000528F.i.22.1 | M00001661D:D05 | 2478 |
| 2060 | Mar. 24, 1998 | 39 | RTA00000527F.c.23.1 | M00003822C:A07 | 37742 |
| 2061 | Mar. 24, 1998 | 40 | RTA00000426F.h.23.1 | M00003911A:D12 | 75964 |
| 2062 | Mar. 24, 1998 | 41 | RTA00000525F.b.17.1 | M00004037B:A04 | 24715 |
| 2063 | Mar. 24, 1998 | 42 | RTA00000527F.i.19.2 | M00003853C:C06 | 38089 |
| 2064 | Mar. 24, 1998 | 43 | RTA00000527F.p.07.1 | M00004029B:B03 | 23343 |
| 2065 | Mar. 24, 1998 | 44 | RTA00000527F.p.17.1 | M00004030C:D12 | 17223 |
| 2066 | Mar. 24, 1998 | 45 | RTA00000528F.m.12.1 | M00003842D:F08 | 5768 |
| 2067 | Mar. 24, 1998 | 46 | RTA00000523F.c.09.1 | M00003813C:D08 | 47389 |
| 2068 | Mar. 24, 1998 | 47 | RTA00000523F.e.18.1 | M00003829D:A11 | 62898 |
| 2069 | Mar. 24, 1998 | 48 | RTA00000527F.k.21.1 | M00003982B:H10 | 36051 |
| 2070 | Mar. 24, 1998 | 49 | RTA00000527F.n.22.1 | M00004027A:A08 | 24175 |
| 2071 | Mar. 24, 1998 | 50 | RTA00000522F.k.15.1 | M00001652D:G06 | 76866 |
| 2072 | Mar. 24, 1998 | 51 | RTA00000522F.n.02.1 | M00001655D:E08 | 74959 |
| 2073 | Mar. 24, 1998 | 52 | RTA00000523F.l.07.1 | M00004927C:H11 | 0 |
| 2074 | Mar. 24, 1998 | 53 | RTA00000525F.c.17.1 | M00004040A:C08 | 38160 |
| 2075 | Mar. 24, 1998 | 54 | RTA00000425F.f.19.1 | M00001653D:G07 | 32635 |
| 2076 | Mar. 24, 1998 | 55 | RTA00000528F.e.23.1 | M00001593B:D10 | 19242 |
| 2077 | Mar. 24, 1998 | 56 | RTA00000522F.n.16.1 | M00001657D:A10 | 26769 |
| 2078 | Mar. 24, 1998 | 57 | RTA00000427F.c.20.1 | M00003978A:E01 | 26527 |
| 2079 | Mar. 24, 1998 | 58 | RTA00000527F.k.06.1 | M00003981B:B12 | 12469 |
| 2080 | Mar. 24, 1998 | 59 | RTA00000427F.n.14.1 | M00004960B:D12 | 0 |
| 2081 | Mar. 24, 1998 | 60 | RTA00000523F.i.06.1 | M00003855A:A01 | 66341 |
| 2082 | Mar. 24, 1998 | 61 | RTA00000427F.f.21.1 | M00004118B:C11 | 36853 |
| 2083 | Mar. 24, 1998 | 62 | RTA00000427F.j.19.1 | M00004077A:G12 | 41395 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2084 | Mar. 24, 1998 | 63 | RTA00000522F.b.01.1 | M00001570C:B02 | 75691 |
| 2085 | Mar. 24, 1998 | 64 | RTA00000424F.j.24.1 | M00001596A:G06 | 79101 |
| 2086 | Mar. 24, 1998 | 65 | RTA00000523F.c.91.1 | M00003810A:A02 | 65710 |
| 2087 | Mar. 24, 1998 | 66 | RTA00000427F.b.15.1 | M00003971C:F09 | 66891 |
| 2088 | Mar. 24, 1998 | 67 | RTA00000527F.e.03.1 | M00003825D:F01 | 25560 |
| 2089 | Mar. 24, 1998 | 68 | RTA00000523F.n.04.1 | M00005138B:D12 | 0 |
| 2090 | Mar. 24, 1998 | 69 | RTA00000522F.j.15.2 | M00001651C:G12 | 76535 |
| 2091 | Mar. 24, 1998 | 70 | RTA00000525F.e.07.1 | M00004115C:G03 | 38147 |
| 2092 | Mar. 24, 1998 | 71 | RTA00000527F.j.20.2 | M00003860D:E06 | 37603 |
| 2093 | Mar. 24, 1998 | 72 | RTA00000426F.f.19.1 | M00003854C:C09 | 66701 |
| 2094 | Mar. 24, 1998 | 73 | RTA00000524F.b.12.1 | M00005213C:G01 | 0 |
| 2095 | Mar. 24, 1998 | 74 | RTA00000527F.d.19.1 | M00003825B:F10 | 486 |
| 2096 | Mar. 24, 1998 | 75 | RTA00000523F.j.22.1 | M00003857A:E12 | 64688 |
| 2097 | Mar. 24, 1998 | 76 | RTA00000523F.l.18.1 | M00005134D:A06 | 0 |
| 2098 | Mar. 24, 1998 | 77 | RTA00000425F.i.17.1 | M00001633A:F11 | 43213 |
| 2099 | Mar. 24, 1998 | 78 | RTA00000427F.o.05.1 | M00004958B:D01 | 0 |
| 2100 | Mar. 24, 1998 | 79 | RTA00000523F.l.15.1 | M00005134C:E11 | 0 |
| 2101 | Mar. 24, 1998 | 80 | RTA00000425F.p.12.1 | M00001638C:G01 | 73219 |
| 2102 | Mar. 24, 1998 | 81 | RTA00000427F.j.07.1 | M00004105A:B10 | 64819 |
| 2103 | Mar. 24, 1998 | 82 | RTA00000523F.h.15.1 | M00003851C:F09 | 65137 |
| 2104 | Mar. 24, 1998 | 83 | RTA00000527F.i.05.2 | M00003851C:B06 | 37481 |
| 2105 | Mar. 24, 1998 | 84 | RTA00000527F.k.18.1 | M00003982B:C10 | 11332 |
| 2106 | Mar. 24, 1998 | 85 | RTA00000427F.m.21.1 | M00004900C:E11 | 0 |
| 2107 | Mar. 24, 1998 | 86 | RTA00000523F.k.01.1 | M00003966C:F03 | 41437 |
| 2108 | Mar. 24, 1998 | 87 | RTA00000425F.j.11.1 | M00001637C:H12 | 76667 |
| 2109 | Mar. 24, 1998 | 88 | RTA00000424F.b.22.4 | M00001530A:F11 | 72971 |
| 2110 | Mar. 24, 1998 | 89 | RTA00000527F.n.02.1 | M00003986C:G11 | 24190 |
| 2111 | Mar. 24, 1998 | 90 | RTA00000525F.a.03.1 | M00004031D:F05 | 36786 |
| 2112 | Mar. 24, 1998 | 91 | RTA00000527F.j.21.2 | M00003855A:F01 | 37490 |
| 2113 | Mar. 24, 1998 | 92 | RTA00000424F.a.24.4 | M00001448D:E11 | 73951 |
| 2114 | Mar. 24, 1998 | 93 | RTA00000522F.k.14.1 | M00001652D:G02 | 74280 |
| 2115 | Mar. 24, 1998 | 94 | RTA00000522F.n.05.1 | M00001655D:H11 | 73260 |
| 2116 | Mar. 24, 1998 | 95 | RTA00000523F.c.18.1 | M00003817C:A10 | 66179 |
| 2117 | Mar. 24, 1998 | 96 | RTA00000523F.b.13.1 | M00003809B:A03 | 66330 |
| 2118 | Mar. 24, 1998 | 97 | RTA00000522F.j.14.2 | M00001651C:D11 | 73123 |
| 2119 | Mar. 24, 1998 | 98 | RTA00000527F.p.16.1 | M00004030C:C02 | 23798 |
| 2120 | Mar. 24, 1998 | 99 | RTA00000425F.c.20.1 | M00001626D:A02 | 73581 |
| 2121 | Mar. 24, 1998 | 100 | RTA00000424F.i.21.1 | M00001596A:E07 | 73482 |
| 2122 | Mar. 24, 1998 | 101 | RTA00000523F.j.19.1 | M00003966B:D02 | 65910 |
| 2123 | Mar. 24, 1998 | 102 | RTA00000522F.g.19.1 | M00001595C:A01 | 78119 |
| 2124 | Mar. 24, 1998 | 103 | RTA00000424F.b.22.1 | M00001530A:F11 | 72971 |
| 2125 | Mar. 24, 1998 | 104 | RTA00000527F.b.18.1 | M00003810D:H09 | 37469 |
| 2126 | Mar. 24, 1998 | 105 | RTA00000526F.d.01.1 | M00004104B:A02 | 4468 |
| 2127 | Mar. 24, 1998 | 106 | RTA00000424F.j.14.1 | M00001592B:B02 | 74311 |
| 2128 | Mar. 24, 1998 | 107 | RTA00000523F.n.20.1 | M00005174D:H02 | 0 |
| 2129 | Mar. 24, 1998 | 108 | RTA00000525F.e.16.1 | M00004117B:G01 | 36837 |
| 2130 | Mar. 24, 1998 | 109 | RTA00000424F.a.01.4 | M00001575A:D05 | 43214 |
| 2131 | Mar. 24, 1998 | 110 | RTA00000522F.d.08.1 | M00001578B:A06 | 74284 |
| 2132 | Mar. 24, 1998 | 111 | RTA00000525F.d.08.1 | M00001631A:F06 | 74350 |
| 2133 | Mar. 24, 1998 | 112 | RTA00000523F.n.12.1 | M00005173C:A02 | 0 |
| 2134 | Mar. 24, 1998 | 113 | RTA00000527F.g.07.1 | M00003840C:C02 | 37488 |
| 2135 | Mar. 24, 1998 | 114 | RTA00000524F.a.23.1 | M00005211C:E09 | 0 |
| 2136 | Mar. 24, 1998 | 115 | RTA00000525F.b.05.1 | M00004034C:F05 | 21116 |
| 2137 | Mar. 24, 1998 | 116 | RTA00000425F.n.05.1 | M00001647D:G07 | 73965 |
| 2138 | Mar. 24, 1998 | 117 | RTA00000523F.d.18.1 | M00003822B:G01 | 64072 |
| 2139 | Mar. 24, 1998 | 118 | RTA00000525F.a.02.1 | M00004031C:H10 | 37454 |
| 2140 | Mar. 24, 1998 | 119 | RTA00000523F.p.06.1 | M00005177D:F09 | 0 |
| 2141 | Mar. 24, 1998 | 120 | RTA00000426F.h.09.1 | M00003905B:G03 | 78797 |
| 2142 | Mar. 24, 1998 | 121 | RTA00000427F.n.02.1 | M00004900D:B10 | 0 |
| 2143 | Mar. 24, 1998 | 122 | RTA00000523F.o.12.1 | M00005177A:B06 | 0 |
| 2144 | Mar. 24, 1998 | 123 | RTA00000427F.g.05.1 | M00004069C:C05 | 63138 |
| 2145 | Mar. 24, 1998 | 124 | RTA00000424F.m.12.1 | M00001586C:H07 | 77675 |
| 2146 | Mar. 24, 1998 | 125 | RTA00000424F.a.01.1 | M00001575A:D05 | 43214 |
| 2147 | Mar. 24, 1998 | 126 | RTA00000527F.m.05.1 | M00003985A:C01 | 17240 |
| 2148 | Mar. 24, 1998 | 127 | RTA00000523F.n.10.1 | M00005140D:G09 | 0 |
| 2149 | Mar. 24, 1998 | 128 | RTA00000428F.c.02.1 | M00005229D:H07 | 0 |
| 2150 | Mar. 24, 1998 | 129 | RTA00000527F.p.18.1 | M00004030D:B06 | 31635 |
| 2151 | Mar. 24, 1998 | 130 | RTA00000427F.h.12.1 | M00004092C:D08 | 36894 |
| 2152 | Mar. 24, 1998 | 131 | RTA00000523F.c.15.1 | M00003813D:G06 | 36935 |
| 2153 | Mar. 24, 1998 | 132 | RTA00000427F.k.17.1 | M00004101A:F07 | 64965 |
| 2154 | Mar. 24, 1998 | 133 | RTA00000425F.f.04.1 | M00001607A:B06 | 24633 |
| 2155 | Mar. 24, 1998 | 134 | RTA00000424F.c.14.3 | M00001476D:A09 | 76614 |
| 2156 | Mar. 24, 1998 | 135 | RTA00000522F.k.10.2 | M00001652D:B09 | 77619 |
| 2157 | Mar. 24, 1998 | 136 | RTA00000424F.m.22.1 | M00001614C:E11 | 72943 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2158 | Mar. 24, 1998 | 137 | RTA00000527F.h.17.1 | M00003848D:G02 | 37799 |
| 2159 | Mar. 24, 1998 | 138 | RTA00000527F.c.22.1 | M00003822B:G12 | 37496 |
| 2160 | Mar. 24, 1998 | 139 | RTA00000425F.k.22.1 | M00001633C:E12 | 78123 |
| 2161 | Mar. 24, 1998 | 140 | RTA00000424F.m.14.1 | M00001612D:D12 | 77491 |
| 2162 | Mar. 24, 1998 | 141 | RTA00000522F.k.19.1 | M00001653A:A05 | 32625 |
| 2163 | Mar. 24, 1998 | 142 | RTA00000523F.i.18.1 | M00003856B:C04 | 64463 |
| 2164 | Mar. 24, 1998 | 143 | RTA00000425F.j.22.1 | M00001633B:E03 | 73882 |
| 2165 | Mar. 24, 1998 | 144 | RTA00000527F.g.23.1 | M00003846C:F08 | 37538 |
| 2166 | Mar. 24, 1998 | 145 | RTA00000426F.m.24.1 | M00003981A:A07 | 63943 |
| 2167 | Mar. 24, 1998 | 146 | RTA00000527F.i.17.2 | M00003853B:C08 | 37539 |
| 2168 | Mar. 24, 1998 | 147 | RTA00000425F.d.21.1 | M00001631B:H04 | 78920 |
| 2169 | Mar. 24, 1998 | 148 | RTA00000427F.n.18.1 | M00004891D:C11 | 0 |
| 2170 | Mar. 24, 1998 | 149 | RTA00000424F.d.04.3 | M00001478A:F12 | 76505 |
| 2171 | Mar. 24, 1998 | 150 | RTA00000424F.d.04.1 | M00001478A:F12 | 76505 |
| 2172 | Mar. 24, 1998 | 151 | RTA00000427F.c.12.1 | M00003976B:H07 | 66995 |
| 2173 | Mar. 24, 1998 | 152 | RTA00000425F.d.07.1 | M00001631A:F12 | 43197 |
| 2174 | Mar. 24, 1998 | 153 | RTA00000527F.l.13.1 | M00003983C:F10 | 36904 |
| 2175 | Mar. 24, 1998 | 154 | RTA00000522F.h.13.1 | M00001596C:F09 | 40823 |
| 2176 | Mar. 24, 1998 | 155 | RTA00000424F.l.19.1 | M00001609C:A12 | 75454 |
| 2177 | Mar. 24, 1998 | 156 | RTA00000525F.b.22.1 | M00004037C:D07 | 16679 |
| 2178 | Mar. 24, 1998 | 157 | RTA00000523F.g.10.1 | M00003848B:E07 | 40694 |
| 2179 | Mar. 24, 1998 | 158 | RTA00000427F.a.06.1 | M00004036A:A11 | 66550 |
| 2180 | Mar. 24, 1998 | 159 | RTA00000525F.c.19.1 | M00004040B:F07 | 38159 |
| 2181 | Mar. 24, 1998 | 160 | RTA00000523F.f.06.1 | M00003833D:H08 | 62871 |
| 2182 | Mar. 24, 1998 | 161 | RTA00000424F.h.10.1 | M00001485C:G06 | 72925 |
| 2183 | Mar. 24, 1998 | 162 | RTA00000522F.a.12.1 | M00001567A:H05 | 33515 |
| 2184 | Mar. 24, 1998 | 163 | RTA00000522F.h.01.1 | M00001595C:E05 | 75010 |
| 2185 | Mar. 24, 1998 | 164 | RTA00000523F.n.17.1 | M00005174D:B02 | 0 |
| 2186 | Mar. 24, 1998 | 165 | RTA00000425F.e.21.1 | M00001629D:D10 | 77203 |
| 2187 | Mar. 24, 1998 | 166 | RTA00000523F.f.07.1 | M00003833D:H10 | 62799 |
| 2188 | Mar. 24, 1998 | 167 | RTA00000424F.i.20.1 | M00001596A:D01 | 44010 |
| 2189 | Mar. 24, 1998 | 168 | RTA00000424F.j.12.1 | M00001594C:E05 | 73827 |
| 2190 | Mar. 24, 1998 | 169 | RTA00000425F.f.05.1 | M00001607A:D10 | 24090 |
| 2191 | Mar. 24, 1998 | 170 | RTA00000523F.d.12.1 | M00003822B:D08 | 64888 |
| 2192 | Mar. 24, 1998 | 171 | RTA00000523F.e.10.1 | M00003829A:F03 | 62878 |
| 2193 | Mar. 24, 1998 | 172 | RTA00000425F.f.11.1 | M00001656C:C04 | 79275 |
| 2194 | Mar. 24, 1998 | 173 | RTA00000426F.m.18.1 | M00003986D:G07 | 62974 |
| 2195 | Mar. 24, 1998 | 174 | RTA00000424F.b.21.4 | M00001530A:B02 | 24686 |
| 2196 | Mar. 24, 1998 | 175 | RTA00000528F.d.18.1 | M00001582C:E01 | 2684 |
| 2197 | Mar. 24, 1998 | 176 | RTA00000522F.g.15.1 | M00001595B:G07 | 76536 |
| 2198 | Mar. 24, 1998 | 177 | RTA00000522F.n.12.1 | M00001656A:H12 | 74117 |
| 2199 | Mar. 24, 1998 | 178 | RTA00000428F.a.12.1 | M00005179B:H02 | 0 |
| 2200 | Mar. 24, 1998 | 179 | RTA00000424F.d.10.3 | M00001530D:A11 | 73110 |
| 2201 | Mar. 24, 1998 | 180 | RTA00000523F.k.02.1 | M00004687A:C03 | 0 |
| 2202 | Mar. 24, 1998 | 181 | RTA00000523F.b.06.1 | M00003808A:F09 | 28736 |
| 2203 | Mar. 24, 1998 | 182 | RTA00000524F.b.17.1 | M00005214B:A06 | 0 |
| 2204 | Mar. 24, 1998 | 183 | RTA00000527F.c.04.1 | M00003813C:H08 | 23090 |
| 2205 | Mar. 24, 1998 | 184 | RTA00000524F.b.18.1 | M00005214B:D11 | 0 |
| 2206 | Mar. 24, 1998 | 185 | RTA00000527F.h.23.1 | M00003850C:G09 | 37630 |
| 2207 | Mar. 24, 1998 | 186 | RTA00000425F.c.07.1 | M00001585D:F03 | 76042 |
| 2208 | Mar. 24, 1998 | 187 | RTA00000428F.b.23.1 | M00005231D:H10 | 0 |
| 2209 | Mar. 24, 1998 | 188 | RTA00000525F.c.15.1 | M00004040A:A07 | 7692 |
| 2210 | Mar. 24, 1998 | 189 | RTA00000424F.d.22.3 | M00001448B:G07 | 76189 |
| 2211 | Mar. 24, 1998 | 190 | RTA00000523F.h.12.1 | M00003851C:D07 | 65745 |
| 2212 | Mar. 24, 1998 | 191 | RTA00000522F.g.22.1 | M00001595C:B12 | 77504 |
| 2213 | Mar. 24, 1998 | 192 | RTA00000523F.m.02.1 | M00005134D:H03 | 0 |
| 2214 | Mar. 24, 1998 | 193 | RTA00000428F.b.12.1 | M00005231C:B07 | 0 |
| 2215 | Mar. 24, 1998 | 194 | RTA00000522F.j.12.2 | M00001651C:A04 | 74341 |
| 2216 | Mar. 24, 1998 | 195 | RTA00000523F.i.08.1 | M00003855A:C12 | 65099 |
| 2217 | Mar. 24, 1998 | 196 | RTA00000523F.f.12.1 | M00003840A:C10 | 63751 |
| 2218 | Mar. 24, 1998 | 197 | RTA00000425F.j.20.1 | M00001633B:A12 | 26760 |
| 2219 | Mar. 24, 1998 | 198 | RTA00000523F.o.05.1 | M00005175B:H04 | 0 |
| 2220 | Mar. 24, 1998 | 199 | RTA00000427F.f.24.1 | M00004076D:B09 | 64572 |
| 2221 | Mar. 24, 1998 | 200 | RTA00000527F.a.13.1 | M00003805D:E06 | 37740 |
| 2222 | Mar. 24, 1998 | 201 | RTA00000427F.n.17.1 | M00004891D:A07 | 0 |
| 2223 | Mar. 24, 1998 | 202 | RTA00000528F.j.11.1 | M00001669B:C12 | 1070 |
| 2224 | Mar. 24, 1998 | 203 | RTA00000427F.p.10.2 | M00005102C:F09 | 0 |
| 2225 | Mar. 24, 1998 | 204 | RTA00000424F.a.09.4 | M00001575C:C11 | 77833 |
| 2226 | Mar. 24, 1998 | 205 | RTA00000426F.h.12.1 | M00003905C:F12 | 78093 |
| 2227 | Mar. 24, 1998 | 206 | RTA00000525F.f.07.1 | M00004119A:A06 | 37500 |
| 2228 | Mar. 24, 1998 | 207 | RTA00000424F.j.07.1 | M00001596B:C11 | 79211 |
| 2229 | Mar. 24, 1998 | 208 | RTA00000424F.m.10.1 | M00001586C:E06 | 34251 |
| 2230 | Mar. 24, 1998 | 209 | RTA00000427F.g.16.1 | M00004069A:E12 | 63011 |
| 2231 | Mar. 24, 1998 | 210 | RTA00000522F.g.06.1 | M00001594D:G11 | 78221 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2232 | Mar. 24, 1998 | 211 | RTA00000424F.h.03.1 | M00001487C:G09 | 74447 |
| 2233 | Mar. 24, 1998 | 212 | RTA00000424F.n.06.1 | M00001613A:D02 | 74737 |
| 2234 | Mar. 24, 1998 | 213 | RTA00000427F.c.22.1 | M00003978A:E09 | 63990 |
| 2235 | Mar. 24, 1998 | 214 | RTA00000424F.k.12.1 | M00001610C:B07 | 77666 |
| 2236 | Mar. 24, 1998 | 215 | RTA00000425F.f.02.1 | M00001607A:A01 | 76982 |
| 2237 | Mar. 24, 1998 | 216 | RTA00000427F.h.11.1 | M00004092C:B12 | 26494 |
| 2238 | Mar. 24, 1998 | 217 | RTA00000425F.j.16.1 | M00001639D:F02 | 75631 |
| 2239 | Mar. 24, 1998 | 218 | RTA00000427F.i.19.1 | M00004102C:D01 | 64206 |
| 2240 | Mar. 24, 1998 | 219 | RTA00000427F.f.17.1 | M00004115A:B12 | 63803 |
| 2241 | Mar. 24, 1998 | 220 | RTA00000522F.o.18.1 | M00001669B:H06 | 76366 |
| 2242 | Mar. 24, 1998 | 221 | RTA00000427F.j.22.1 | M00004097D:B05 | 66367 |
| 2243 | Mar. 24, 1998 | 222 | RTA00000426F.p.10.1 | M00004033D:C05 | 65845 |
| 2244 | Mar. 24, 1998 | 223 | RTA00000522F.m.02.1 | M00001654C:G07 | 76834 |
| 2245 | Mar. 24, 1998 | 224 | RTA00000527F.k.09.1 | M00003981C:F05 | 213 |
| 2246 | Mar. 24, 1998 | 225 | RTA00000527F.d.09.1 | M00003824A:G11 | 10848 |
| 2247 | Mar. 24, 1998 | 226 | RTA00000425F.e.15.1 | M00001608D:F11 | 75921 |
| 2248 | Mar. 24, 1998 | 227 | RTA00000427F.j.11.1 | M00004097C:H08 | 26635 |
| 2249 | Mar. 24, 1998 | 228 | RTA00000523F.o.14.1 | M00005177A:H09 | 0 |
| 2250 | Mar. 24, 1998 | 229 | RTA00000424F.n.13.1 | M00001584D:B06 | 74942 |
| 2251 | Mar. 24, 1998 | 230 | RTA00000424F.g.14.1 | M00001572A:B06 | 74879 |
| 2252 | Mar. 24, 1998 | 231 | RTA00000426F.e.17.1 | M00003810C:B06 | 64089 |
| 2253 | Mar. 24, 1998 | 232 | RTA00000527F.j.13.2 | M00003852B:G04 | 2924 |
| 2254 | Mar. 24, 1998 | 233 | RTA00000426F.f.13.1 | M00003851A:A06 | 65384 |
| 2255 | Mar. 24, 1998 | 234 | RTA00000524F.c.16.1 | M00005218D:G10 | 0 |
| 2256 | Mar. 24, 1998 | 235 | RTA00000427F.g.19.1 | M00004087A:B05 | 64611 |
| 2257 | Mar. 24, 1998 | 236 | RTA00000527F.o.01.1 | M00004027A:D06 | 19088 |
| 2258 | Mar. 24, 1998 | 237 | RTA00000522F.c.01.1 | M00001576A:C11 | 74938 |
| 2259 | Mar. 24, 1998 | 238 | RTA00000522F.g.17.1 | M00001595B:G10 | 76486 |
| 2260 | Mar. 24, 1998 | 239 | RTA00000523F.j.17.1 | M00003966B:A04 | 63610 |
| 2261 | Mar. 24, 1998 | 240 | RTA00000522F.n.14.1 | M00001657C:C11 | 73410 |
| 2262 | Mar. 24, 1998 | 241 | RTA00000527F.o.12.1 | M00004028B:G08 | 688 |
| 2263 | Mar. 24, 1998 | 242 | RTA00000523F.e.20.1 | M00003829D:F03 | 65164 |
| 2264 | Mar. 24, 1998 | 243 | RTA00000424F.c.15.3 | M00001476D:F12 | 73533 |
| 2265 | Mar. 24, 1998 | 244 | RTA00000426F.p.09.1 | M00004033D:B07 | 66665 |
| 2266 | Mar. 24, 1998 | 245 | RTA00000522F.p.09.1 | M00001670A:F09 | 75204 |
| 2267 | Mar. 24, 1998 | 246 | RTA00000426F.m.21.1 | M00003983A:F06 | 64915 |
| 2268 | Mar. 24, 1998 | 247 | RTA00000425F.j.21.1 | M00001633B:B11 | 77373 |
| 2269 | Mar. 24, 1998 | 248 | RTA00000527F.l.14.1 | M00003983D:A09 | 14935 |
| 2270 | Mar. 24, 1998 | 249 | RTA00000523F.h.21.1 | M00003853B:C10 | 41440 |
| 2271 | Mar. 24, 1998 | 250 | RTA00000427F.h.24.1 | M00004091B:H09 | 65193 |
| 2272 | Mar. 24, 1998 | 251 | RTA00000425F.f.24.1 | M00001656D:C04 | 40841 |
| 2273 | Mar. 24, 1998 | 252 | RTA00000425F.m.03.1 | M00001642D:G08 | 76045 |
| 2274 | Mar. 24, 1998 | 253 | RTA00000426F.m.08.1 | M00004030B:A12 | 63781 |
| 2275 | Mar. 24, 1998 | 254 | RTA00000523F.d.24.1 | M00003824D:D08 | 64799 |
| 2276 | Mar. 24, 1998 | 255 | RTA00000523F.c.14.1 | M00003813D:C02 | 66015 |
| 2277 | Mar. 24, 1998 | 256 | RTA00000523F.b.20.1 | M00003809C:H07 | 66492 |
| 2278 | Mar. 24, 1998 | 257 | RTA00000522F.h.07.1 | M00001595D:C11 | 75149 |
| 2279 | Mar. 24, 1998 | 258 | RTA00000527F.g.10.1 | M00003845A:E12 | 37820 |
| 2280 | Mar. 24, 1998 | 259 | RTA00000528F.m.04.1 | M00003830D:H11 | 10815 |
| 2281 | Mar. 24, 1998 | 260 | RTA00000524F.b.02.1 | M00005212A:A02 | 0 |
| 2282 | Mar. 24, 1998 | 261 | RTA00000427F.i.22.1 | M00004104D:B05 | 63199 |
| 2283 | Mar. 24, 1998 | 262 | RTA00000424F.k.03.1 | M00001590D:B04 | 21289 |
| 2284 | Mar. 24, 1998 | 263 | RTA00000527F.n.07.1 | M00003986D:H12 | 15939 |
| 2285 | Mar. 24, 1998 | 264 | RTA00000425F.e.09.1 | M00001608C:G04 | 75550 |
| 2286 | Mar. 24, 1998 | 265 | RTA00000427F.h.02.1 | M00004085B:G01 | 63652 |
| 2287 | Mar. 24, 1998 | 266 | RTA00000426F.f.16.1 | M00003813B:F02 | 65613 |
| 2288 | Mar. 24, 1998 | 267 | RTA00000425F.i.21.1 | M00001635B:B02 | 75305 |
| 2289 | Mar. 24, 1998 | 268 | RTA00000427F.k.19.1 | M00004103B:B07 | 62851 |
| 2290 | Mar. 24, 1998 | 269 | RTA00000427F.p.02.2 | M00005100B:D02 | 0 |
| 2291 | Mar. 24, 1998 | 270 | RTA00000426F.g.16.1 | M00003814B:C01 | 41446 |
| 2292 | Mar. 24, 1998 | 271 | RTA00000527F.l.05.1 | M00003983A:D02 | 13016 |
| 2293 | Mar. 24, 1998 | 272 | RTA00000426F.m.02.1 | M00004034C:C06 | 66237 |
| 2294 | Mar. 24, 1998 | 273 | RTA00000424F.a.02.4 | M00001575A:D06 | 78806 |
| 2295 | Mar. 24, 1998 | 274 | RTA00000523F.h.06.1 | M00003851B:D03 | 28745 |
| 2296 | Mar. 24, 1998 | 275 | RTA00000522F.l.22.1 | M00001654C:D10 | 75801 |
| 2297 | Mar. 24, 1998 | 276 | RTA00000427F.h.19.1 | M00004092D:B11 | 63047 |
| 2298 | Mar. 24, 1998 | 277 | RTA00000427F.e.08.1 | M00003974D:E01 | 47387 |
| 2299 | Mar. 24, 1998 | 278 | RTA00000522F.g.21.1 | M00001595C:A09 | 77310 |
| 2300 | Mar. 24, 1998 | 279 | RTA00000528F.b.03.1 | M00001455A:D10 | 2078 |
| 2301 | Mar. 24, 1998 | 280 | RTA00000522F.g.20.1 | M00001595C:A05 | 77688 |
| 2302 | Mar. 24, 1998 | 281 | RTA00000527F.k.20.1 | M00003982B:H07 | 17148 |
| 2303 | Mar. 24, 1998 | 282 | RTA00000427F.h.22.1 | M00004108C:E01 | 64547 |
| 2304 | Mar. 24, 1998 | 283 | RTA00000425F.k.20.1 | M00001633C:A08 | 74048 |
| 2305 | Mar. 24, 1998 | 284 | RTA00000524F.b.19.1 | M00005216B:D02 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2306 | Mar. 24, 1998 | 285 | RTA00000522F.b.07.1 | M00001570D:E05 | 78634 |
| 2307 | Mar. 24, 1998 | 286 | RTA00000426F.g.19.1 | M00003858B:G02 | 63672 |
| 2308 | Mar. 24, 1998 | 287 | RTA00000525F.d.19.1 | M00004114B:D09 | 36860 |
| 2309 | Mar. 24, 1998 | 288 | RTA00000427F.l.04.1 | M00005136D:C01 | 0 |
| 2310 | Mar. 24, 1998 | 289 | RTA00000427F.d.10.1 | M00003978C:A12 | 40685 |
| 2311 | Mar. 24, 1998 | 290 | RTA00000427F.l.03.1 | M00005136D:B07 | 0 |
| 2312 | Mar. 24, 1998 | 291 | RTA00000523F.o.23.1 | M00005177C:G04 | 0 |
| 2313 | Mar. 24, 1998 | 292 | RTA00000424F.a.05.4 | M00001575B:C0: | 77976 |
| 2314 | Mar. 24, 1998 | 293 | RTA00000525F.c.02.1 | M00004038A:E05 | 14618 |
| 2315 | Mar. 24, 1998 | 294 | RTA00000424F.a.05.1 | M00001575B:C01 | 77976 |
| 2316 | Mar. 24, 1998 | 295 | RTA00000522F.l.15.1 | M00001654B:A01 | 74691 |
| 2317 | Mar. 24, 1998 | 296 | RTA00000425F.e.02.1 | M00001625C:F10 | 76143 |
| 2318 | Mar. 24, 1998 | 297 | RTA00000525F.c.11.1 | M00004039C:E02 | 37895 |
| 2319 | Mar. 24, 1998 | 298 | RTA00000527F.e.08.1 | M00003826B:B04 | 19015 |
| 2320 | Mar. 24, 1998 | 299 | RTA00000522F.c.14.1 | M00001577A:A03 | 75449 |
| 2321 | Mar. 24, 1998 | 300 | RTA00000424F.m.08.1 | M00001584A:A07 | 19402 |
| 2322 | Mar. 24, 1998 | 301 | RTA00000527F.f.18.1 | M00003830D:B11 | 37577 |
| 2323 | Mar. 24, 1998 | 302 | RTA00000427F.p.04.2 | M00005100B:H07 | 0 |
| 2324 | Mar. 24, 1998 | 303 | RTA00000522F.a.06.1 | M00001567A:C11 | 73662 |
| 2325 | Mar. 24, 1998 | 304 | RTA00000525F.d.13.1 | M00004110C:E03 | 349 |
| 2326 | Mar. 24, 1998 | 305 | RTA00000523F.n.16.1 | M00005173D:H02 | 0 |
| 2327 | Mar. 24, 1998 | 306 | RTA00000522F.d.23.1 | M00001579D:F02 | 73868 |
| 2328 | Mar. 24, 1998 | 307 | RTA00000427F.p.03.2 | M00005100B:G11 | 0 |
| 2329 | Mar. 24, 1998 | 308 | RTA00000424F.k.23.1 | M00001614A:B10 | 31061 |
| 2330 | Mar. 24, 1998 | 309 | RTA00000523F.j.10.1 | M00003860B:G09 | 63384 |
| 2331 | Mar. 24, 1998 | 310 | RTA00000527F.p.08.1 | M00004029C:F02 | 36013 |
| 2332 | Mar. 24, 1998 | 311 | RTA00000428F.b.02.1 | M00005214D:D10 | 0 |
| 2333 | Mar. 24, 1998 | 312 | RTA00000426F.f.17.1 | M00003811C:C02 | 66334 |
| 2334 | Mar. 24, 1998 | 313 | RTA00000523F.j.21.1 | M00003966C:A12 | 36925 |
| 2335 | Mar. 24, 1998 | 314 | RTA00000522F.e.09.1 | M00001589D:A01 | 32599 |
| 2336 | Mar. 24, 1998 | 315 | RTA00000427F.n.19.1 | M00004891D:E07 | 0 |
| 2337 | Mar. 24, 1998 | 316 | RTA00000523F.h.16.1 | M00003851D:H11 | 66031 |
| 2338 | Mar. 24, 1998 | 317 | RTA00000428F.a.01.1 | M00004897D:G05 | 0 |
| 2339 | Mar. 24, 1998 | 318 | RTA00000523F.a.01.1 | M00001671C:F11 | 74923 |
| 2340 | Mar. 24, 1998 | 319 | RTA00000523F.p.15.1 | M00005178B:H01 | 0 |
| 2341 | Mar. 24, 1998 | 320 | RTA00000427F.j.06.1 | M00004102D:B05 | 63676 |
| 2342 | Mar. 24, 1998 | 321 | RTA00000424F.m.04.1 | M00001609C:G05 | 79017 |
| 2343 | Mar. 24, 1998 | 322 | RTA00000523F.i.17.1 | M00003856B:A12 | 65779 |
| 2344 | Mar. 24, 1998 | 323 | RTA00000524F.c.12.1 | M00005218B:D09 | 0 |
| 2345 | Mar. 24, 1998 | 324 | RTA00000523F.o.09.1 | M00005176A:C12 | 0 |
| 2346 | Mar. 24, 1998 | 325 | RTA00000525F.c.18.1 | M00004040B:C05 | 24208 |
| 2347 | Mar. 24, 1998 | 326 | RTA00000527F.e.09.1 | M00003826B:E11 | 37521 |
| 2348 | Mar. 24, 1998 | 327 | RTA00000424F.j.08.1 | M00001596B:D09 | 73972 |
| 2349 | Mar. 24, 1998 | 328 | RTA00000523F.n.01.1 | M00005137A:E01 | 0 |
| 2350 | Mar. 24, 1998 | 329 | RTA00000527F.c.09.1 | M00003817C:G06 | 64859 |
| 2351 | Mar. 24, 1998 | 330 | RTA00000523F.d.23.1 | M00003824C:A10 | 63633 |
| 2352 | Mar. 24, 1998 | 331 | RTA00000528F.k.10.1 | M00001678C:F09 | 1981 |
| 2353 | Mar. 24, 1998 | 332 | RTA00000523F.c.03.1 | M00003810B:B11 | 36913 |
| 2354 | Mar. 24, 1998 | 333 | RTA00000427F.k.21.1 | M00004090D:F12 | 62880 |
| 2355 | Mar. 24, 1998 | 334 | RTA00000427F.n.1.1 | M00004960B:A09 | 0 |
| 2356 | Mar. 24, 1998 | 335 | RTA00000427F.d.09.1 | M00003980C:F12 | 66486 |
| 2357 | Mar. 24, 1998 | 336 | RTA00000426F.n.17.1 | M00004039D:B10 | 66572 |
| 2358 | Mar. 24, 1998 | 337 | RTA00000525F.e.08.1 | M00004115C:H04 | 24193 |
| 2359 | Mar. 24, 1998 | 338 | RTA00000523F.e.15.1 | M00003829C:E08 | 7919 |
| 2360 | Mar. 24, 1998 | 339 | RTA00000426F.m.03.1 | M00004034C:E08 | 66480 |
| 2361 | Mar. 24, 1998 | 340 | RTA00000424F.h.06.1 | M00001485C:D07 | 77552 |
| 2362 | Mar. 24, 1998 | 341 | RTA00000425F.d.06.1 | M00001631A:D03 | 77660 |
| 2363 | Mar. 24, 1998 | 342 | RTA00000427F.e.12.1 | M00003959C:G06 | 62813 |
| 2364 | Mar. 24, 1998 | 343 | RTA00000527F.c.11.1 | M00003817D:D12 | 37484 |
| 2365 | Mar. 24, 1998 | 344 | RTA00000425F.p.15.1 | M00001638C:R07 | 31680 |
| 2366 | Mar. 24, 1998 | 345 | RTA00000426F.n.23.1 | M00004030C:A08 | 18176 |
| 2367 | Mar. 24, 1998 | 346 | RTA00000522F.m.19.1 | M00001655C:C07 | 41544 |
| 2368 | Mar. 24, 1998 | 347 | RTA00000522F.a.05.1 | M00001567A:C04 | 32611 |
| 2369 | Mar. 24, 1998 | 348 | RTA00000427F.i.09.1 | M00004097C:E03 | 65916 |
| 2370 | Mar. 24, 1998 | 349 | RTA00000424F.j.09.1 | M00001596B:H05 | 74387 |
| 2371 | Mar. 24, 1998 | 350 | RTA00000424F.n.11.1 | M00001582C:C04 | 73874 |
| 2372 | Mar. 24, 1998 | 351 | RTA00000523F.l.03.1 | M00004927A:A02 | 0 |
| 2373 | Mar. 24, 1998 | 352 | RTA00000527F.e.13.1 | M00003826C:F05 | 37588 |
| 2374 | Mar. 24, 1998 | 353 | RTA00000428F.a.18.1 | M00005214C:A09 | 0 |
| 2375 | Mar. 24, 1998 | 354 | RTA00000425F.j.19.1 | M00001639D:006 | 77925 |
| 2376 | Mar. 24, 1998 | 355 | RTA00000522F.g.12.1 | M00001595A:E07 | 78783 |
| 2377 | Mar. 24, 1998 | 356 | RTA00000523F.g.07.1 | M00001693A:H06 | 75804 |
| 2378 | Mar. 24, 1998 | 357 | RTA00000425F.e.19.1 | M00001629D:B10 | 73409 |
| 2379 | Mar. 24, 1998 | 358 | RTA00000425F.n.19.1 | M00001638B:C08 | 78324 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2380 | Mar. 24, 1998 | 359 | RTA00000523F.d.21.1 | M00003824B:C09 | 33424 |
| 2381 | Mar. 24, 1998 | 360 | RTA00000521F.j.03.1 | M00003860A:A08 | 64535 |
| 2382 | Mar. 24, 1998 | 361 | RTA00000523F.p.08.1 | M00005178A:A07 | 0 |
| 2383 | Mar. 24, 1998 | 362 | RTA00000523F.p.09.1 | M00005178A:A08 | 0 |
| 2384 | Mar. 24, 1998 | 363 | RTA00000427F.k.07.1 | M00004099A:F11 | 63742 |
| 2385 | Mar. 24, 1998 | 364 | RTA00000523F.m.07.1 | M00005136A:D10 | 0 |
| 2386 | Mar. 24, 1998 | 365 | RTA00000527F.k.16.1 | M00003982B:B06 | 1015 |
| 2387 | Mar. 24, 1998 | 366 | RTA00000522F.a.17.1 | M00001567C:B08 | 79032 |
| 2388 | Mar. 24, 1998 | 361 | RTA00000527F.l.19.1 | M00003983D:E08 | 36856 |
| 2389 | Mar. 24, 1998 | 368 | RTA00000424F.i.11.1 | M00001485D:A05 | 41569 |
| 2390 | Mar. 24, 1998 | 369 | RTA00000524F.c.08.1 | M00005217C:C01 | 0 |
| 2391 | Mar. 24, 1998 | 370 | RTA00000424F.d.19.3 | M00001448B:A07 | 73180 |
| 2392 | Mar. 24, 1998 | 371 | RTA00000522F.j.09.2 | M00001650D:F11 | 78522 |
| 2393 | Mar. 24, 1998 | 372 | RTA00000424F.m.24.1 | M00001614C:G07 | 77045 |
| 2394 | Mar. 24, 1998 | 373 | RTA00000522F.j.19.2 | M00001652B:D06 | 76224 |
| 2395 | Mar. 24, 1998 | 374 | RTA00000528F.f.10.1 | M00001596C:G05 | 3600 |
| 2396 | Mar. 24, 1998 | 375 | RTA00000427F.p.19.2 | M00004895C:G05 | 0 |
| 2397 | Mar. 24, 1998 | 376 | RTA00000525F.b.21.1 | M00004037C:D04 | 9486 |
| 2398 | Mar. 24, 1998 | 377 | RTA00000527F.j.12.2 | M00003857C:E05 | 37503 |
| 2399 | Mar. 24, 1998 | 378 | RTA00000522F.g.11.1 | M00001595A:D12 | 75432 |
| 2400 | Mar. 24, 1998 | 379 | RTA00000522F.k.02.2 | M00001652C:B09 | 77622 |
| 2401 | Mar. 24, 1998 | 380 | RTA00000427F.e.13.1 | M00003959D:A04 | 66080 |
| 2402 | Mar. 24, 1998 | 381 | RTA00000426F.f.18.1 | M00003854C:C02 | 63271 |
| 2403 | Mar. 24, 1998 | 382 | RTA00000427F.a.12.1 | M00003982C:H10 | 63377 |
| 2404 | Mar. 24, 1998 | 383 | RTA00000424F.b.23.4 | M00001530A:H05 | 77322 |
| 2405 | Mar. 24, 1998 | 384 | RTA00000527F.p.03.1 | M00004029B:A06 | 5940 |
| 2406 | Mar. 24, 1998 | 385 | RTA00000426F.f.12.1 | M00003823C:C04 | 19096 |
| 2407 | Mar. 24, 1998 | 386 | RTA00000523F.l.16.1 | M00005134C:G04 | 0 |
| 2408 | Mar. 24, 1998 | 387 | RTA00000427F.f.02.1 | M00004118D:A11 | 36822 |
| 2409 | Mar. 24, 1998 | 388 | RTA00000526F.d.17.1 | M00004235A:A12 | 2757 |
| 2410 | Mar. 24, 1998 | 389 | RTA00000424F.i.15.1 | M00001596A:A02 | 78043 |
| 2411 | Mar. 24, 1998 | 390 | RTA00000524F.a.11.1 | M00005210D:C09 | 0 |
| 2412 | Mar. 24, 1998 | 391 | RTA00000522F.m.03.1 | M00001654C:G09 | 79194 |
| 2413 | Mar. 24, 1998 | 392 | RTA00000522F.a.20.1 | M00001567C:E07 | 74070 |
| 2414 | Mar. 24, 1998 | 393 | RTA00000424F.b.15.4 | M00001539B:B10 | 74958 |
| 2415 | Mar. 24, 1998 | 394 | RTA00000527F.g.14.1 | M00003845D:B02 | 37532 |
| 2416 | Mar. 24, 1998 | 395 | RTA00000522F.d.06.1 | M00001578B:A02 | 74809 |
| 2417 | Mar. 24, 1998 | 396 | RTA00000528F.g.05.2 | M00001615C:E07 | 3770 |
| 2418 | Mar. 24, 1998 | 397 | RTA00000427F.e.10.1 | M00003974D:H07 | 64599 |
| 2419 | Mar. 24, 1998 | 398 | RTA00000527F.c.16.1 | M00003821A:H09 | 22908 |
| 2420 | Mar. 24, 1998 | 399 | RTA00000524F.c.07.1 | M00005217A:G10 | 0 |
| 2421 | Mar. 24, 1998 | 400 | RTA00000523F.f.17.1 | M00003840B:E08 | 63984 |
| 2422 | Mar. 24, 1998 | 401 | RTA00000525F.c.16.1 | M00004040A:B04 | 38209 |
| 2423 | Mar. 24, 1998 | 402 | RTA00000527F.p.24.1 | M00004031B:A06 | 36832 |
| 2424 | Mar. 24, 1998 | 403 | RTA00000425F.n.17.1 | M00001636A:H12 | 78304 |
| 2425 | Mar. 24, 1998 | 404 | RTA00000522F.b.18.1 | M00001573B:A06 | 3460 |
| 2426 | Mar. 24, 1998 | 405 | RTA00000425F.c.07.1 | M00001608C:D02 | 75992 |
| 2427 | Mar. 24, 1998 | 406 | RTA00000523F.o.07.1 | M00005176A:A05 | 0 |
| 2428 | Mar. 24, 1998 | 407 | RTA00000523F.h.08.1 | M00003851B:E01 | 62893 |
| 2429 | Mar. 24, 1998 | 408 | RTA00000522F.o.10.1 | M00001660D:E05 | 78798 |
| 2430 | Mar. 24, 1998 | 409 | RTA00000425F.l.10.1 | M00001638A:C08 | 26893 |
| 2431 | Mar. 24, 1998 | 410 | RTA00000427F.f.16.1 | M00004119D:H06 | 64122 |
| 2432 | Mar. 24, 1998 | 411 | RTA00000424F.n.12.1 | M00001582C:G02 | 41589 |
| 2433 | Mar. 24, 1998 | 412 | RTA00000425F.i.11.1 | M00001664B:F06 | 21716 |
| 2434 | Mar. 24, 1998 | 413 | RTA00000425F.i.10.1 | M00001664B:E05 | 78736 |
| 2435 | Mar. 24, 1998 | 414 | RTA00000426F.m.12.1 | M00004030B:D08 | 63740 |
| 2436 | Mar. 24, 1998 | 415 | RTA00000527F.g.12.1 | M00003845C:D04 | 37746 |
| 2437 | Mar. 24, 1998 | 416 | RTA00000527F.i.12.2 | M00003852B:D11 | 0 |
| 2438 | Mar. 24, 1998 | 417 | RTA00000524F.b.10.1 | M00005213C:A01 | 0 |
| 2439 | Mar. 24, 1998 | 418 | RTA00000425F.i.18.1 | M00001633A:G10 | 42255 |
| 2440 | Mar. 24, 1998 | 419 | RTA00000428F.b.22.1 | M00005231D:B09 | 0 |
| 2441 | Mar. 24, 1998 | 420 | RTA00000424F.j.13.1 | M00001594C:H03 | 74485 |
| 2442 | Mar. 24, 1998 | 421 | RTA00000523F.i.10.1 | M00003855B:B09 | 64876 |
| 2443 | Mar. 24, 1998 | 422 | RTA00000527F.f.03.1 | M00003829A:B08 | 17788 |
| 2444 | Mar. 24, 1998 | 423 | RTA00000427F.p.06.2 | M00005102C:C01 | 0 |
| 2445 | Mar. 24, 1998 | 424 | RTA00000424F.k.10.1 | M00001592D:H02 | 73232 |
| 2446 | Mar. 24, 1998 | 425 | RTA00000522F.i.07.2 | M00001649A:E10 | 78377 |
| 2447 | Mar. 24, 1998 | 426 | RTA00000424F.k.21.1 | M00001614A:A04 | 73197 |
| 2448 | Mar. 24, 1998 | 427 | RTA00000522F.b.08.1 | M00001570D:E06 | 26915 |
| 2449 | Mar. 24, 1998 | 428 | RTA00000522F.l.08.1 | M00001654A:E08 | 78781 |
| 2450 | Mar. 24, 1998 | 429 | RTA00000525F.a.14.1 | M00004033B:C02 | 37566 |
| 2451 | Mar. 24, 1998 | 430 | RTA00000424F.g.08.1 | M00001482C:F09 | 74928 |
| 2452 | Mar. 24, 1998 | 431 | RTA00000425F.l.09.1 | M00001638A:B04 | 75251 |
| 2453 | Mar. 24, 1998 | 432 | RTA00000522F.o.20.1 | M00001669C:B09 | 74853 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2454 | Mar. 24, 1998 | 433 | RTA00000527F.j.04.2 | M00003856A:G04 | 11809 |
| 2455 | Mar. 24, 1998 | 434 | RTA00000522F.c.11.1 | M00001576C:H02 | 31064 |
| 2456 | Mar. 24, 1998 | 435 | RTA00000523F.c.13.1 | M00003813D:B12 | 40668 |
| 2457 | Mar. 24, 1998 | 436 | RTA00000427F.i.21.1 | M00004102C:F03 | 65540 |
| 2458 | Mar. 24, 1998 | 437 | RTA00000427F.n.10.1 | M00004960B:A08 | 0 |
| 2459 | Mar. 24, 1998 | 438 | RTA00000522F.h.02.1 | M00001595C:E09 | 74947 |
| 2460 | Mar. 24, 1998 | 439 | RTA00000522F.g.10.1 | M00001595A:C07 | 74294 |
| 2461 | Mar. 24, 1998 | 440 | RTA00000523F.o.22.1 | M00005177C:B04 | 0 |
| 2462 | Mar. 24, 1998 | 441 | RTA00000528F.g.22.2 | M00001630C:F09 | 920 |
| 2463 | Mar. 24, 1998 | 442 | RTA00000425F.d.14.1 | M00001629A:H09 | 13417 |
| 2464 | Mar. 24, 1998 | 443 | RTA00000425F.k.16.1 | M00001640A:F05 | 75282 |
| 2465 | Mar. 24, 1998 | 444 | RTA00000525F.b.09.1 | M00004035B:F05 | 23472 |
| 2466 | Mar. 24, 1998 | 445 | RTA00000522F.j.08.2 | M00001650D:D10 | 76613 |
| 2467 | Mar. 24, 1998 | 446 | RTA00000425F.f.20.1 | M00001653D:H07 | 74071 |
| 2468 | Mar. 24, 1998 | 447 | RTA00000523F.f.19.1 | M00003840B:F05 | 34169 |
| 2469 | Mar. 24, 1998 | 448 | RTA00000425F.j.18.1 | M00001639D:G12 | 75561 |
| 2470 | Mar. 24, 1998 | 449 | RTA00000426F.m.04.1 | M00004028A:B10 | 36865 |
| 2471 | Mar. 24, 1998 | 450 | RTA00000527F.g.21.1 | M00003846B:C05 | 36028 |
| 2472 | Mar. 24, 1998 | 451 | RTA00000527F.i.15.2 | M00003852C:F07 | 14235 |
| 2473 | Mar. 24, 1998 | 452 | RTA00000525F.a.22.1 | M00004033D:G06 | 36848 |
| 2474 | Mar. 24, 1998 | 453 | RTA00000522F.p.22.1 | M00001671B:F02 | 73322 |
| 2475 | Mar. 24, 1998 | 454 | RTA00000424F.d.12.2 | M00001530D:E06 | 74342 |
| 2476 | Mar. 24, 1998 | 455 | RTA00000424F.g.24.1 | M00001487C:A11 | 79156 |
| 2477 | Mar. 24, 1998 | 456 | RTA00000427F.a.10.1 | M00004038B:D01 | 65370 |
| 2478 | Mar. 24, 1998 | 457 | RTA00000426F.h.20.1 | M00003905A:H11 | 23187 |
| 2479 | Mar. 24, 1998 | 458 | RTA00000424F.d.12.3 | M00001530D:E06 | 74342 |
| 2480 | Mar. 24, 1998 | 459 | RTA00000425F.c.03.1 | M00001585D:B12 | 74643 |
| 2481 | Mar. 24, 1998 | 460 | RTA00000523F.f.16.1 | M00003840B:E07 | 26522 |
| 2482 | Mar. 24, 1998 | 461 | RTA00000427F.f.15.1 | M00004119D:A07 | 66734 |
| 2483 | Mar. 24, 1998 | 462 | RTA00000427F.p.13.2 | M00004695B:E04 | 0 |
| 2484 | Mar. 24, 1998 | 463 | RTA00000523F.p.16.1 | M00005179D:B03 | 0 |
| 2485 | Mar. 24, 1998 | 464 | RTA00000522F.p.18.1 | M00001671A:H06 | 76376 |
| 2486 | Mar. 24, 1998 | 465 | RTA00000528F.d.04.1 | M00001570D:E07 | 2395 |
| 2487 | Mar. 24, 1998 | 466 | RTA00000427F.d.06.1 | M00003980B:C06 | 33446 |
| 2488 | Mar. 24, 1998 | 467 | RTA00000528F.h.02.2 | M00001632C:D08 | 1701 |
| 2489 | Mar. 24, 1998 | 468 | RTA00000524F.a.18.1 | M00005211A:E09 | 0 |
| 2490 | Mar. 24, 1998 | 469 | RTA00000522F.e.20.1 | M00001590B:H10 | 26770 |
| 2491 | Mar. 24, 1998 | 470 | RTA00000427F.p.24.2 | M00004897D:F03 | 0 |
| 2492 | Mar. 24, 1998 | 471 | RTA00000528F.c.11.1 | M00001486D:D12 | 1701 |
| 2493 | Mar. 24, 1998 | 472 | RTA00000522F.g.18.1 | M00001595B:H11 | 73226 |
| 2494 | Mar. 24, 1998 | 473 | RTA00000523F.o.21.1 | M00005177C:A01 | 0 |
| 2495 | Mar. 24, 1998 | 474 | RTA00000522F.h.05.1 | M00001595C:H11 | 73358 |
| 2496 | Mar. 24, 1998 | 475 | RTA00000427F.i.06.1 | M00004097B:D03 | 41450 |
| 2497 | Mar. 24, 1998 | 476 | RTA00000425F.n.16.1 | M00001636A:C02 | 18265 |
| 2498 | Mar. 24, 1998 | 477 | RTA00000527F.l.21.1 | M00003983D:H02 | 36439 |
| 2499 | Mar. 24, 1998 | 478 | RTA00000527F.p.09.1 | M00004029C:F05 | 7694 |
| 2500 | Mar. 24, 1998 | 479 | RTA00000527F.l.23.1 | M00003984A:B06 | 36018 |
| 2501 | Mar. 24, 1998 | 480 | RTA00000424F.d.17.3 | M00001455A:E11 | 73958 |
| 2502 | Mar. 24, 1998 | 481 | RTA00000523F.j.02.1 | M00003857A:H10 | 62853 |
| 2503 | Feb. 24, 1998 | 1132 | RTA00000119A.c.12.1 | M00001453A:D08 | 4882 |
| 2504 | Feb. 24, 1998 | 6 | RTA00000119A.j.15.1 | M00001460A:E11 | 79623 |
| 2505 | Feb. 24, 1998 | 1041 | RTA00000403F.b.05.1 | M00001455B:E07 | 74300 |
| 2506 | Feb. 24, 1998 | 994 | RTA00000408F.b.04.2 | M00001455A:F04 | 39933 |
| 2507 | Feb. 24, 1998 | 401 | RTA00000132A.c.11.1 | M00001454A:G03 | 87278 |
| 2508 | Feb. 24, 1998 | 535 | RTA00000119A.g.7.1 | M00001454A:F11 | 83580 |
| 2509 | Feb. 24, 1998 | 867 | RTA00000339F.l.21.1 | M00001455D:D11 | 9781 |
| 2510 | Feb. 24, 1998 | 62 | RTA00000339F.n.10.1 | M00001453B:F08 | 13719 |
| 2511 | Feb. 24, 1998 | 380 | RTA00000403F.b.19.1 | M00001456B:A06 | 22327 |
| 2512 | Jan. 28, 1998 | 288 | RTA00000181AR.i.06.3 | M00001452A:C07 | 19119 |
| 2512 | Feb. 24, 1998 | 198 | RTA00000339R.l.14.1 | M00001452A:C07 | 19119 |
| 2513 | Jan. 28, 1998 | 288 | RTA00000181AR.i.06.3 | M00001452A:C07 | 19119 |
| 2513 | Feb. 24, 1998 | 198 | RTA00000339R.l.14.1 | M00001452A:C07 | 19119 |
| 2514 | Feb. 24, 1998 | 264 | RTA00000345F.j.08.1 | M00001451B:A04 | 16731 |
| 2515 | Feb. 24, 1998 | 1125 | RTA00000118A.n.5.1 | M00001451A:C10 | 0 |
| 2516 | Feb. 24, 1998 | 229 | RTA00000345F.i.09.1 | M00001450A:D08 | 27250 |
| 2517 | Feb. 24, 1998 | 670 | RTA00000131A.i.6.1 | M00001450A:B08 | 0 |
| 2518 | Feb. 24, 1998 | 892 | RTA00000339F.m.17.1 | M00001453B:H12 | 20854 |
| 2519 | Feb. 24, 1998 | 1123 | RTA00000408F.c.23.1 | M00001458C:D10 | 42261 |
| 2520 | Feb. 24, 1998 | 680 | RTA00000345F.e.11.1 | M00001391C:C04 | 4392 |
| 2521 | Feb. 24, 1998 | 644 | RTA00000119A.j.9.1 | M00001460A:B12 | 82060 |
| 2522 | Feb. 24, 1998 | 972 | RTA00000408F.d.15.1 | M00001459B:C11 | 78467 |
| 2523 | Feb. 24, 1998 | 1081 | RTA00000403F.d.02.1 | M00001458D:D01 | 39224 |
| 2524 | Feb. 24, 1998 | 231 | RTA00000408F.d.06.1 | M00001458D:C11 | 78997 |
| 2525 | Feb. 24, 1998 | 663 | RTA00000403F.b.12.1 | M00001455D:A06 | 78775 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2526 | Feb. 24, 1998 | 856 | RTA00000408F.d.02.1 | M00001458D:A01 | 79169 |
| 2527 | Feb. 24, 1998 | 743 | RTA00000345F.i.08.1 | M00001449D:G10 | 0 |
| 2528 | Feb. 24, 1998 | 1162 | RTA00000408F.c.10.1 | M00001458A:A11 | 18247 |
| 2529 | Feb. 24, 1998 | 841 | RTA00000119A.i.8.1 | M00001457A:G12 | 82593 |
| 2530 | Feb. 24, 1998 | 677 | RTA00000119A.h.24.1 | M00001457A:C05 | 82266 |
| 2531 | Feb. 24, 1998 | 750 | RTA00000403F.c.05.1 | M00001456C:C11 | 74935 |
| 2532 | Feb. 24, 1998 | 751 | RTA00000422F.i.02.1 | M00001456C:B12 | 76436 |
| 2533 | Feb. 24, 1998 | 920 | RTA00000403F.b.24.1 | M00001456B:G01 | 78838 |
| 2534 | Feb. 24, 1998 | 1251 | RTA00000408F.d.03.1 | M00001458D:A02 | 22768 |
| 2535 | Feb. 24, 1998 | 450 | RTA00000118A.a.23.1 | M00001395A:H02 | 3500 |
| 2536 | Feb. 24, 1998 | 85 | RTA00000339F.k.22.1 | M00001427C:D01 | 5556 |
| 2537 | Feb. 24, 1998 | 684 | RTA00000339F.k.20.1 | M00001426D:D12 | 6662 |
| 2538 | Feb. 24, 1998 | 129 | RTA00000118A.d.24.1 | M00001416A:H02 | 81488 |
| 2539 | Feb. 24, 1998 | 397 | RTA00000118A.d.17.1 | M00001416A:D09 | 81921 |
| 2540 | Feb. 24, 1998 | 158 | RTA00000348R.j.16.1 | M00001410A:D07 | 7005 |
| 2541 | Feb. 24, 1998 | 1025 | RTA00000118A.j.24.1 | M00001450A:B03 | 18 |
| 2542 | Feb. 24, 1998 | 1005 | RTA00000339F.e.17.1 | M00001397D:G08 | 7568 |
| 2543 | Feb. 24, 1998 | 1040 | RTA00000348R.o.12.1 | M00001433C:F10 | 2263 |
| 2544 | Feb. 24, 1998 | 746 | RTA00000345F.e.02.1 | M00001395A:E03 | 0 |
| 2545 | Feb. 24, 1998 | 517 | RTA00000118A.a.2.1 | M00001395A:A12 | 38067 |
| 2546 | Feb. 24, 1998 | 1065 | RTA00000195R.a.06.1 | M00001394A:E04 | 35265 |
| 2546 | Jan. 28, 1998 | 595 | RTA00000195R.a.06.1 | M00001394A:E04 | 35265 |
| 2547 | Jan. 28, 1998 | 595 | RTA00000195R.a.06.1 | M00001394A:E04 | 35265 |
| 2547 | Feb. 24, 1998 | 1065 | RTA00000195R.a.06.1 | M00001394A:E04 | 35265 |
| 2548 | Jan. 28, 1998 | 675 | RTA00000179AR.b.21.3 | M00001392C:D05 | 4366 |
| 2548 | Feb. 24, 1998 | 1264 | RTA00000345F.e.13.1 | M00001392C:D05 | 4366 |
| 2549 | Jan. 28, 1998 | 562 | RTA00000196F.j.12.1 | M00001396A:H03 | 19294 |
| 2550 | Feb. 24, 1998 | 1042 | RTA00000339F.g.10.1 | M00001400C:D02 | 6327 |
| 2551 | Feb. 24, 1998 | 706 | RTA00000403F.a.09.1 | M00001448B:H05 | 77820 |
| 2552 | Feb. 24, 1998 | 823 | RTA00000119A.k.1.1 | M00001460A:H11 | 81282 |
| 2553 | Feb. 24, 1998 | 703 | RTA00000339F.n.05.1 | M00001449D:B01 | 39648 |
| 2554 | Feb. 24, 1998 | 787 | RTA00000345F.i.24.1 | M00001449C:C05 | 0 |
| 2555 | Feb. 24, 1998 | 68 | RTA00000339F.n.03.1 | M00001449B:B03 | 0 |
| 2556 | Feb. 24, 1998 | 440 | RTA00000403F.a.18.1 | M00001448D:F12 | 75726 |
| 2557 | Feb. 24, 1998 | 815 | RTA00000403F.a.17.1 | M00001448D:E12 | 13686 |
| 2558 | Feb. 24, 1998 | 275 | RTA00000353R.j.24.1 | M00001428B:D01 | 23089 |
| 2559 | Feb. 24, 1998 | 902 | RTA00000403F.a.10.1 | M00001448C:E11 | 73952 |
| 2560 | Feb. 24, 1998 | 1214 | RTA00000339F.j.07.1 | M00001428D:B10 | 5673 |
| 2561 | Feb. 24, 1998 | 378 | RTA00000403F.a.07.1 | M00001448B:F09 | 73559 |
| 2562 | Feb. 24, 1998 | 473 | RTA00000403F.a.05.1 | M00001448A:E11 | 18808 |
| 2563 | Feb. 24, 1998 | 128 | RTA00000403F.a.04.1 | M00001448A:B12 | 23529 |
| 2564 | Feb. 24, 1998 | 227 | RTA00000347F.c.06.1 | M00001444D:C01 | 18846 |
| 2565 | Feb. 24, 1998 | 35 | RTA00000339F.i.13.1 | M00001434A:B10 | 5970 |
| 2566 | Feb. 24, 1998 | 442 | RTA00000347F.b.02.1 | M00001450A:A02 | 39304 |
| 2567 | Feb. 24, 1998 | 288 | RTA00000403F.a.11.1 | M00001448C:F10 | 73109 |
| 2568 | Feb. 24, 1998 | 853 | RTA00000408F.j.13.2 | M00001485B:D10 | 42275 |
| 2569 | Feb. 24, 1998 | 249 | RTA00000119A.j.10.1 | M00001460A:C10 | 79646 |
| 2570 | Feb. 24, 1998 | 634 | RTA00000418F.c.04.1 | M00001487B:A11 | 41587 |
| 2571 | Feb. 24, 1998 | 110 | RTA00000408F.k.14.1 | M00001486B:E12 | 73856 |
| 2572 | Feb. 24, 1998 | 894 | RTA00000408F.k.12.1 | M00001486B:D07 | 77246 |
| 2573 | Feb. 24, 1998 | 395 | RTA00000408F.j.19.2 | M00001485C:C08 | 73752 |
| 2574 | Feb. 24, 1998 | 509 | RTA00000349R.g.10.1 | M00001495B:B08 | 5777 |
| 2575 | Feb. 24, 1998 | 426 | RTA00000408F.j.15.2 | M00001485B:F05 | 74759 |
| 2576 | Feb. 24, 1998 | 101 | RTA00000121A.m.2.1 | M00001507A:A11 | 81064 |
| 2577 | Feb. 24, 1998 | 330 | RTA00000403F.i.04.1 | M00001485B:D09 | 8930 |
| 2578 | Feb. 24, 1998 | 647 | RTA00000418F.b.23.1 | M00001485A:C05 | 28767 |
| 2579 | Feb. 24, 1998 | 569 | RTA00000403F.h.18.1 | M00001484C:A04 | 39241 |
| 2580 | Feb. 24, 1998 | 236 | RTA00000403F.h.12.1 | M00001483C:G09 | 15205 |
| 2581 | Feb. 24, 1998 | 707 | RTA00000403F.h.11.1 | M00001483B:D04 | 39219 |
| 2582 | Feb. 24, 1998 | 869 | RTA00000403F.h.07.1 | M00001482D:H11 | 26856 |
| 2583 | Feb. 24, 1998 | 1101 | RTA00000408F.j.17.2 | M00001485B:H03 | 78935 |
| 2584 | Feb. 24, 1998 | 344 | RTA00000403F.m.15.2 | M00001575D:D12 | 26901 |
| 2585 | Feb. 24, 1998 | 768 | RTA00000121A.k.5.1 | M00001507A:E04 | 17530 |
| 2586 | Feb. 24, 1998 | 1174 | RTA00000121A.k.22.1 | M00001507A:C05 | 79523 |
| 2587 | Feb. 24, 1998 | 184 | RTA00000133A.j.13.1 | M00001507A:B02 | 16846 |
| 2588 | Feb. 24, 1998 | 1230 | RTA00000399F.j.14.1 | M00001578C:F05 | 16942 |
| 2589 | Feb. 24, 1998 | 304 | RTA00000403F.n.18.2 | M00001577D:H06 | 8811 |
| 2590 | Feb. 24, 1998 | 938 | RTA00000403F.i.23.1 | M00001487B:E10 | 11364 |
| 2591 | Feb. 24, 1998 | 1131 | RTA00000418F.e.20.1 | M00001576C:G05 | 73741 |
| 2592 | Feb. 24, 1998 | 651 | RTA00000403F.g.11.1 | M00001481A:H08 | 24238 |
| 2593 | Feb. 24, 1998 | 312 | RTA00000399F.j.08.1 | M00001575D:B10 | 38927 |
| 2594 | Feb. 24, 1998 | 800 | RTA00000403F.m.12.1 | M00001575D:A02 | 16933 |
| 2595 | Feb. 24, 1998 | 1017 | RTA00000418F.e.03.1 | M00001573S:G08 | 73442 |
| 2596 | Feb. 24, 1998 | 269 | RTA00000422F.e.08.1 | M00001573A:E01 | 39020 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2597 | Feb. 24, 1998 | 1247 | RTA00000408F.o.13.1 | M00001572A:B05 | 74895 |
| 2598 | Feb. 24, 1998 | 847 | RTA00000403F.l.11.1 | M00001571D:F05 | 25073 |
| 2599 | Feb. 24, 1998 | 910 | RTA00000418F.f.03.1 | M00001577B:F10 | 78911 |
| 2600 | Feb. 24, 1998 | 244 | RTA00000120A.g.23.1 | M00001465A:E10 | 81189 |
| 2601 | Feb. 24, 1998 | 1189 | RTA00000339F.o.18.1 | M00001469B:B01 | 6641 |
| 2602 | Feb. 24, 1998 | 1266 | RTA00000121A.a.2.1 | M00001468A:H10 | 81843 |
| 2603 | Feb. 24, 1998 | 414 | RTA00000120A.p.18.1 | M00001468A:C05 | 6478 |
| 2604 | Feb. 24, 1998 | 96 | RTA00000120A.n.19.3 | M00001467A:H07 | 80004 |
| 2605 | Feb. 24, 1998 | 1231 | RTA00000120A.m.13.3 | M00001467A:C10 | 80608 |
| 2606 | Feb. 24, 1998 | 134 | RTA00000408F.i.08.2 | M00001482A:H05 | 75811 |
| 2607 | Feb. 24, 1998 | 410 | RTA00000120A.h.5.1 | M00001465A:G06 | 80344 |
| 2608 | Feb. 24, 1998 | 403 | RTA00000403F.d.22.1 | M00001473A:A07 | 10692 |
| 2609 | Feb. 24, 1998 | 183 | RTA00000120A.g.18.1 | M00001465A:C12 | 81255 |
| 2610 | Feb. 24, 1998 | 810 | RTA00000120A.h.9.1 | M00001465A:B12 | 80736 |
| 2611 | Feb. 24, 1998 | 71 | RTA00000120A.d.24.1 | M00001464A:E10 | 5085 |
| 2612 | Feb. 24, 1998 | 490 | RTA00000120A.d.15.1 | M00001464A:B02 | 80533 |
| 2613 | Feb. 24, 1998 | 736 | RTA00000120A.c.7.1 | M00001462A:D03 | 80985 |
| 2614 | Feb. 24, 1998 | 724 | RTA00000119A.m.17.1 | M00001461A:F05 | 79536 |
| 2615 | Feb. 24, 1998 | 1063 | RTA00000132A.n.7.1 | M00001466A:F08 | 0 |
| 2616 | Feb. 24, 1998 | 74 | RTA00000408F.e.22.2 | M00001476B:F08 | 26930 |
| 2617 | Jan. 28, 1998 | 656 | RTA00000178AR.h.22.3 | M00001376B:A08 | 19230 |
| 2617 | Jan. 28, 1998 | 657 | RTA00000178AR.h.22.2 | M00001376B:A08 | 19230 |
| 2617 | Feb. 24, 1998 | 1137 | RTA00000345F.d.03.1 | M00001376B:A08 | 19230 |
| 2618 | Feb. 24, 1998 | 1012 | RTA00000403F.g.06.1 | M00001480C:A05 | 10505 |
| 2619 | Feb. 24, 1998 | 419 | RTA00000408F.h.08.1 | M00001480A:D03 | 74575 |
| 2620 | Feb. 24, 1998 | 871 | RTA00000403F.f.23.1 | M00001479C:E01 | 39223 |
| 2621 | Feb. 24, 1998 | 638 | RTA00000418F.b.09.1 | M00001478B:H08 | 19700 |
| 2622 | Feb. 24, 1998 | 770 | RTA00000421F.f.05.1 | M00001477B:E02 | 5266 |
| 2623 | Feb. 24, 1998 | 549 | RTA00000121A.h.18.1 | M00001471A:B04 | 16376 |
| 2624 | Feb. 24, 1998 | 660 | RTA00000408F.e.24.2 | M00001476C:C11 | 75002 |
| 2625 | Feb. 24, 1998 | 144 | RTA00000349R.f.15.1 | M00001472A:D08 | 75097 |
| 2626 | Feb. 24, 1998 | 774 | RTA00000403F.e.24.1 | M00001476B:D10 | 16432 |
| 2627 | Feb. 24, 1998 | 268 | RTA00000403F.e.23.1 | M00001476A:D11 | 9626 |
| 2628 | Feb. 24, 1998 | 715 | RTA00000418F.b.01.1 | M00001475C:G11 | 76040 |
| 2629 | Feb. 24, 1998 | 1073 | RTA00000418F.a.10.1 | M00001475B:C04 | 15245 |
| 2630 | Feb. 24, 1998 | 100 | RTA00000339F.o.23.1 | M00001473C:D09 | 7801 |
| 2631 | Feb. 24, 1998 | 756 | RTA00000403F.g.13.1 | M00001481B:D09 | 38718 |
| 2632 | Feb. 24, 1998 | 915 | RTA00000408F.f.14.2 | M00001476D:F03 | 73024 |
| 2633 | Jan. 28, 1998 | 389 | RTA00000181AR.k.2.2 | M00001453C:A11 | 0 |
| 2633 | Jan. 28, 1998 | 286 | RTA00000181AR.k.2.3 | M00001453C:A11 | 0 |
| 2634 | Jan. 28, 1998 | 565 | RTA00000191AF.c.10.1 | M00003989B:F11 | 40422 |
| 2635 | Jan. 28, 1998 | 449 | RTA00000181AF.m.22.3 | M00001455D:F09 | 9283 |
| 2635 | Jan. 28, 1998 | 450 | RTA00000181AF.m.21.3 | M00001455D:F09 | 9283 |
| 2636 | Jan. 28, 1998 | 449 | RTA00000181AF.m.22.3 | M00001455D:F09 | 9283 |
| 2636 | Jan. 28, 1998 | 450 | RTA00000181AF.m.21.3 | M00001455D:F09 | 9283 |
| 2637 | Jan. 28, 1998 | 449 | RTA00000181AF.m.22.3 | M00001455D:F09 | 9283 |
| 2637 | Jan. 28, 1998 | 450 | RTA00000181AF.m.21.3 | M00001455D:F09 | 9283 |
| 2638 | Jan. 28, 1998 | 449 | RTA00000181AF.m.22.3 | M00001455D:F09 | 9283 |
| 2638 | Jan. 28, 1998 | 450 | RTA00000181AF.m.21.3 | M00001455D:F09 | 9283 |
| 2639 | Jan. 28, 1998 | 390 | RTA00000197AR.f.07.1 | M00001457C:C11 | 19261 |
| 2639 | Jan. 28, 1998 | 184 | RTA00000197AF.f.7.1 | M00001457C:C11 | 19261 |
| 2640 | Jan. 28, 1998 | 598 | RTA00000197F.e.10.1 | M00001454B:D08 | 13154 |
| 2641 | Jan. 28, 1998 | 184 | RTA00000197AF.f.7.1 | M00001457C:C11 | 19261 |
| 2641 | Jan. 28, 1998 | 390 | RTA00000197AR.f.07.1 | M00001457C:C11 | 19261 |
| 2642 | Jan. 28, 1998 | 286 | RTA00000181AR.k.2.3 | M00001453C:A11 | 0 |
| 2642 | Jan. 28, 1998 | 389 | RTA00000181AR.k.2.2 | M00001453C:A11 | 0 |
| 2643 | Jan. 28, 1998 | 667 | RTA00000197AF.d.16.1 | M00001452A:E07 | 23505 |
| 2644 | Jan. 28, 1998 | 679 | RTA00000197AF.d.11.1 | M00001451C:E01 | 27260 |
| 2645 | Jan. 28, 1998 | 664 | RTA00000195R.a.23.1 | M00001449C:H12 | 86432 |
| 2646 | Jan. 28, 1998 | 594 | RTA00000181AR.e.04.3 | M00001448A:G09 | 11825 |
| 2647 | Jan. 28, 1998 | 405 | RTA00000197AF.b.24.1 | M00001446C:D09 | 23171 |
| 2648 | Jan. 28, 1998 | 572 | RTA00000181AF.l.16.2 | M00001454D:E05 | 13532 |
| 2649 | Jan. 28, 1998 | 590 | RTA00000190AF.d.2.1 | M00003906B:F12 | 2444 |
| 2650 | Jan. 28, 1998 | 675 | RTA00000179AR.b.21.3 | M00001392C:D05 | 4366 |
| 2650 | Feb. 24, 1998 | 1264 | RTA00000345F.e.13.1 | M00001392C:D05 | 4366 |
| 2651 | Jan. 28, 1998 | 486 | RTA00000190AR.p.22.2 | M00003979A:E11 | 16368 |
| 2652 | Jan. 28, 1998 | 701 | RTA00000199AF.o.10.1 | M00003974C:E04 | 0 |
| 2653 | Jan. 28, 1998 | 704 | RTA00000190AF.o.12.1 | M00003972D:C09 | 3438 |
| 2654 | Jan. 28, 1998 | 469 | RTA00000190AF.n.2.1 | M00003963A:E03 | 5650 |
| 2655 | Jan. 28, 1998 | 612 | RTA00000197AR.e.22.1 | M00001456A:H02 | 78758 |
| 2656 | Jan. 28, 1998 | 640 | RTA00000190AF.f.5.1 | M00003909A:H04 | 5015 |
| 2657 | Jan. 28, 1998 | 539 | RTA00000197AR.b.13.1 | M00001445B:E04 | 9560 |
| 2658 | Jan. 28, 1998 | 431 | RTA00000199AF.k.15.1 | M00003905C:G10 | 8275 |
| 2659 | Jan. 28, 1998 | 747 | RTA00000190AF.c.6.1 | M00003904D:D10 | 4780 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2660 | Jan. 28, 1998 | 584 | RTA00000190AR.c.03.1 | M00003904C:A08 | 0 |
| 2660 | Feb. 24, 1998 | 1069 | RTA00000346F.k.05.1 | M00003904C:A08 | 0 |
| 2661 | Jan. 28, 1998 | 584 | RTA00000190AR.c.03.1 | M00003904C:A08 | 0 |
| 2661 | Feb. 24, 1998 | 1069 | RTA00000346F.k.05.1 | M00003904C:A08 | 0 |
| 2662 | Jan. 28, 1998 | 577 | RTA00000190AF.a.24.2 | M00003901B:A05 | 0 |
| 2663 | Jan. 28, 1998 | 639 | RTA00000199AF.j.1.1 | M00003881C:G09 | 6006 |
| 2664 | Jan. 28, 1998 | 649 | RTA00000190AR.l.19.2 | M00003946A:H10 | 88204 |
| 2665 | Jan. 28, 1998 | 488 | RTA00000179AR.l.22.4 | M00001405B:E09 | 4314 |
| 2665 | Jan. 28, 1998 | 481 | RTA00000179AR.l.22.2 | M00001405B:E09 | 4314 |
| 2666 | Jan. 28, 1998 | 721 | RTA00000180AF.c.4.1 | M00001417B:C04 | 5415 |
| 2667 | Jan. 28, 1998 | 744 | RTA00000196F.m.4.1 | M00001413A:F03 | 7958 |
| 2668 | Jan. 28, 1998 | 569 | RTA00000196AF.l.23.1 | M00001412A:E04 | 12052 |
| 2669 | Jan. 28, 1998 | 707 | RTA00000179AF.p.15.1 | M00001411D:F05 | 5622 |
| 2670 | Jan. 28, 1998 | 599 | RTA00000179AF.o.5.1 | M00001408D:D04 | 6172 |
| 2671 | Jan. 28, 1998 | 420 | RTA00000181F.c.11.1 | M00001445D:A06 | 4769 |
| 2672 | Jan. 28, 1998 | 500 | RTA00000179AR.m.07.5 | M00001405D:D11 | 0 |
| 2673 | Jan. 28, 1998 | 609 | RTA00000196AF.n.05.1 | M00001418B:F07 | 12531 |
| 2673 | Feb. 24, 1998 | 1120 | RTA00000353R.l.23.1 | M00001418B:F07 | 12531 |
| 2674 | Jan. 28, 1998 | 481 | RTA00000179AR.l.22.2 | M00001405B:E09 | 4314 |
| 2674 | Jan. 28, 1998 | 488 | RTA00000179AR.l.22.4 | M00001405B:E09 | 4314 |
| 2675 | Jan. 28, 1998 | 481 | RTA00000179AR.l.22.2 | M00001405B:E09 | 4314 |
| 2675 | Jan. 28, 1998 | 488 | RTA00000179AR.l.22.4 | M00001405B:E09 | 4314 |
| 2676 | Jan. 28, 1998 | 481 | RTA00000179AR.l.22.2 | M00001405B:E09 | 4314 |
| 2676 | Jan. 28, 1998 | 488 | RTA00000179AR.l.22.4 | M00001405B:E09 | 4314 |
| 2677 | Jan. 28, 1998 | 636 | RTA00000196F.k.20.1 | M00001402B:F12 | 6324 |
| 2678 | Jan. 28, 1998 | 691 | RTA00000195F.a.10.1 | M00001401C:H03 | 6803 |
| 2679 | Feb. 24, 1998 | 161 | RTA00000418F.n.22.1 | M00001659D:B05 | 79062 |
| 2680 | Jan. 28, 1998 | 611 | RTA00000196F.l.13.2 | M00001408A:H04 | 0 |
| 2681 | Jan. 28, 1998 | 535 | RTA00000196AF.n.19.1 | M00001423D:D12 | 6881 |
| 2682 | Jan. 28, 1998 | 413 | RTA00000200F.a.12.1 | M00004031D:B05 | 16751 |
| 2683 | Jan. 28, 1998 | 580 | RTA00000197F.a.12.1 | M00001438B:B09 | 7895 |
| 2684 | Jan. 28, 1998 | 681 | RTA00000180AF.l.04.2 | M00001432D:F05 | 11159 |
| 2685 | Jan. 28, 1998 | 568 | RTA00000196AF.p.01.2 | M00001430A:A02 | 87143 |
| 2686 | Jan. 28, 1998 | 736 | RTA00000196AF.o.13.1 | M00001428B:A09 | 0 |
| 2687 | Jan. 28, 1998 | 438 | RTA00000180AR.g.03.4 | M00001425A:C11 | 9024 |
| 2687 | Jan. 28, 1998 | 95 | RTA00000180AF.g.3.1 | M00001425A:C11 | 9024 |
| 2688 | Jan. 28, 1998 | 514 | RTA00000196AF.n.02.1 | M00001417D:A04 | 39260 |
| 2689 | Jan. 28, 1998 | 741 | RTA00000196AF.n.22.1 | M00001424B:H04 | 9572 |
| 2690 | Jan. 28, 1998 | 609 | RTA00000196AF.n.05.1 | M00001418B:F07 | 12531 |
| 2690 | Feb. 24, 1998 | 1120 | RTA00000353R.l.23.1 | M00001418B:F07 | 12531 |
| 2691 | Jan. 28, 1998 | 462 | RTA00000196AF.n.17.1 | M00001423D:A09 | 12477 |
| 2692 | Jan. 28, 1998 | 477 | RTA00000180AR.e.22.2 | M00001423A:G05 | 7714 |
| 2693 | Jan. 28, 1998 | 445 | RTA00000196AF.n.13.1 | M00001422C:F12 | 8396 |
| 2694 | Jan. 28, 1998 | 696 | RTA00000180AR.d.16.3 | M00001419D:C10 | 11393 |
| 2694 | Feb. 24, 1998 | 1184 | RTA00000345F.h.08.1 | M00001419D:C10 | 11393 |
| 2695 | Jan. 28, 1998 | 696 | RTA00000180AR.d.16.3 | M00001419D:C10 | 11393 |
| 2695 | Feb. 24, 1998 | 1184 | RTA00000345F.h.08.1 | M00001419D:C10 | 11393 |
| 2696 | Jan. 28, 1998 | 541 | RTA00000197AR.b.16.1 | M00001445C:A08 | 0 |
| 2697 | Jan. 28, 1998 | 95 | RTA00000180AF.g.3.1 | M00001425A:C11 | 9024 |
| 2697 | Jan. 28, 1998 | 438 | RTA00000180AR.g.03.4 | M00001425A:C11 | 9024 |
| 2698 | Jan. 28, 1998 | 536 | RTA00000193AR.a.2.3 | M00004216D:D03 | 0 |
| 2699 | Jan. 28, 1998 | 588 | RTA00000191AF.b.4.1 | M00003983C:F03 | 14936 |
| 2700 | Jan. 28, 1998 | 401 | RTA00000195F.e.04.1 | M00004465D:D04 | 6731 |
| 2701 | Feb. 24, 1998 | 91 | RTA00000355R.e.15.1 | M00004316A:G09 | 22639 |
| 2701 | Jan. 28, 1998 | 410 | RTA00000201F.a.20.1 | M00004316A:G09 | 22639 |
| 2702 | Jan. 28, 1998 | 410 | RTA00000201F.a.20.1 | M00004316A:G09 | 22639 |
| 2702 | Feb. 24, 1998 | 91 | RTA00000355R.e.15.1 | M00004316A:G09 | 22639 |
| 2703 | Jan. 28, 1998 | 716 | RTA00000200F.p.05.1 | M00004285C:A08 | 3984 |
| 2704 | Feb. 24, 1998 | 434 | RTA00000348R.b.16.1 | M00001347B:H04 | 6510 |
| 2705 | Jan. 28, 1998 | 528 | RTA00000200F.n.09.2 | M00004249D:B08 | 12391 |
| 2706 | Feb. 24, 1998 | 575 | RTA00000345F.a.18.1 | M00001351C:B06 | 5517 |
| 2707 | Jan. 28, 1998 | 658 | RTA00000193AF.a.1.1 | M00004216D:C03 | 16501 |
| 2708 | Jan. 28, 1998 | 472 | RTA00000192AF.p.17.1 | M00004214C:H05 | 11451 |
| 2709 | Jan. 28, 1998 | 478 | RTA00000192AR.o.24.2 | M00004210B:B05 | 7191 |
| 2710 | Jan. 28, 1998 | 753 | RTA00000192AF.o.17.1 | M00004208D:B10 | 5275 |
| 2711 | Jan. 28, 1998 | 563 | RTA00000192AR.o.16.2 | M00004208B:F05 | 9061 |
| 2712 | Jan. 28, 1998 | 730 | RTA00000192AF.o.11.1 | M00004205D:F06 | 0 |
| 2713 | Jan. 28, 1998 | 624 | RTA00000200F.o.15.1 | M00004275A:B03 | 7866 |
| 2714 | Feb. 24, 1998 | 169 | RTA00000347F.a.17.1 | M00001366D:C06 | 16723 |
| 2715 | Jan. 28, 1998 | 656 | RTA00000178AR.h.22.3 | M00001376B:A08 | 19230 |
| 2715 | Jan. 28, 1998 | 657 | RTA00000178AR.h.22.2 | M00001376B:A08 | 19230 |
| 2715 | Feb. 24, 1998 | 1137 | RTA00000345F.d.03.1 | M00001376B:A08 | 19230 |
| 2716 | Jan. 28, 1998 | 657 | RTA00000178AR.h.22.2 | M00001376B:A08 | 19230 |
| 2716 | Jan. 28, 1998 | 656 | RTA00000178AR.h.22.3 | M00001376B:A08 | 19230 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2716 | Feb. 24, 1998 | 1137 | RTA00000345F.d.03.1 | M00001376B:A08 | 19230 |
| 2717 | Jan. 28, 1998 | 522 | RTA00000178AR.h.17.2 | M00001376A:C05 | 23824 |
| 2717 | Feb. 24, 1998 | 1095 | RTA00000345F.c.12.1 | M00001376A:C05 | 23824 |
| 2718 | Jan. 28, 1998 | 522 | RTA00000178AR.h.17.2 | M00001376A:C05 | 23824 |
| 2718 | Feb. 24, 1998 | 1095 | RTA00000345F.c.12.1 | M00001376A:C05 | 23824 |
| 2719 | Feb. 24, 1998 | 1155 | RTA00000353R.h.04.1 | M00001375B:C06 | 17123 |
| 2720 | Jan. 28, 1998 | 614 | RTA00000201F.f.03.1 | M00004493B:D09 | 22633 |
| 2721 | Feb. 24, 1998 | 16 | RTA00000399F.a.02.1 | M00001366D:C12 | 0 |
| 2722 | Jan. 28, 1998 | 436 | RTA00000200AF.k.11.1 | M00004197C:F03 | 9796 |
| 2722 | Jan. 28, 1998 | 501 | RTA00000200R.k.11.1 | M00004197C:F03 | 9796 |
| 2723 | Feb. 24, 1998 | 1140 | RTA00000339F.c.05.1 | M00001365A:H10 | 3908 |
| 2724 | Feb. 24, 1998 | 322 | RTA00000339F.c.24.1 | M00001364B:B06 | 5516 |
| 2725 | Feb. 24, 1998 | 888 | RTA00000339R.c.04.1 | M00001362D:H01 | 1805 |
| 2726 | Jan. 28, 1998 | 33 | RTA00000178AR.a.20.1 | M00001362C:H11 | 945 |
| 2726 | Feb. 24, 1998 | 979 | RTA00000345F.b.17.1 | M00001362C:H11 | 945 |
| 2727 | Jan. 28, 1998 | 33 | RTA00000178AR.a.20.1 | M00001362C:H11 | 945 |
| 2727 | Feb. 24, 1998 | 979 | RTA00000345F.b.17.1 | M00001362C:H11 | 945 |
| 2728 | Feb. 24, 1998 | 1173 | RTA00000339R.b.07.1 | M00001360A:G10 | 6826 |
| 2729 | Feb. 24, 1998 | 973 | RTA00000339F.b.22.1 | M00001373D:B03 | 6867 |
| 2730 | Jan. 28, 1998 | 581 | RTA00000191AF.p.3.2 | M00004104B:F11 | 17 |
| 2731 | Jan. 28, 1998 | 637 | RTA00000200AF.g.15.1 | M00004135B:G01 | 22898 |
| 2731 | Jan. 28, 1998 | 476 | RTA00000200R.g.15.1 | M00004135B:G01 | 22898 |
| 2732 | Jan. 28, 1998 | 637 | RTA00000200AF.g.15.1 | M00004135B:G01 | 22898 |
| 2732 | Jan. 28, 1998 | 476 | RTA00000200R.g.15.1 | M00004135B:G01 | 22898 |
| 2733 | Jan. 28, 1998 | 474 | RTA00000192AR.d.1.3 | M00004130D:H01 | 14507 |
| 2734 | Jan. 28, 1998 | 735 | RTA00000192AF.b.11.1 | M00004117A:G01 | 40014 |
| 2735 | Jan. 28, 1998 | 726 | RTA00000200R.f.10.1 | M00004111D:B07 | 4 |
| 2736 | Jan. 28, 1998 | 752 | RTA00000192AF.o.7.1 | M00004204D:C03 | 5275 |
| 2737 | Jan. 28, 1998 | 516 | RTA00000200AF.e.23.1 | M00004107B:A06 | 14686 |
| 2738 | Jan. 28, 1998 | 685 | RTA00000200F.i.9.1 | M00004159C:F09 | 36756 |
| 2738 | Feb. 24, 1998 | 704 | RTA00000355R.a.12.1 | M00004159C:F09 | 36756 |
| 2739 | Jan. 28, 1998 | 417 | RTA00000200R.d.16.1 | M00004085A:B02 | 39875 |
| 2740 | Jan. 28, 1998 | 454 | RTA00000200R.d.04.1 | M00004078A:A06 | 5506 |
| 2741 | Jan. 28, 1998 | 551 | RTA00000200AR.c.24.1 | M00004076D:D04 | 15972 |
| 2742 | Jan. 28, 1998 | 524 | RTA00000191AF.j.24.1 | M00004076B:G03 | 0 |
| 2743 | Feb. 24, 1998 | 1166 | RTA00000347F.h.01.1 | M00004040A:G12 | 12043 |
| 2743 | Jan. 28, 1998 | 684 | RTA00000200AR.b.11.1 | M00004040A:G12 | 12043 |
| 2744 | Feb. 24, 1998 | 1166 | RTA00000347F.h.01.1 | M00004040A:G12 | 12043 |
| 2744 | Jan. 28, 1998 | 684 | RTA00000200AR.b.11.1 | M00004040A:G12 | 12043 |
| 2745 | Jan. 28, 1998 | 415 | RTA00000200AF.f.09.1 | M00004111C:E11 | 12863 |
| 2746 | Jan. 28, 1998 | 448 | RTA00000200AF.j.9.1 | M00004177C:A01 | 8608 |
| 2747 | Feb. 24, 1998 | 446 | RTA00000133A.m.19.2 | M00001512A:G05 | 80167 |
| 2748 | Jan. 28, 1998 | 436 | RTA00000200AF.k.11.1 | M00004197C:F03 | 9796 |
| 2748 | Jan. 28, 1998 | 501 | RTA00000200R.k.11.1 | M00004197C:F03 | 9796 |
| 2749 | Jan. 28, 1998 | 436 | RTA00000200AF.k.11.1 | M00004197C:F03 | 9796 |
| 2749 | Jan. 28, 1998 | 501 | RTA00000200R.k.11.1 | M00004197C:F03 | 9796 |
| 2750 | Jan. 28, 1998 | 436 | RTA00000200AF.k.11.1 | M00004197C:F03 | 9796 |
| 2750 | Jan. 28, 1998 | 501 | RTA00000200R.k.11.1 | M00004197C:F03 | 9796 |
| 2751 | Jan. 28, 1998 | 610 | RTA00000200AF.k.2.1 | M00004188D:G08 | 35924 |
| 2752 | Jan. 28, 1998 | 494 | RTA00000200AF.k.1.1 | M00004188C:A09 | 40049 |
| 2752 | Jan. 28, 1998 | 194 | RTA00000200R.k.01.1 | M00004188C:A09 | 40049 |
| 2753 | Jan. 28, 1998 | 574 | RTA00000192AF.f.3.1 | M00004146C:C11 | 5257 |
| 2754 | Jan. 28, 1998 | 604 | RTA00000200AF.j.15.1 | M00004185D:E04 | 5849 |
| 2755 | Jan. 28, 1998 | 579 | RTA00000200F.i.7.1 | M00004157D:B03 | 22322 |
| 2756 | Jan. 28, 1998 | 634 | RTA00000192AF.j.6.1 | M00004172C:D08 | 11494 |
| 2757 | Jan. 28, 1998 | 421 | RTA00000200AF.i.21.1 | M00004167D:A07 | 5316 |
| 2758 | Jan. 28, 1998 | 543 | RTA00000200AF.i.19.1 | M00004167A:H03 | 14722 |
| 2759 | Jan. 28, 1998 | 483 | RTA00000192AF.h.19.1 | M00004162C:A07 | 4642 |
| 2760 | Feb. 24, 1998 | 704 | RTA00000355R.a.12.1 | M00004159C:F09 | 36756 |
| 2760 | Jan. 28, 1998 | 685 | RTA00000200F.i.9.1 | M00004159C:F09 | 36756 |
| 2761 | Jan. 28, 1998 | 607 | RTA00000200AF.k.12.1 | M00004198B:D02 | 7359 |
| 2762 | Jan. 28, 1998 | 494 | RTA00000200AF.k.1.1 | M00004188C:A09 | 40049 |
| 2762 | Jan. 28, 1998 | 194 | RTA00000200R.k.01.1 | M00004188C:A09 | 40049 |
| 2763 | Feb. 24, 1998 | 554 | RTA00000409F.i.03.1 | M00001610A:E09 | 75968 |
| 2764 | Feb. 24, 1998 | 1228 | RTA00000404F.h.10.1 | M00001618A:A03 | 37148 |
| 2765 | Feb. 24, 1998 | 332 | RTA00000409F.i.24.1 | M00001611B:A09 | 76967 |
| 2766 | Feb. 24, 1998 | 1023 | RTA00000404F.f.12.1 | M00001611B:A05 | 39209 |
| 2767 | Feb. 24, 1998 | 572 | RTA00000422F.l.03.1 | M00001610D:D05 | 39147 |
| 2768 | Feb. 24, 1998 | 497 | RTA00000350R.f.21.1 | M00001610C:E07 | 22110 |
| 2769 | Feb. 24, 1998 | 557 | RTA00000409F.j.05.1 | M00001611C:C12 | 74128 |
| 2770 | Feb. 24, 1998 | 223 | RTA00000404F.e.22.1 | M00001610A:H05 | 11344 |
| 2771 | Feb. 24, 1998 | 165 | RTA00000409F.j.07.1 | M00001611C:H11 | 75190 |
| 2772 | Feb. 24, 1998 | 959 | RTA00000340F.g.20.1 | M00001609D:G10 | 4089 |
| 2773 | Feb. 24, 1998 | 737 | RTA00000404F.e.15.1 | M00001609B:C09 | 39101 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2774 | Feb. 24, 1998 | 974 | RTA00000340F.h.07.1 | M00001608D:D11 | 19254 |
| 2775 | Feb. 24, 1998 | 857 | RTA00000404F.e.09.1 | M00001608B:A09 | 39121 |
| 2776 | Jan. 28, 1998 | 340 | RTA00000185AF.n.8.1 | M00001608B:A03 | 0 |
| 2776 | Feb. 24, 1998 | 75 | RTA00000350R.i.22.1 | M00001608B:A03 | 0 |
| 2777 | Jan. 28, 1998 | 340 | RTA00000185AF.n.8.1 | M00001608B:A03 | 0 |
| 2777 | Feb. 24, 1998 | 75 | RTA00000350R.i.22.1 | M00001608B:A03 | 0 |
| 2778 | Feb. 24, 1998 | 546 | RTA00000409F.i.09.1 | M00001610B:C07 | 75279 |
| 2779 | Feb. 24, 1998 | 374 | RTA00000422F.m.04.1 | M00001615B:A09 | 38702 |
| 2780 | Feb. 24, 1998 | 505 | RTA00000121A.o.3.1 | M00001511A:A02 | 81437 |
| 2781 | Feb. 24, 1998 | 453 | RTA00000130A.h.13.1 | M00001617A:A01 | 80790 |
| 2782 | Feb. 24, 1998 | 163 | RTA00000422F.l.23.1 | M00001616D:C11 | 4240 |
| 2783 | Feb. 24, 1998 | 889 | RTA00000346F.b.16.1 | M00001615C:G05 | 16485 |
| 2784 | Feb. 24, 1998 | 203 | RTA00000404F.g.21.1 | M00001615C:A11 | 37947 |
| 2785 | Feb. 24, 1998 | 32 | RTA00000409F.j.02.1 | M00001611B:E06 | 76417 |
| 2786 | Feb. 24, 1998 | 872 | RTA00000409F.l.20.1 | M00001615B:G01 | 74394 |
| 2787 | Feb. 24, 1998 | 978 | RTA00000130A.e.20.1 | M00001606A:H09 | 79502 |
| 2788 | Feb. 24, 1998 | 45 | RTA00000409F.l.12.1 | M00001615A:D06 | 26755 |
| 2789 | Feb. 24, 1998 | 182 | RTA00000404F.g.14.1 | M00001614D:B08 | 8858 |
| 2790 | Feb. 24, 1998 | 912 | RTA00000404F.g.13.1 | M00001614C:E06 | 9436 |
| 2791 | Feb. 24, 1998 | 1191 | RTA00000340F.i.05.1 | M00001614B:E08 | 0 |
| 2792 | Feb. 24, 1998 | 192 | RTA00000421F.k.15.1 | M00001613D:B03 | 2222 |
| 2793 | Feb. 24, 1998 | 360 | RTA00000409F.j.19.1 | M00001613A:F03 | 73792 |
| 2794 | Feb. 24, 1998 | 57 | RTA00000409F.l.21.1 | M00001615B:G07 | 73143 |
| 2795 | Feb. 24, 1998 | 354 | RTA00000404F.c.03.2 | M00001592C:F11 | 39198 |
| 2796 | Feb. 24, 1998 | 791 | RTA00000399F.n.15.1 | M00001594D:C03 | 3213 |
| 2797 | Feb. 24, 1998 | 921 | RTA00000422F.j.02.1 | M00001594D:B08 | 10368 |
| 2798 | Feb. 24, 1998 | 1114 | RTA00000340F.f.22.1 | M00001594B:F12 | 1720 |
| 2799 | Feb. 24, 1998 | 966 | RTA00000422F.k.15.1 | M00001594A:G09 | 19253 |
| 2800 | Feb. 24, 1998 | 46 | RTA00000404F.c.20.1 | M00001594A:D08 | 39088 |
| 2801 | Feb. 24, 1998 | 955 | RTA00000404F.e.06.1 | M00001607D:F06 | 39315 |
| 2802 | Feb. 24, 1998 | 1103 | RTA00000346F.a.16.1 | M00001593A:B07 | 12082 |
| 2803 | Feb. 24, 1998 | 540 | RTA00000418F.i.18.1 | M00001595C:B05 | 78024 |
| 2804 | Feb. 24, 1998 | 1245 | RTA00000422F.k.22.1 | M00001592C:E05 | 4098 |
| 2805 | Feb. 24, 1998 | 693 | RTA00000404F.b.19.1 | M00001592B:A04 | 39281 |
| 2806 | Feb. 24, 1998 | 1013 | RTA00000404F.b.18.1 | M00001592A:H05 | 13669 |
| 2807 | Feb. 24, 1998 | 989 | RTA00000418F.i.12.1 | M00001592A:E02 | 78971 |
| 2808 | Feb. 24, 1998 | 404 | RTA00000404F.b.11.1 | M00001591D:F06 | 39079 |
| 2809 | Feb. 24, 1998 | 786 | RTA00000404F.b.09.1 | M00001591D:C07 | 39166 |
| 2810 | Feb. 24, 1998 | 1147 | RTA00000404F.c.18.1 | M00001594A:C01 | 38982 |
| 2811 | Feb. 24, 1998 | 686 | RTA00000129A.k.21.1 | M00001601A:E12 | 82067 |
| 2812 | Feb. 24, 1998 | 1011 | RTA00000400F.c.04.1 | M00001618A:F08 | 6445 |
| 2813 | Feb. 24, 1998 | 702 | RTA00000130A.d.5.1 | M00001605A:H03 | 82051 |
| 2814 | Feb. 24, 1998 | 425 | RTA00000130A.b.5.1 | M00001605A:E09 | 79579 |
| 2815 | Feb. 24, 1998 | 458 | RTA00000130A.a.19.1 | M00001605A:A06 | 0 |
| 2816 | Feb. 24, 1998 | 51 | RTA00000129A.n.21.1 | M00001604A:C11 | 79381 |
| 2817 | Feb. 24, 1998 | 804 | RTA00000129A.n.24.1 | M00001604A:C07 | 81409 |
| 2818 | Feb. 24, 1998 | 317 | RTA00000195AF.b.21.1 | M00001595B:A09 | 39055 |
| 2818 | Jan. 28, 1998 | 602 | RTA00000195AF.b.21.1 | M00001595B:A09 | 39055 |
| 2819 | Feb. 24, 1998 | 864 | RTA00000129A.n.17.1 | M00001604A:A09 | 79811 |
| 2820 | Feb. 24, 1998 | 317 | RTA00000195AF.b.21.1 | M00001595B:A09 | 39055 |
| 2820 | Jan. 28, 1998 | 602 | RTA00000195AF.b.21.1 | M00001595B:A09 | 39055 |
| 2821 | Feb. 24, 1998 | 875 | RTA00000129A.k.22.1 | M00001601A:E02 | 79639 |
| 2822 | Feb. 24, 1998 | 406 | RTA00000129A.k.12.1 | M00001601A:A06 | 79322 |
| 2823 | Feb. 24, 1998 | 179 | RTA00000418F.i.19.1 | M00001596D:E03 | 79180 |
| 2824 | Feb. 24, 1998 | 759 | RTA00000399F.o.06.1 | M00001595D:G03 | 13574 |
| 2825 | Feb. 24, 1998 | 306 | RTA00000404F.d.13.1 | M00001595D:A04 | 39036 |
| 2826 | Feb. 24, 1998 | 1055 | RTA00000346F.a.04.1 | M00001607B:C05 | 5382 |
| 2827 | Feb. 24, 1998 | 350 | RTA00000129A.p.3.1 | M00001604A:B08 | 32644 |
| 2828 | Feb. 24, 1998 | 721 | RTA00000422F.k.14.1 | M00001649D:A08 | 0 |
| 2829 | Feb. 24, 1998 | 391 | RTA00000130A.h.16.1 | M00001617A:A08 | 80761 |
| 2830 | Feb. 24, 1998 | 962 | RTA00000404F.p.05.2 | M00001652D:E09 | 1896 |
| 2831 | Feb. 24, 1998 | 65 | RTA00000404F.p.04.2 | M00001652D:E05 | 39069 |
| 2832 | Feb. 24, 1998 | 1108 | RTA00000346F.c.16.1 | M00001652B:G10 | 9579 |
| 2833 | Feb. 24, 1998 | 1200 | RTA00000422F.k.17.1 | M00001652A:A01 | 38955 |
| 2834 | Feb. 24, 1998 | 1218 | RTA00000418F.m.18.1 | M00001653B:G10 | 76479 |
| 2835 | Feb. 24, 1998 | 171 | RTA00000404F.n.20.1 | M00001650A:C11 | 26865 |
| 2836 | Feb. 24, 1998 | 180 | RTA00000400F.j.19.1 | M00001653C:D10 | 4086 |
| 2837 | Feb. 24, 1998 | 556 | RTA00000400F.i.11.1 | M00001649C:H10 | 2587 |
| 2838 | Feb. 24, 1998 | 848 | RTA00000404F.n.18.2 | M00001649C:E11 | 37169 |
| 2839 | Feb. 24, 1998 | 29 | RTA00000404F.n.16.2 | M00001649C:D05 | 39095 |
| 2840 | Feb. 24, 1998 | 146 | RTA00000404F.n.11.2 | M00001649A:E11 | 38001 |
| 2841 | Feb. 24, 1998 | 700 | RTA00000350R.m.14.1 | M00001644C:B07 | 39171 |
| 2842 | Feb. 24, 1998 | 699 | RTA00000340F.l.05.1 | M00001644B:D06 | 38935 |
| 2843 | Feb. 24, 1998 | 479 | RTA00000418F.m.10.1 | M00001651A:H11 | 79110 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2844 | Feb. 24, 1998 | 1169 | RTA00000405F.b.08.1 | M00001656B:E01 | 39182 |
| 2845 | Feb. 24, 1998 | 855 | RTA00000423F.a.01.1 | M00001659C:F10 | 39103 |
| 2846 | Feb. 24, 1998 | 363 | RTA00000405F.c.11.1 | M00001659A:D12 | 39068 |
| 2847 | Feb. 24, 1998 | 807 | RTA00000418F.n.11.1 | M00001658D:G12 | 78977 |
| 2848 | Feb. 24, 1998 | 795 | RTA00000418F.n.07.1 | M00001658B:A07 | 76316 |
| 2849 | Feb. 24, 1998 | 109 | RTA00000422F.p.24.2 | M00001658A:G09 | 5823 |
| 2850 | Feb. 24, 1998 | 696 | RTA00000404F.p.12.2 | M00001653B:C06 | 0 |
| 2851 | Feb. 24, 1998 | 369 | RTA00000410F.m.05.1 | M00001657B:B04 | 74964 |
| 2852 | Feb. 24, 1998 | 1229 | RTA00000422F.n.14.1 | M00001642C:G02 | 26787 |
| 2853 | Feb. 24, 1998 | 529 | RTA00000422F.o.19.2 | M00001655C:E01 | 13084 |
| 2854 | Feb. 24, 1998 | 327 | RTA00600405F.a.11.1 | M00001655A:B11 | 39124 |
| 2855 | Feb. 24, 1998 | 393 | RTA00000418F.m.24.1 | M00001654D:F12 | 77114 |
| 2856 | Feb. 24, 1998 | 381 | RTA00000418F.m.23.1 | M00001654D:F11 | 77195 |
| 2857 | Feb. 24, 1998 | 877 | RTA00000418F.m.22.1 | M00001654D:E12 | 74567 |
| 2858 | Feb. 24, 1998 | 166 | RTA00000418F.m.19.1 | M00001654D:A03 | 8890 |
| 2859 | Feb. 24, 1998 | 291 | RTA00000405F.c.01.1 | M00001657D:A04 | 19236 |
| 2860 | Feb. 24, 1998 | 356 | RTA00000409F.m.24.1 | M00001620D:H02 | 3942 |
| 2861 | Feb. 24, 1998 | 717 | RTA00000404F.i.22.1 | M00001625C:G05 | 39082 |
| 2862 | Feb. 24, 1998 | 648 | RTA00000340F.i.13.1 | M00001624B:B10 | 79299 |
| 2863 | Feb. 24, 1998 | 914 | RTA00000138A.m.15.1 | M00001624A:A03 | 41603 |
| 2864 | Feb. 24, 1998 | 587 | RTA00000130A.o.21.1 | M00001623A:F04 | 80218 |
| 2865 | Feb. 24, 1998 | 22 | RTA00000130A.m.15.1 | M00001622A:H12 | 81630 |
| 2866 | Feb. 24, 1998 | 767 | RTA00000138A.p.10.1 | M00001644A:H01 | 81625 |
| 2867 | Feb. 24, 1998 | 262 | RTA00000409F.n.14.1 | M00001621B:G05 | 78190 |
| 2868 | Feb. 24, 1998 | 960 | RTA00000404F.l.19.2 | M00001639B:H01 | 16196 |
| 2869 | Feb. 24, 1998 | 608 | RTA00000404F.i.12.1 | M00001620D:G11 | 39001 |
| 2870 | Feb. 24, 1998 | 342 | RTA00000404F.i.02.1 | M00001619D:D10 | 39015 |
| 2871 | Feb. 24, 1998 | 195 | RTA00000404F.h.22.1 | M00001619C:C07 | 18735 |
| 2872 | Feb. 24, 1998 | 214 | RTA00000404F.h.19.1 | M00001619A:E05 | 8096 |
| 2873 | Feb. 24, 1998 | 52 | RTA00000409F.m.12.1 | M00001618B:D09 | 73490 |
| 2874 | Feb. 24, 1998 | 769 | RTA00000340F.i.10.1 | M0000161°A:F10 | 3°561 |
| 2875 | Feb. 24, 1998 | 383 | RTA00000404F.i.18.1 | M00001621C:H12 | 21912 |
| 2876 | Feb. 24, 1998 | 256 | RTA00000404F.m.03.2 | M00001640A:H02 | 11799 |
| 2877 | Feb. 24, 1998 | 519 | RTA00000404F.l.10.1 | M00001638B:F10 | 23136 |
| 2878 | Feb. 24, 1998 | 646 | RTA00000421F.m.14.1 | M00001642A:F03 | 3524 |
| 2879 | Feb. 24, 1998 | 659 | RTA00000422F.m.24.1 | M00001641D:C04 | 39159 |
| 2880 | Feb. 24, 1998 | 701 | RTA00000418F.l.11.1 | M00001641C:H07 | 77158 |
| 2881 | Feb. 24, 1998 | 873 | RTA00000418F.l.06.1 | M00001641C:F01 | 73317 |
| 2882 | Feb. 24, 1998 | 422 | RTA00000418F.l.04.1 | M00001641C:D02 | 74140 |
| 2883 | Feb. 24, 1998 | 766 | RTA00000404F.j.01.1 | M00001625D:G10 | 26859 |
| 2884 | Feb. 24, 1998 | 20 | RTA00000404F.m.04.2 | M00001641A:A11 | 22720 |
| 2885 | Feb. 24, 1998 | 346 | RTA00000418F.j.08.1 | M00001626C:C11 | 73382 |
| 2886 | Feb. 24, 1998 | 141 | RTA00000418F.k.19.1 | M00001639C:C60 | 74932 |
| 2887 | Feb. 24, 1998 | 373 | RTA00000418F.k.18.1 | M00001639C:A10 | 75385 |
| 2888 | Feb. 24, 1998 | 405 | RTA00000418F.k.17.1 | M00001639C:A09 | 75390 |
| 2889 | Feb. 24, 1998 | 63 | RTA00000404F.l.20.2 | M00001639B:H05 | 38638 |
| 2889 | Feb. 24, 1998 | 133 | RTA00000404F.l.20.1 | M00001639B:H05 | 38638 |
| 2890 | Feb. 24, 1998 | 133 | RTA00000404F.l.20.1 | M00001639B:H05 | 38638 |
| 2890 | Feb. 24, 1998 | 63 | RTA00000404F.l.20.2 | M00001639B:H05 | 38638 |
| 2891 | Feb. 24, 1998 | 1261 | RTA00000404F.m.17.2 | M00001643B:E05 | 0 |
| 2892 | Feb. 24, 1998 | 626 | RTA00000410F.j.01.1 | M00001641B:F12 | 73399 |
| 2893 | Feb. 24, 1998 | 982 | RTA00000126A.p.23.2 | M00001552A:F06 | 80915 |
| 2894 | Feb. 24, 1998 | 196 | RTA00000418F.k.10.1 | M00001639A:G07 | 74454 |
| 2895 | Feb. 24, 1998 | 765 | RTA00000137A.j.15.4 | M00001559A:C08 | 4213 |
| 2896 | Feb. 24, 1998 | 895 | RTA00000137A.j.11.4 | M00001559A:A11 | 79752 |
| 2897 | Feb. 24, 1998 | 232 | RTA00000128A.b.20.1 | M00001558A:G09 | 79761 |
| 2898 | Feb. 24, 1998 | 152 | RTA00000127A.i.20.1 | M00001555A:B12 | 81418 |
| 2899 | Feb. 24, 1998 | 78 | RTA00000195AF.b.13.1 | M00001560D:A03 | 12605 |
| 2899 | Jan. 28, 1998 | 59 | RTA00000195AF.b.13.1 | M00001560D:A03 | 12605 |
| 2900 | Feb. 24, 1998 | 448 | RTA00000127A.a.3.1 | M00001552A:H10 | 13232 |
| 2901 | Feb. 24, 1998 | 801 | RTA00000128A.m.23.1 | M00001561A:D01 | 81441 |
| 2902 | Feb. 24, 1998 | 499 | RTA00000126A.p.18.2 | M00001552A:E10 | 80881 |
| 2903 | Feb. 24, 1998 | 1212 | RTA00000349R.o.03.1 | M00001551D:H07 | 23006 |
| 2904 | Feb. 24, 1998 | 484 | RTA00000126A.n.13.2 | M00001551A:H06 | 79735 |
| 2905 | Feb. 24, 1998 | 240 | RTA00000126A.n.7.2 | M00001551A:D06 | 79557 |
| 2906 | Feb. 24, 1998 | 451 | RTA00000126A.o.22.1 | M00001551A:A11 | 81752 |
| 2907 | Feb. 24, 1998 | 513 | RTA00000126A.k.7.2 | M00001550A:E07 | 79866 |
| 2908 | Feb. 24, 1998 | 578 | RTA00000127A.f.11.1 | M00001554A:A08 | 81463 |
| 2909 | Feb. 24, 1998 | 372 | RTA00000408F.p.24.1 | M00001579A:E03 | 74286 |
| 2910 | Feb. 24, 1998 | 985 | RTA00000409F.a.08.1 | M00001582D:B01 | 74978 |
| 2911 | Feb. 24, 1998 | 685 | RTA00000129A.a.13.2 | M00001582A:A03 | 79780 |
| 2912 | Feb. 24, 1998 | 574 | RTA00000403F.o.14.1 | M00001579D:H09 | 38971 |
| 2913 | Feb. 24, 1998 | 601 | RTA00000403F.o.13.1 | M00001579D:F04 | 39049 |
| 2914 | Feb. 24, 1998 | 432 | RTA00000418F.g.05.1 | M00001579C:H06 | 73075 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2915 | Jan. 28, 1998 | 59 | RTA00000195AF.b.13.1 | M00001560D:A03 | 12605 |
| 2915 | Feb. 24, 1998 | 78 | RTA00000195AF.b.13.1 | M00001560D:A03 | 12605 |
| 2916 | Feb. 24, 1998 | 491 | RTA00000418F.f.21.1 | M00001579B:F04 | 75157 |
| 2917 | Feb. 24, 1998 | 612 | RTA00000125A.k.14.1 | M00001545A:G05 | 79457 |
| 2918 | Jan. 28, 1998 | 248 | RTA00000198R.c.14.1 | M00001578D:C04 | 39814 |
| 2918 | Feb. 24, 1998 | 778 | RTA00000347F.e.05.1 | M00001578D:C04 | 39814 |
| 2919 | Jan. 28, 1998 | 248 | RTA00000198R.c.14.1 | M00001578D:C04 | 39814 |
| 2919 | Feb. 24, 1998 | 778 | RTA00000347F.e.05.1 | M00001578D:C04 | 39814 |
| 2920 | Feb. 24, 1998 | 361 | RTA00000422F.d.16.1 | M00001570C:G03 | 39133 |
| 2921 | Feb. 24, 1998 | 173 | RTA00000418F.d.13.1 | M00001570A:H01 | 74309 |
| 2922 | Feb. 24, 1998 | 1195 | RTA00000422F.e.23.1 | M00001567D:B03 | 19246 |
| 2923 | Feb. 24, 1998 | 1168 | RTA00000421F.b.06.1 | M00001567A:B09 | 2113 |
| 2924 | Feb. 24, 1998 | 580 | RTA00000403F.o.07.1 | M00001579C:A01 | 39037 |
| 2925 | Feb. 24, 1998 | 531 | RTA00000345F.n.12.1 | M00001528A:C04 | 7337 |
| 2926 | Feb. 24, 1998 | 154 | RTA00000340F.b.21.1 | M00001533D:A08 | 8001 |
| 2927 | Feb. 24, 1998 | 19 | RTA00000123A.k.23.1 | M00001533A:G05 | 80313 |
| 2928 | Feb. 24, 1998 | 1265 | RTA00000340F.d.07.1 | M00001532D:A06 | 0 |
| 2929 | Feb. 24, 1998 | 1124 | RTA00000123A.h.22.1 | M00001532A:C01 | 17124 |
| 2930 | Feb. 24, 1998 | 1241 | RTA00000408F.l.14.1 | M00001530A:E10 | 12001 |
| 2931 | Feb. 24, 1998 | 534 | RTA00000126A.g.7.1 | M00001548A:H04 | 1902 |
| 2932 | Feb. 24, 1998 | 694 | RTA00000418F.c.07.1 | M00001529D:C05 | 73245 |
| 2933 | Feb. 24, 1998 | 1034 | RTA00000124A.f.16.3 | M00001536A:F11 | 47430 |
| 2934 | Feb. 24, 1998 | 790 | RTA00000345F.n.08.1 | M00001517A:B11 | 0 |
| 2935 | Feb. 24, 1998 | 613 | RTA00000122A.j.22.1 | M00001516A:F06 | 81151 |
| 2936 | Feb. 24, 1998 | 885 | RTA00000122A.j.17.1 | M00001516A:D02 | 62736 |
| 2937 | Feb. 24, 1998 | 1262 | RTA00000122A.h.4.1 | M00001514A:G03 | 33576 |
| 2938 | Feb. 24, 1998 | 135 | RTA00000122A.d.5.1 | M00001513A:F05 | 81155 |
| 2939 | Jan. 28, 1998 | 391 | RTA00000179AF.e.20.3 | M00001396A:C03 | 4009 |
| 2940 | Feb. 24, 1998 | 537 | RTA00000408F.l.09.1 | M00001530A:A09 | 75487 |
| 2941 | Feb. 24, 1998 | 683 | RTA00000403F.j.21.1 | M00001540D:E02 | 24723 |
| 2942 | Feb. 24, 1998 | 343 | RTA00000422F.g.21.1 | M00001583A:F07 | 17232 |
| 2943 | Feb. 24, 1998 | 226 | RTA00000125A.k.10.1 | M00001545A:F02 | 81641 |
| 2944 | Feb. 24, 1998 | 763 | RTA00000135A.m.18.1 | M00001545A:C03 | 19255 |
| 2945 | Feb. 24, 1998 | 156 | RTA00000125A.k.1.1 | M00001545A:B12 | 0 |
| 2946 | Feb. 24, 1998 | 597 | RTA00000135A.l.1.2 | M00001545A:B10 | 39426 |
| 2947 | Feb. 24, 1998 | 586 | RTA00000125A.g.24.1 | M00001544A:F05 | 80397 |
| 2948 | Feb. 24, 1998 | 467 | RTA00000123A.n.13.2 | M00001534A:D03 | 39167 |
| 2949 | Feb. 24, 1998 | 830 | RTA00000347F.b.08.1 | M00001541B:E05 | 17591 |
| 2950 | Feb. 24, 1998 | 997 | RTA00000134A.l.9.1 | M00001535A:D10 | 81814 |
| 2951 | Feb. 24, 1998 | 371 | RTA00000403F.j.17.1 | M00001539D:B10 | 38563 |
| 2952 | Feb. 24, 1998 | 33 | RTA00000403F.j.15.1 | M00001539B:G07 | 23840 |
| 2953 | Feb. 24, 1998 | 1209 | RTA00000408F.n.05.2 | M00001539A:H02 | 77883 |
| 2954 | Feb. 24, 1998 | 530 | RTA00000408F.n.02.2 | M00001539A:E01 | 76993 |
| 2955 | Feb. 24, 1998 | 1213 | RTA00000135A.a.23.1 | M00001537A:H05 | 27054 |
| 2956 | Feb. 24, 1998 | 347 | RTA00000125A.n.4.1 | M00001546A:D08 | 81984 |
| 2957 | Feb. 24, 1998 | 472 | RTA00000135A.f.14.2 | M00001542A:G12 | 79969 |
| 2958 | Feb. 24, 1998 | 243 | RTA00000410F.c.14.1 | M00001634A:H05 | 77809 |
| 2959 | Feb. 24, 1998 | 919 | RTA00000410F.d.18.1 | M00001635D:D05 | 75458 |
| 2960 | Feb. 24, 1998 | 825 | RTA00000404F.k.22.2 | M00001635D:C12 | 39084 |
| 2960 | Feb. 24, 1998 | 364 | RTA00000404F.k.22.1 | M00001635D:C12 | 39084 |
| 2961 | Feb. 24, 1998 | 825 | RTA00000404F.k.22.2 | M00001635D:C12 | 39084 |
| 2961 | Feb. 24, 1998 | 364 | RTA00000404F.k.22.1 | M00001635D:C12 | 39084 |
| 2962 | Feb. 24, 1998 | 595 | RTA00000410F.d.10.1 | M00001635B:H02 | 77561 |
| 2963 | Feb. 24, 1998 | 175 | RTA00000410F.d.09.1 | M00001635B:H01 | 76964 |
| 2964 | Feb. 24, 1998 | 206 | RTA00000410F.b.15.1 | M00001633C:F09 | 77100 |
| 2965 | Feb. 24, 1998 | 1083 | RTA00000418F.j.20.1 | M00001634D:D04 | 77101 |
| 2966 | Feb. 24, 1998 | 922 | RTA00000410F.e.09.1 | M00001636A:F08 | 76093 |
| 2967 | Feb. 24, 1998 | 1035 | RTA00000404F.k.15.1 | M00001634A:B04 | 18225 |
| 2968 | Feb. 24, 1998 | 1167 | RTA00000410F.c.06.1 | M00001633D:H06 | 77784 |
| 2969 | Feb. 24, 1998 | 53 | RTA00000410F.c.04.1 | M00001633D:G09 | 74099 |
| 2970 | Feb. 24, 1998 | 567 | RTA00000410F.c.02.1 | M00001633D:D12 | 75055 |
| 2971 | Feb. 24, 1998 | 819 | RTA00000410F.b.24.1 | M00001633D:D09 | 75104 |
| 2972 | Feb. 24, 1998 | 666 | RTA00000403F.o.19.1 | M00001582D:F02 | 78615 |
| 2973 | Feb. 24, 1998 | 559 | RTA00000418F.k.03.1 | M00001634D:G11 | 78901 |
| 2974 | Feb. 24, 1998 | 999 | RTA00000418F.k.04.1 | M00001637A:A03 | 75864 |
| 2975 | Feb. 24, 1998 | 936 | RTA00000121A.n.23.1 | M00001511A:G01 | 26981 |
| 2976 | Feb. 24, 1998 | 201 | RTA00000404F.l.09.1 | M00001638B:E12 | 39176 |
| 2977 | Feb. 24, 1998 | 1160 | RTA00000400F.g.02.1 | M00001638B:E03 | 1508 |
| 2978 | Feb. 24, 1998 | 827 | RTA00000410F.f.12.1 | M00001637C:E03 | 73883 |
| 2979 | Feb. 24, 1998 | 622 | RTA00000404F.l.07.1 | M00001637C:C06 | 10798 |
| 2980 | Feb. 24, 1998 | 365 | RTA00000418F.k.07.1 | M00001637A:F10 | 75067 |
| 2981 | Feb. 24, 1998 | 248 | RTA00000404F.k.24.1 | M00001636A:C03 | 15256 |
| 2982 | Feb. 24, 1998 | 25 | RTA00000418F.k.05.1 | M00001637A:A06 | 73021 |
| 2983 | Feb. 24, 1998 | 1178 | RTA00000400F.f.11.1 | M00001636A:E07 | 4088 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 2984 | Feb. 24, 1998 | 1180 | RTA00000404F.l.05.1 | M00001636D:F09 | 38671 |
| 2985 | Feb. 24, 1998 | 711 | RTA00000404F.l.03.2 | M00001636B:G11 | 40272 |
| 2985 | Feb. 24, 1998 | 785 | RTA00000404F.l.03.1 | M00001636B:G11 | 40272 |
| 2986 | Feb. 24, 1998 | 785 | RTA00000404F.l.03.1 | M00001636B:G11 | 40272 |
| 2986 | Feb. 24, 1998 | 711 | RTA00000404F.l.03.2 | M00001636B:G11 | 40272 |
| 2987 | Feb. 24, 1998 | 711 | RTA00000404F.l.03.2 | M00001636B:G11 | 40272 |
| 2987 | Feb. 24, 1998 | 785 | RTA00000404F.l.03.1 | M00001636B:G11 | 40272 |
| 2988 | Feb. 24, 1998 | 711 | RTA00000404F.l.03.2 | M00001636B:G11 | 40272 |
| 2988 | Feb. 24, 1998 | 785 | RTA00000404F.l.03.1 | M00001636B:G11 | 40272 |
| 2989 | Feb. 24, 1998 | 1106 | RTA00000410F.b.17.1 | M00001633C:H05 | 77458 |
| 2990 | Feb. 24, 1998 | 253 | RTA00000400F.f.18.1 | M00001637A:E10 | 3764 |
| 2991 | Feb. 24, 1998 | 562 | RTA00000401F.j.17.1 | M00003901B:C05 | 5483 |
| 2992 | Feb. 24, 1998 | 1082 | RTA00000137A.o.22.1 | M00001587A:D01 | 0 |
| 2993 | Feb. 24, 1998 | 594 | RTA00000129A.c.18.2 | M00001587A:B10 | 37216 |
| 2994 | Feb. 24, 1998 | 891 | RTA00000137A.p.12.1 | M00001587A:B01 | 80614 |
| 2995 | Feb. 24, 1998 | 131 | RTA00000418F.g.22.1 | M00001585B:F01 | 74837 |
| 2996 | Feb. 24, 1998 | 880 | RTA00000418F.g.20.1 | M00001585B:C03 | 74626 |
| 2997 | Feb. 24, 1998 | 742 | RTA00000410F.b.18.1 | M00001633C:H11 | 76701 |
| 2998 | Feb. 24, 1998 | 879 | RTA00000409F.b.19.1 | M00001584D:H02 | 14479 |
| 2999 | Feb. 24, 1998 | 167 | RTA00000399F.l.14.1 | M00001590B:G08 | 3354 |
| 3000 | Feb. 24, 1998 | 1260 | RTA00000422F.f.18.1 | M00001583D:B08 | 24528 |
| 3000 | Feb. 24, 1998 | 1258 | RTA00000403F.p.05.2 | M00001553D:B08 | 24528 |
| 3001 | Feb. 24, 1998 | 1260 | RTA00000422F.f.18.1 | M00001583D:B08 | 24528 |
| 3001 | Feb. 24, 1998 | 1258 | RTA00000403F.p.05.2 | M00001583D:B08 | 24528 |
| 3002 | Feb. 24, 1998 | 1260 | RTA00000422F.f.18.1 | M00001583D:B08 | 24528 |
| 3002 | Feb. 24, 1998 | 1258 | RTA00000403F.p.05.2 | M00001583D:B08 | 24528 |
| 3003 | Feb. 24, 1998 | 1260 | RTA00000422F.f.18.1 | M00001583D:B08 | 24528 |
| 3003 | Feb. 24, 1998 | 1258 | RTA00000403F.p.05.2 | M00001583D:B08 | 24528 |
| 3004 | Feb. 24, 1998 | 67 | RTA00000409F.a.22.1 | M00001583B:F02 | 75200 |
| 3005 | Feb. 24, 1998 | 564 | RTA00000418F.k.08.1 | M00001639A:C03 | 18259 |
| 3006 | Jan. 28, 1998 | 282 | RTA00000193AF.c.15.1 | M00004248B:E08 | 3726 |
| 3007 | Feb. 24, 1998 | 242 | RTA00000404F.j.08.1 | M00001629B:B08 | 39066 |
| 3008 | Feb. 24, 1998 | 669 | RTA00000410F.b.10.1 | M00001633C:B09 | 74504 |
| 3009 | Feb. 24, 1998 | 725 | RTA00000410F.b.07.1 | M00001633C:A05 | 78916 |
| 3010 | Feb. 24, 1998 | 423 | RTA00000410F.a.16.1 | M00001633A:E06 | 73548 |
| 3011 | Feb. 24, 1998 | 695 | RTA00000418F.j.15.1 | M00001632C:H07 | 74855 |
| 3012 | Feb. 24, 1998 | 901 | RTA00000418F.j.14.1 | M00001632C:B10 | 32623 |
| 3013 | Feb. 24, 1998 | 752 | RTA00000410F.a.08.1 | M00001632A:B10 | 73324 |
| 3014 | Feb. 24, 1998 | 1007 | RTA00000404F.a.01.1 | M00001589B:B08 | 19251 |
| 3015 | Feb. 24, 1998 | 1093 | RTA00000340F.i.15.1 | M00001629C:E07 | 26815 |
| 3016 | Feb. 24, 1998 | 664 | RTA00000404F.a.09.1 | M00001589C:E06 | 38985 |
| 3017 | Feb. 24, 1998 | 1246 | RTA00000418F.j.11.1 | M00001626C:E04 | 73853 |
| 3018 | Feb. 24, 1998 | 174 | RTA00000404F.b.02.1 | M00001591B:B12 | 38984 |
| 3019 | Feb. 24, 1998 | 1142 | RTA00000418F.i.06.1 | M00001591B:B06 | 75151 |
| 3020 | Feb. 24, 1998 | 740 | RTA00000399F.l.19.1 | M00001590D:G07 | 40145 |
| 3021 | Feb. 24, 1998 | 1098 | RTA00000409F.d.16.1 | M00001590C:F10 | 76090 |
| 3022 | Feb. 24, 1998 | 591 | RTA00000409F.a.16.1 | M00001583A:A05 | 73990 |
| 3023 | Feb. 24, 1998 | 1110 | RTA00000404F.j.24.1 | M00001631D:G05 | 39067 |
| 3024 | Jan. 28, 1998 | 108 | RTA00000183AR.h.23.2 | M00001528A:F09 | 18957 |
| 3024 | Jan. 28, 1998 | 236 | RTA00000183AR.h.23.1 | M00001528A:F09 | 18957 |
| 3024 | Jan. 28, 1998 | 129 | RTA00000134A.d.10.1 | M00001528A:F09 | 18957 |
| 3025 | Jan. 28, 1998 | 68 | RTA00000184F.k.19.1 | M00001558B:D08 | 8022 |
| 3025 | Jan. 28, 1998 | 63 | RTA00000184AF.k.19.1 | M00001558B:D08 | 8022 |
| 3026 | Jan. 28, 1998 | 269 | RTA00000183AF.k.13.1 | M00001534B:C12 | 0 |
| 3027 | Jan. 28, 1998 | 129 | RTA00000134A.d.10.1 | M00001528A:F09 | 18957 |
| 3027 | Jan. 28, 1998 | 108 | RTA00000183AR.h.23.2 | M00001528A:F09 | 18957 |
| 3027 | Jan. 28, 1998 | 236 | RTA00000183AR.h.23.1 | M00001528A:F09 | 18957 |
| 3028 | Jan. 28, 1998 | 129 | RTA00000134A.d.10.1 | M00001528A:F09 | 18957 |
| 3028 | Jan. 28, 1998 | 108 | RTA00000183AR.h.23.2 | M00001528A:F09 | 18957 |
| 3028 | Jan. 28, 1998 | 236 | RTA00000183AR.h.23.1 | M00001528A:F09 | 18957 |
| 3029 | Jan. 28, 1998 | 236 | RTA00000183AR.h.23.1 | M00001528A:F09 | 18957 |
| 3029 | Jan. 28, 1998 | 108 | RTA00000183AR.h.23.2 | M00001528A:F09 | 18957 |
| 3029 | Jan. 28, 1998 | 129 | RTA00000134A.d.10.1 | M00001528A:F09 | 18957 |
| 3030 | Jan. 28, 1998 | 34 | RTA00000197AF.n.8.1 | M00001536D:A12 | 4101 |
| 3031 | Jan. 28, 1998 | 108 | RTA00000183AR.h.23.2 | M00001528A:F09 | 18957 |
| 3031 | Jan. 28, 1998 | 129 | RTA00000134A.d.10.1 | M00001528A:F09 | 18957 |
| 3031 | Jan. 28, 1998 | 236 | RTA00000183AR.h.23.1 | M00001528A:F09 | 18957 |
| 3032 | Jan. 28, 1998 | 106 | RTA00000197AF.n.21.1 | M00001540B:C09 | 0 |
| 3033 | Jan. 28, 1998 | 236 | RTA00000183AR.h.23.1 | M00001528A:F09 | 18957 |
| 3033 | Jan. 28, 1998 | 129 | RTA00000134A.d.10.1 | M00001528A:F09 | 18957 |
| 3033 | Jan. 28, 1998 | 108 | RTA00000183AR.h.23.2 | M00001528A:F09 | 18957 |
| 3034 | Jan. 28, 1998 | 108 | RTA00000183AR.h.232 | M00001528A:F09 | 18957 |
| 3034 | Jan. 28, 1998 | 236 | RTA00000183AR.h.23.1 | M00001528A:F09 | 18957 |
| 3034 | Jan. 28, 1998 | 129 | RTA00000134A.d.10.1 | M00001528A:F09 | 18957 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3035 | Jan. 28, 1998 | 129 | RTA00000134A.d.10.1 | M00001528A:F09 | 18957 |
| 3035 | Jan. 28, 1998 | 108 | RTA00000183AR.h.23.2 | M00001528A:F09 | 18957 |
| 3035 | Jan. 28, 1998 | 236 | RTA00000183AR.h.23.1 | M00001528A:F09 | 18957 |
| 3036 | Jan. 28, 1998 | 233 | RTA00000197AF.l.8.1 | M00001511B:C06 | 39954 |
| 3037 | Jan. 28, 1998 | 323 | RTA00000182AF.m.21.1 | M00001490C:C12 | 18699 |
| 3038 | Jan. 28, 1998 | 223 | RTA00000197F.i.9.1 | M00001488D:C10 | 0 |
| 3039 | Jan. 28, 1998 | 236 | RTA00000183AR.h.23.1 | M00001528A:F09 | 18957 |
| 3039 | Jan. 28, 1998 | 108 | RTA00000183AR.h.23.2 | M00001528A:F09 | 18957 |
| 3039 | Jan. 28, 1998 | 129 | RTA00000134A.d.10.1 | M00001528A:F09 | 18957 |
| 3040 | Jan. 28, 1998 | 352 | RTA00000197AF.p.3.1 | M00001550A:A03 | 7239 |
| 3041 | Jan. 28, 1998 | 301 | RTA00000181AR.i.19.3 | M00001452C:B06 | 16970 |
| 3041 | Jan. 28, 1998 | 295 | RTA00000181AR.i.19.2 | M00001452C:B06 | 16970 |
| 3042 | Jan. 28, 1998 | 68 | RTA00000184F.k.19.1 | M00001558B:D08 | 8022 |
| 3042 | Jan. 28, 1998 | 63 | RTA00000184AF.k.19.1 | M00001558B:D08 | 8022 |
| 3043 | Jan. 28, 1998 | 63 | RTA00000184AF.k.19.1 | M00001558B:D08 | 8022 |
| 3043 | Jan. 28, 1998 | 68 | RTA00000184F.k.19.1 | M000015588:D08 | 8022 |
| 3044 | Jan. 28, 1998 | 41 | RTA00000184F.k.12.1 | M00001557D:D09 | 8761 |
| 3045 | Jan. 28, 1998 | 150 | RTA00000184F.k.09.1 | M00001557C:H07 | 7065 |
| 3046 | Jan. 28, 1998 | 82 | RTA00000183AF.l.18.1 | M00001535D:C01 | 3484 |
| 3047 | Jan. 28, 1998 | 338 | RTA00000184AF.i.1.1 | M00001554B:C07 | 0 |
| 3048 | Jan. 28, 1998 | 327 | RTA00000182AF.i.1.3 | M00001479B:A01 | 7033 |
| 3049 | Jan. 28, 1998 | 256 | RTA00000184AR.e.15.1 | M00001549C:E06 | 16347 |
| 3050 | Jan. 28, 1998 | 99 | RTA00000184AF.d.8.1 | M00001548A:A08 | 4393 |
| 3051 | Jan. 28, 1998 | 355 | RTA00000184AR.b.24.1 | M00001546B:C05 | 5777 |
| 3052 | Jan. 28, 1998 | 322 | RTA00000184AR.b.21.1 | M00001546B:B02 | 39788 |
| 3053 | Jan. 28, 1998 | 97 | RTA00000197AF.o.2.1 | M00001541C:B07 | 5739 |
| 3054 | Jan. 28, 1998 | 313 | RTA00000183AF.o.11.1 | M00001540D:D02 | 0 |
| 3055 | Jan. 28, 1998 | 42 | RTA00000184F.j.21.1 | M00001557A:D02 | 7065 |
| 3056 | Jan. 28, 1998 | 378 | RTA00000181AF.k.24.3 | M00001454B:C12 | 7005 |
| 3056 | Jan. 28, 1998 | 119 | RTA00000181AR.k.24.2 | M00001454B:C12 | 7005 |
| 3056 | Jan. 28, 1998 | 116 | RTA00000181AR.k.24.3 | M00001454B:C12 | 7005 |
| 3057 | Jan. 28, 1998 | 134 | RTA00000197F.e.11.1 | M00001454B:G03 | 2306 |
| 3057 | Jan. 28, 1998 | 298 | RTA00000197AR.e.11.1 | M00001454B:G03 | 2306 |
| 3058 | Jan. 28, 1998 | 134 | RTA00000J97F.e.11.1 | M00001454B:G03 | 2306 |
| 3058 | Jan. 28, 1998 | 298 | RTA00000197AR.e.11.1 | M00001454B:G03 | 2306 |
| 3059 | Jan. 28, 1998 | 134 | RTA00000197F.e.11.1 | M00001454B:G03 | 2306 |
| 3059 | Jan. 28, 1998 | 298 | RTA00000197AR.e.11.1 | M00001454B:G03 | 2306 |
| 3060 | Jan. 28, 1998 | 116 | RTA000G0181AR.k.24.3 | M00001454B:C12 | 7005 |
| 3060 | Jan. 28, 1998 | 378 | RTA00000181AF.k.24.3 | M00001454B:C12 | 7005 |
| 3060 | Jan. 28, 1998 | 119 | RTA00000181AR.k.24.2 | M00001454B:C12 | 7005 |
| 3061 | Jan. 28, 1998 | 116 | RTA00000181AR.k.24.3 | M00001454B:C12 | 7005 |
| 3061 | Jan. 28, 1998 | 378 | RTA00000181AF.k.24.3 | M00001454B:C12 | 7005 |
| 3061 | Jan. 28, 1998 | 119 | RTA00000181AR.k.24.2 | M00001454B:C12 | 7005 |
| 3062 | Jan. 28, 1998 | 159 | RTA00000182AF.l.12.1 | M00001487A:A05 | 1027 |
| 3063 | Jan. 28, 1998 | 119 | RTA00000181AR.k.24.2 | M00001454B:C12 | 7005 |
| 3063 | Jan. 28, 1998 | 116 | RTA00000181AR.k.24.3 | M00001454B:C12 | 7005 |
| 3063 | Jan. 28, 1998 | 378 | RTA00000181AF.k.24.3 | M00001454B:C12 | 7005 |
| 3064 | Jan. 28, 1998 | 341 | RTA00000181AF.l.06.2 | M00001454C:C08 | 0 |
| 3065 | Jan. 28, 1998 | 116 | RTA00000181AR.k.24.3 | M00001454B:C12 | 7005 |
| 3065 | Jan. 28, 1998 | 119 | RTA00000181AR.k.24.2 | M00001454B:C12 | 7005 |
| 3065 | Jan. 28, 1998 | 378 | RTA00000181AF.k.24.3 | M00001454B:C12 | 7005 |
| 3066 | Jan. 28, 1998 | 378 | RTA00000181AF.k.24.3 | M00001454B:C12 | 7005 |
| 3066 | Jan. 28, 1998 | 116 | RTA00000181AR.k.24.3 | M00001454B:C12 | 7005 |
| 3066 | Jan. 28, 1998 | 119 | RTA00000181AR.k.24.2 | M00001454B:C12 | 7005 |
| 3067 | Jan. 28, 1998 | 378 | RTA00000181AF.k.24.3 | M00001454B:C12 | 7005 |
| 3067 | Jan. 28, 1998 | 116 | RTA00000181AR.k.24.3 | M00001454B:C12 | 7005 |
| 3067 | Jan. 28, 1998 | 119 | RTA00000181AR.k.24.2 | M00001454B:C12 | 7005 |
| 3068 | Jan. 28, 1998 | 378 | RTA00000181AF.k.24.3 | M00001454B:C12 | 7005 |
| 3068 | Jan. 28, 1998 | 116 | RTA00000181AR.k.24.3 | M00001454B:C12 | 7005 |
| 3068 | Jan. 28, 1998 | 119 | RTA00000181AR.k.24.2 | M00001454B:C12 | 7005 |
| 3069 | Jan. 28, 1998 | 170 | RTA00000197AF.d.23.1 | M00001453A:E11 | 16130 |
| 3070 | Jan. 28, 1998 | 491 | RTA00000196F.k.11.1 | M00001399C:H12 | 3 |
| 3071 | Jan. 28, 1998 | 119 | RTA00000181AR.k.24.2 | M00001454B:C12 | 7005 |
| 3071 | Jan. 28, 1998 | 378 | RTA00000181AF.k.24.3 | M00001454B:C12 | 7005 |
| 3071 | Jan. 28, 1998 | 116 | RTA0000D181AR.k.24.3 | M00001454B:C12 | 7005 |
| 3072 | Jan. 28, 1998 | 674 | RTA00000197AR.e.24.1 | M00001456B:F10 | 39250 |
| 3072 | Jan. 28, 1998 | 3 | RTA00000197AF.e.24.1 | M00001456B:F10 | 39250 |
| 3073 | Feb. 24, 1998 | 78 | RTA00000195AF.b.13.1 | M00001560D:A03 | 12605 |
| 3073 | Jan. 28, 1998 | 59 | RTA00000195AF.b.13.1 | M00001560D:A03 | 12605 |
| 3074 | Jan. 28, 1998 | 189 | RTA00000197AF.h.10.1 | M00001476B:F10 | 15554 |
| 3075 | Jan. 28, 1998 | 46 | RTA00000182AF.f.13.1 | M00001470C:B10 | 8010 |
| 3076 | Jan. 28, 1998 | 200 | RTA00000182AF.f.2.1 | M00001469D:D02 | 4794 |
| 3077 | Jan. 28, 1998 | 325 | RTA00000182AF.d.18.4 | M00001467D:H05 | 37435 |
| 3078 | Jan. 28, 1998 | 45 | RTA00000197AR.f.12.1 | M00001458C:E01 | 3513 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3079 | Jan. 28, 1998 | 298 | RTA00000197AR.e.11.1 | M00001454B:G03 | 2306 |
| 3079 | Jan. 28, 1998 | 134 | RTA00000197F.e.11.1 | M00001454B:G03 | 2306 |
| 3080 | Jan. 28, 1998 | 37 | RTA00000181AF.n.15.2 | M00001457A:B07 | 86128 |
| 3081 | Jan. 28, 1998 | 7 | RTA00000197AR.e.12.1 | M00001454B:G07 | 22095 |
| 3082 | Jan. 28, 1998 | 674 | RTA00000197AR.e.24.1 | M00001456B:F10 | 39250 |
| 3082 | Jan. 28, 1998 | 3 | RTA00000197AF.e.24.1 | M00001456B:F10 | 39250 |
| 3083 | Jan. 28, 1998 | 88 | RTA00000197AF.e.23.1 | M00001456B:C09 | 37157 |
| 3084 | Jan. 28, 1998 | 243 | RTA00000181AF.m.15.3 | M00001455D:A11 | 12081 |
| 3085 | Jan. 28, 1998 | 326 | RTA00000197AR.e.19.1 | M00001455D:A09 | 8047 |
| 3086 | Jan. 28, 1998 | 293 | RTA00000197AF.e.13.1 | M00001454C:F02 | 662 |
| 3087 | Jan. 28, 1998 | 380 | RTA00000182AF.k.24.1 | M00001485D:B10 | 5625 |
| 3088 | Jan. 28, 1998 | 206 | RTA00000181AF.o.04.2 | M00001457C:C12 | 22205 |
| 3089 | Jan. 28, 1998 | 228 | RTA00000187AR.h.15.2 | M00001679A:A06 | 6660 |
| 3090 | Jan. 28, 1998 | 68 | RTA00000184F.k.19.1 | M00001558B:D08 | 8022 |
| 3090 | Jan. 28, 1998 | 63 | RTA00000184AF.k.19.1 | M00001558B:D08 | 8022 |
| 3091 | Jan. 28, 1998 | 191 | RTA00000187AF.p.23.1 | M00003748B:F02 | 39804 |
| 3092 | Jan. 28, 1998 | 10 | RTA00000198AF.n.16.1 | M00001694C:H10 | 3721 |
| 3093 | Jan. 28, 1998 | 219 | RTA00000198AF.m.19.1 | M00001680D:D02 | 40041 |
| 3093 | Jan. 28, 1998 | 32 | RTA00000198R.m.19.1 | M00001680D:D02 | 40041 |
| 3094 | Jan. 28, 1998 | 32 | RTA00000198R.m.19.1 | M00001680D:D02 | 40041 |
| 3094 | Jan. 28, 1998 | 219 | RTA00000198AF.m.19.1 | M00001680D:D02 | 40041 |
| 3095 | Jan. 28, 1998 | 317 | RTA00000198AF.p.09.1 | M00003761D:E02 | 10473 |
| 3095 | Jan. 28, 1998 | 186 | RTA00000198R.p.09.1 | M00003761D:E02 | 10473 |
| 3096 | Jan. 28, 1998 | 219 | RTA00000198AF.m.19.1 | M00001680D:D02 | 40041 |
| 3096 | Jan. 28, 1998 | 32 | RTA00000198R.m.19.1 | M00001680D:D02 | 40041 |
| 3097 | Jan. 28, 1998 | 64 | RTA00000198AF.p.12.1 | M00003763D:E10 | 8878 |
| 3097 | Jan. 28, 1998 | 542 | RTA00000198R.p.12.1 | M00003763D:E10 | 8878 |
| 3098 | Jan. 28, 1998 | 364 | RTA00000187AF.g.13.1 | M00001676C:C11 | 2991 |
| 3099 | Jan. 28, 1998 | 430 | RTA00000198R.k.23.1 | M00001661B:C08 | 8995 |
| 3099 | Jan. 28, 1998 | 294 | RTA00000198AF.k.23.1 | M00001661B:C08 | 8995 |
| 3100 | Jan. 28, 1998 | 430 | RTA00000198R.k.23.1 | M00001661B:C08 | 8995 |
| 3100 | Jan. 28, 1998 | 294 | RTA00000198AF.k.23.1 | M00001661B:C08 | 8995 |
| 3101 | Jan. 28, 1998 | 57 | RTA00000198AF.k.20.1 | M00001660C:B12 | 22553 |
| 3102 | Jan. 28, 1998 | 368 | RTA00000198AF.k.18.1 | M00001660A:C12 | 17432 |
| 3103 | Jan. 28, 1998 | 247 | RTA00000198AF.k.08.1 | M00001656C:G08 | 17436 |
| 3104 | Jan. 28, 1998 | 219 | RTA00000198AF.m.19.1 | M00001680D:D02 | 40041 |
| 3104 | Jan. 28, 1998 | 32 | RTA00000198R.m.19.1 | M00001680D:D02 | 40041 |
| 3105 | Jan. 28, 1998 | 199 | RTA00000199R.c.09.1 | M00003800A:C09 | 16824 |
| 3105 | Jan. 28, 1998 | 66 | RTA00000199F.c.09.2 | M00003800A:C09 | 16824 |
| 3106 | Jan. 28, 1998 | 225 | RTA00000189AF.b.5.1 | M00003828A:E04 | 3784 |
| 3107 | Jan. 28, 1998 | 5 | RTA00000195R.c.11.1 | M00003811A:E03 | 66087 |
| 3108 | Jan. 28, 1998 | 284 | RTA00000199F.d.10.2 | M00003808C:B05 | 22049 |
| 3108 | Feb. 24, 1998 | 816 | RTA00000354R.n.04.1 | M00003808C:B05 | 22049 |
| 3109 | Jan. 28, 1998 | 284 | RTA00000199F.d.10.2 | M00003808C:B05 | 22049 |
| 3109 | Feb. 24, 1998 | 816 | RTA00000354R.n.04.1 | M00003808C:B05 | 22049 |
| 3110 | Jan. 28, 1998 | 2 | RTA00000188AF.n.15.1 | M00003804A:H04 | 0 |
| 3111 | Jan. 28, 1998 | 317 | RTA00000198AF.p.09.1 | M00003761D:E02 | 10473 |
| 3111 | Jan. 28, 1998 | 186 | RTA00000198R.p.09.1 | M00003761D:E02 | 10473 |
| 3112 | Jan. 28, 1998 | 199 | RTA00000199R.c.09.1 | M00003800A:C09 | 16824 |
| 3112 | Jan. 28, 1998 | 66 | RTA00000199F.c.09.2 | M00003800A:C09 | 16824 |
| 3113 | Jan. 28, 1998 | 487 | RTA00000198F.i.8.1 | M00001639A:F10 | 9807 |
| 3113 | Jan. 28, 1998 | 277 | RTA00000198AR.i.08.1 | M00001639A:F10 | 9807 |
| 3114 | Jan. 28, 1998 | 66 | RTA00000199F.c.09.2 | M00003800A:C09 | 16824 |
| 3114 | Jan. 28, 1998 | 199 | RTA00000199R.c.09.1 | M00003800A:C09 | 16824 |
| 3115 | Jan. 28, 1998 | 224 | RTA00000188AF.m.11.1 | M00003799A:D09 | 0 |
| 3116 | Jan. 28, 1998 | 58 | RTA00000199F.b.01.2 | M00003778A:D08 | 19118 |
| 3117 | Jan. 28, 1998 | 216 | RTA00000188AF.g.9.1 | M00003774B:B08 | 4959 |
| 3118 | Jan. 28, 1998 | 201 | RTA00000198AF.p.18.1 | M00003769B:D03 | 23081 |
| 3119 | Jan. 28, 1998 | 542 | RTA00000198R.p.12.1 | M00003763D:E10 | 8878 |
| 3119 | Jan. 28, 1998 | 64 | RTA00000198AF.p.12.1 | M00003763D:E10 | 8878 |
| 3120 | Jan. 28, 1998 | 199 | RTA00000199R.c.09.1 | M00003800A:C09 | 16824 |
| 3120 | Jan. 28, 1998 | 66 | RTA00000199F.c.09.2 | M00003800A:C09 | 16824 |
| 3121 | Jan. 28, 1998 | 146 | RTA00000185AF.a.19.2 | M00001571C:H06 | 5749 |
| 3122 | Jan. 28, 1998 | 248 | RTA00000198R.c.14.1 | M00001578D:C04 | 39814 |
| 3122 | Feb. 24, 1998 | 778 | RTA00000347F.e.05.1 | M00001578D:C04 | 39814 |
| 3123 | Jan. 28, 1998 | 248 | RTA00000198R.c.14.1 | M00001578D:C04 | 39814 |
| 3123 | Feb. 24, 1998 | 778 | RTA00000347F.e.05.1 | M00001578D:C04 | 39814 |
| 3124 | Jan. 28, 1998 | 147 | RTA00000185AF.c.24.2 | M00001578B:E04 | 23001 |
| 3125 | Jan. 28, 1998 | 195 | RTA00000198AF.c.10.1 | M00001577B:H02 | 77149 |
| 3126 | Jan. 28, 1998 | 171 | RTA00000198R.c.07.1 | M00001575D:G05 | 19181 |
| 3126 | Jan. 28, 1998 | 525 | RTA00000198AF.c.7.1 | M00001575D:G05 | 19181 |
| 3127 | Jan. 28, 1998 | 172 | RTA00000186AF.p.09.2 | M00001655C:E04 | 6879 |
| 3128 | Jan. 28, 1998 | 230 | RTA00000185AR.b.18.1 | M00001575B:C09 | 12171 |
| 3129 | Jan. 28, 1998 | 192 | RTA00000185AF.m.7.1 | M00001605C:D12 | 39804 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3130 | Jan. 28, 1998 | 19 | RTA00000185AF.a.8.1 | M00001570D:A03 | 4868 |
| 3131 | Jan. 28, 1998 | 492 | RTA00000198AF.b.8.1 | M00001567C:H12 | 22636 |
| 3131 | Jan. 28, 1998 | 23 | RTA00000198R.b.08.1 | M00001567C:H12 | 22636 |
| 3132 | Jan. 28, 1998 | 23 | RTA00000198R.b.08.1 | M00001567C:H12 | 22636 |
| 3132 | Jan. 28, 1998 | 492 | RTA00000198AF.b.8.1 | M00001567C:H12 | 22636 |
| 3133 | Jan. 28, 1998 | 357 | RTA00000184AF.o.15.1 | M00001564D:C09 | 0 |
| 3134 | Jan. 28, 1998 | 30 | RTA00000184AR.n.07.2 | M00001561C:F06 | 0 |
| 3135 | Jan. 28, 1998 | 59 | RTA00000195AF.b.13.1 | M00001560D:A03 | 12605 |
| 3135 | Feb. 24, 1998 | 78 | RTA00000195AF.b.13.1 | M00001560D:A03 | 12605 |
| 3136 | Jan. 28, 1998 | 525 | RTA00000198AF.c.7.1 | M00001575D:G05 | 19181 |
| 3136 | Jan. 28, 1998 | 171 | RTA00000198R.c.07.1 | M00001575D:G05 | 19181 |
| 3137 | Jan. 28, 1998 | 303 | RTA00000186AR.e.03.3 | M00001623D:C10 | 22110 |
| 3138 | Jan. 28, 1998 | 295 | RTA00000181AR.i.19.2 | M00001452C:B06 | 16970 |
| 3138 | Jan. 28, 1998 | 301 | RTA00000181AR.i.19.3 | M00001452C:B06 | 16970 |
| 3139 | Jan. 28, 1998 | 232 | RTA00000186AF.j.03.2 | M00001638A:E07 | 0 |
| 3140 | Jan. 28, 1998 | 309 | RTA00000198AF.h.12.1 | M00001632C:A02 | 9503 |
| 3141 | Jan. 28, 1998 | 268 | RTA00000186AF.h.01.2 | M00001632A:F12 | 0 |
| 3142 | Jan. 28, 1998 | 267 | RTA00000186AF.g.11.2 | M00001630B:H09 | 5214 |
| 3143 | Jan. 28, 1998 | 83 | RTA00000186AF.f.24.2 | M00001629B:E06 | 0 |
| 3143 | Jan. 28, 1998 | 336 | RTA00000186AF.f.24.1 | M00001629B:E06 | 0 |
| 3144 | Jan. 28, 1998 | 222 | RTA00000185AF.i.4.1 | M00001594A:B12 | 13942 |
| 3145 | Jan. 28, 1998 | 217 | RTA00000198AF.h.3.1 | M00001625D:C07 | 22562 |
| 3146 | Jan. 28, 1998 | 196 | RTA00000198F.e.10.1 | M00001599B:E09 | 9727 |
| 3147 | Jan. 28, 1998 | 372 | RTA00000186AF.d.23.1 | M00001623B:G07 | 22187 |
| 3148 | Jan. 28, 1998 | 302 | RTA00000186AF.d.1.2 | M00001621C:C08 | 40044 |
| 3149 | Jan. 28, 1998 | 262 | RTA00000186AF.c.17.1 | M00001619D:G05 | 8551 |
| 3150 | Jan. 28, 1998 | 358 | RTA00000198AF.g.7.1 | M00001616C:C09 | 13386 |
| 3151 | Jan. 28, 1998 | 166 | RTA00000198AF.f.21.1 | M00001614D:D09 | 22676 |
| 3152 | Jan. 28, 1998 | 277 | RTA00000198AR.i.08.1 | M00001639A:F10 | 9807 |
| 3152 | Jan. 28, 1998 | 487 | RTA00000195F.i.8.1 | M00001639A:F10 | 9807 |
| 3153 | Jan. 28, 1998 | 336 | RTA00000186AF.f.24.1 | M00001629B:E06 | 0 |
| 3153 | Jan. 28, 1998 | 83 | RTA00000186AF.f.24.2 | M00001629B:E06 | 0 |
| 3154 | Jan. 28, 1998 | 352 | RTA00000197AF.p.3.1 | M00001550A:A03 | 7239 |
| 3155 | Jan. 28, 1998 | 251 | RTA00000192AF.n.13.1 | M00004197D:H01 | 8210 |
| 3156 | Jan. 28, 1998 | 41 | RTA00000184F.k.12.1 | M00001557D:D09 | 8761 |
| 3157 | Jan. 28, 1998 | 731 | RTA00000184F.k.02.1 | M00001557B:H10 | 5192 |
| 3158 | Jan. 28, 1998 | 42 | RTA00000184F.j.21.1 | M00001557A:D02 | 7065 |
| 3159 | Jan. 28, 1998 | 42 | RTA00000184F.j.21.1 | M00001557A:D02 | 7065 |
| 3160 | Jan. 28, 1998 | 302 | RTA00000186AF.d.1.2 | M00001621C:C08 | 40044 |
| 3161 | Jan. 28, 1998 | 560 | RTA00000184AF.i.23.3 | M00001556A:F11 | 1577 |
| 3162 | Jan. 28, 1998 | 558 | RTA00000186AR.h.14.1 | M00001632D:H07 | 0 |
| 3163 | Jan. 28, 1998 | 256 | RTA00000184AR.e.15.1 | M00001549C:E06 | 16347 |
| 3164 | Jan. 28, 1998 | 682 | RTA00000125A.j.16.1 | M00001544A:E06 | 0 |
| 3165 | Jan. 28, 1998 | 129 | RTA00000134A.d.10.1 | M00001528A:F09 | 18957 |
| 3165 | Jan. 28, 1998 | 108 | RTA00000183AR.h.23.2 | M00001528A:F09 | 18957 |
| 3165 | Jan. 28, 1998 | 236 | RTA00000183AR.h.23.1 | M00001528A:F09 | 18957 |
| 3166 | Jan. 28, 1998 | 129 | RTA00000134A.d.10.1 | M00001528A:F09 | 18957 |
| 3166 | Jan. 28, 1998 | 108 | RTA00000183AR.h.23.2 | M00001528A:F09 | 18957 |
| 3166 | Jan. 28, 1998 | 236 | RTA00000183AR.h.23.1 | M00001528A:F09 | 18957 |
| 3167 | Jan. 28, 1998 | 108 | RTA00000183AR.h.23.2 | M00001528A:F09 | 18957 |
| 3167 | Jan. 28, 1998 | 236 | RTA00000183AR.h.23.1 | M00001528A:F09 | 18957 |
| 3167 | Jan. 28, 1998 | 129 | RTA00000134A.d.10.1 | M00001528A:F09 | 18957 |
| 3168 | Feb. 24, 1998 | 531 | RTA00000345F.n.12.1 | M00001528A:C04 | 7337 |
| 3169 | Jan. 28, 1998 | 324 | RTA90000184F.j.06.1 | M00001556B:G02 | 11294 |
| 3170 | Feb. 24, 1998 | 604 | RTA00000351R.c.13.1 | M00003747D:C05 | 11476 |
| 3171 | Jan. 28, 1998 | 301 | RTA00000181AR.i.19.3 | M00001452C:B06 | 16970 |
| 3171 | Jan. 28, 1998 | 295 | RTA00000181AR.i.19.2 | M00001452C:B06 | 16970 |
| 3172 | Jan. 28, 1998 | 231 | RTA00000192AF.l.13.2 | M00004185C:C03 | 11443 |
| 3173 | Jan. 28, 1998 | 634 | RTA00000192AF.j.6.1 | M00004172C:D08 | 11494 |
| 3174 | Jan. 28, 1998 | 165 | RTA00000192AF.g.23.1 | M00004157C:A09 | 6455 |
| 3175 | Jan. 28, 1998 | 574 | RTA00000192AF.f.3.1 | M00004146C:C11 | 5257 |
| 3176 | Jan. 28, 1998 | 146 | RTA00000185AF.a.19.2 | M00001571C:H06 | 5749 |
| 3177 | Jan. 28, 1998 | 651 | RTA00000189AR.d.22.2 | M00003844C:B11 | 6539 |
| 3178 | Jan. 28, 1998 | 161 | RTA00000183AF.e.23.2 | M00001506D:A09 | 0 |
| 3179 | Jan. 28, 1998 | 475 | RTA00000187AR.m.3.3 | M00001682C:B12 | 17055 |
| 3180 | Feb. 24, 1998 | 39 | RTA00000187AF.l.7.1 | M00001680D:F08 | 10539 |
| 3181 | Jan. 28, 1998 | 228 | RTA00000187AR.h.15.2 | M00001679A:A06 | 6660 |
| 3182 | Feb. 24, 1998 | 465 | RTA00000350R.p.18.1 | M00001676B:F05 | 11460 |
| 3183 | Jan. 28, 1998 | 575 | RTA00000186AF.l.12.2 | M00001645A:C12 | 19267 |
| 3184 | Feb. 24, 1998 | 700 | RTA00000350R.m.14.1 | M00001644C:B07 | 39171 |
| 3185 | Jan. 28, 1998 | 261 | RTA00000192AF.a.24.1 | M00004114C:F11 | 13183 |
| 3186 | Jan. 28, 1998 | 236 | RTA00000183AR.h.23.1 | M00001528A:F09 | 18957 |
| 3186 | Jan. 28, 1998 | 108 | RTA00000183AR.h.23.2 | M00001528A:F09 | 18957 |
| 3186 | Jan. 28, 1998 | 129 | RTA00000134A.d.10.1 | M00001528A:F09 | 18957 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3187 | Jan. 28, 1998 | 398 | RTA00000177AR.l.13.3 | M00001353A:G12 | 8078 |
| 3188 | Jan. 28, 1998 | 645 | RTA00000177AF.k.9.1 | M00001352A:E02 | 16245 |
| 3189 | Jan. 28, 1998 | 283 | RTA00000177AF.i.8.4 | M00001350A:H01 | 7187 |
| 3190 | Jan. 28, 1998 | 361 | RTA00000177AR.g.16.4 | M00001347A:B10 | 13576 |
| 3191 | Jan. 28, 1998 | 680 | RTA00000177AF.f.10.1 | M00001345A:E01 | 6420 |
| 3192 | Jan. 28, 1998 | 632 | RTA00000183AR.g.03.1 | M00001512D:G09 | 3956 |
| 3192 | Jan. 28, 1998 | 630 | RTA00000183AR.g.03.2 | M00001512D:G09 | 3956 |
| 3193 | Jan. 28, 1998 | 702 | RTA00000177AR.b.8.5 | M00001340B:A06 | 17062 |
| 3194 | Jan. 28, 1998 | 330 | RTA00000177AR.m.17.4 | M00001355B:G10 | 14391 |
| 3194 | Jan. 28, 1998 | 493 | RTA00000177AF.m.17.1 | M00001355B:G10 | 14391 |
| 3194 | Jan. 28, 1998 | 337 | RTA00000177AR.m.17.3 | M00001355B:G10 | 14391 |
| 3195 | Jan. 28, 1998 | 236 | RTA00000183AR.h.23.1 | M00001528A:F09 | 18957 |
| 3195 | Jan. 28, 1998 | 129 | RTA00000134A.d.10.1 | M00001528A:F09 | 18957 |
| 3195 | Jan. 28, 1998 | 108 | RTA00000183AR.h.23.2 | M00001528A:F09 | 18957 |
| 3196 | Jan. 28, 1998 | 129 | RTA00000134A.d.10.1 | M00001528A:F09 | 18957 |
| 3196 | Jan. 28, 1998 | 236 | RTA00000183AR.h.23.1 | M00001528A:F09 | 18957 |
| 3196 | Jan. 28, 1998 | 108 | RTA00000183AR.h.23.2 | M00001528A:F09 | 18957 |
| 3197 | Jan. 28, 1998 | 435 | RTA00000182AR.c.22.1 | M00001467A:D08 | 16283 |
| 3198 | Jan. 28, 1998 | 635 | RTA00000181AF.p.7.3 | M00001460A:E01 | 38773 |
| 3199 | Jan. 28, 1998 | 362 | RTA00000197AR.c.24.1 | M00001450A:B12 | 82498 |
| 3200 | Feb. 24, 1998 | 442 | RTA00000347F.b.02.1 | M00001450A:A02 | 39304 |
| 3201 | Jan. 28, 1998 | 265 | RTA00000177AF.e.14.1 | M00001343D:H07 | 23255 |
| 3202 | Jan. 28, 1998 | 270 | RTA00000178R.l.08.1 | M00001383A:C03 | 39648 |
| 3203 | Jan. 28, 1998 | 472 | RTA00000192AF.p.17.1 | M00004214C:H05 | 11451 |
| 3204 | Jan. 28, 1998 | 603 | RTA00000183AR.d.11.3 | M00001504D:G06 | 6420 |
| 3205 | Jan. 28, 1998 | 519 | RTA00000183AF.a.24.2 | M00001499B:A11 | 10539 |
| 3206 | Jan. 28, 1998 | 435 | RTA00000182AR.c.22.1 | M00001467A:D08 | 16283 |
| 3207 | Feb. 24, 1998 | 158 | RTA00000348R.j.16.1 | M00001410A:D07 | 7005 |
| 3208 | Jan. 28, 1998 | 411 | RTA00000179AF.j.13.3 | M00001400B:H06 | 0 |
| 3209 | Jan. 28, 1998 | 742 | RTA00000177AF.m.1.1 | M00001353D:D10 | 14929 |
| 3210 | Jan. 28, 1998 | 270 | RTA00000178R.l.08.1 | M00001383A:C03 | 39648 |
| 3211 | Jan. 28, 1998 | 337 | RTA00000177AR.m.17.3 | M00001355B:G10 | 14391 |
| 3211 | Jan. 28, 1998 | 493 | RTA00000177AF.m.17.1 | M00001355B:G10 | 14391 |
| 3211 | Jan. 28, 1998 | 330 | RTA00000177AR.m.17.4 | M00001355B:G10 | 14391 |
| 3212 | Jan. 28, 1998 | 297 | RTA00000178AF.f.9.3 | M00001371C:E09 | 7172 |
| 3213 | Jan. 28, 1998 | 33 | RTA00000178AR.a.20.1 | M00001362C:H11 | 945 |
| 3213 | Feb. 24, 1998 | 979 | RTA00000345F.b.17.1 | M00001362C:H11 | 945 |
| 3214 | Jan. 28, 1998 | 33 | RTA00000178AR.a.20.1 | M00001362C:H11 | 945 |
| 3214 | Feb. 24, 1998 | 979 | RTA00000345F.b.17.1 | M00001362C:H11 | 945 |
| 3215 | Jan. 28, 1998 | 466 | RTA00000177AF.p.20.1 | M00001361A:A05 | 4141 |
| 3216 | Jan. 28, 1998 | 330 | RTA00000177AR.m.17.4 | M00001355B:G10 | 14391 |
| 3216 | Jan. 28, 1998 | 493 | RTA00000177AF.m.17.1 | M00001355B:G10 | 14391 |
| 3216 | Jan. 28, 1998 | 337 | RTA00000177AR.m.17.3 | M00001355B:G10 | 14391 |
| 3217 | Jan. 28, 1998 | 632 | RTA00000183AR.g.03.1 | M00001512D:G09 | 3956 |
| 3217 | Jan. 28, 1998 | 630 | RTA00000183AR.g.03.2 | M00001512D:G09 | 3956 |
| 3218 | Jan. 28, 1998 | 391 | RTA00000179AF.e.20.3 | M00001396A:C03 | 4009 |
| 3219 | Jan. 28, 1998 | 370 | RTA00000179AF.c.15.3 | M00001392D:H06 | 2995 |
| 3219 | Jan. 28, 1998 | 460 | RTA00000179AF.c.15.1 | M00001392D:H06 | 2995 |
| 3220 | Jan. 28, 1998 | 47 | RTA00000192AF.m.12.1 | M00004191D:B11 | 0 |
| 3221 | Jan. 28, 1998 | 438 | RTA00000180AR.g.03.4 | M00001425A:C11 | 9024 |
| 3221 | Jan. 28, 1998 | 95 | RTA00000180AF.g.3.1 | M00001425A:C11 | 9024 |
| 3222 | Jan. 28, 1998 | 438 | RTA00000180AR.g.03.4 | M00001425A:C11 | 9024 |
| 3222 | Jan. 28, 1998 | 95 | RTA00000180A1F.g.3.1 | M00001425A:C11 | 9024 |
| 3223 | Jan. 28, 1998 | 320 | RTA00000196AF.m.13.1 | M00001415B:E09 | 16290 |
| 3224 | Jan. 28, 1998 | 365 | RTA00000196F.l.20.2 | M00001410B:G05 | 22678 |
| 3225 | Jan. 28, 1998 | 80 | RTA00000196AF.p.13.2 | M00001432A:E06 | 6125 |
| 3226 | Jan. 28, 1998 | 179 | RTA00000179AF.f.20.3 | M00001397B:B09 | 16154 |
| 3227 | Jan. 28, 1998 | 379 | RTA00000180AF.l.06.2 | M00001433A:G07 | 5625 |
| 3228 | Jan. 28, 1998 | 460 | RTA00000179AF.c.15.1 | M00001392D:H06 | 2995 |
| 3228 | Jan. 28, 1998 | 370 | RTA00000179AF.c.15.3 | M00001392D:H06 | 2995 |
| 3229 | Jan. 28, 1998 | 107 | RTA00000196R.i.13.1 | M00001390A:A09 | 9857 |
| 3230 | Jan. 28, 1998 | 120 | RTA00000178AR.m.19.5 | M00001384D:H07 | 0 |
| 3230 | Jan. 28, 1998 | 377 | RTA00000178AF.m.19.1 | M00001384D:H07 | 0 |
| 3231 | Jan. 28, 1998 | 120 | RTA00000178AR.m.19.5 | M00001384D:H07 | 0 |
| 3231 | Jan. 28, 1998 | 377 | RTA00000178AF.m.19.1 | M00001384D:H07 | 0 |
| 3232 | Jan. 28, 1998 | 384 | RTA00000196AF.h.17.1 | M00001384C:F12 | 39215 |
| 3233 | Jan. 28, 1998 | 182 | RTA00000196AF.h.16.1 | M00001384C:E03 | 39895 |
| 3234 | Jan. 28, 1998 | 105 | RTA00000179AF.g.12.3 | M00001398A:G03 | 36390 |
| 3235 | Jan. 28, 1998 | 252 | RTA00000181AF.e.18.3 | M00001448D:C09 | 8 |
| 3235 | Jan. 28, 1998 | 253 | RTA00000181AF.e.17.3 | M00001448D:C09 | 8 |
| 3236 | Jan. 28, 1998 | 301 | RTA00000181AR.i.19.3 | M00001452C:B06 | 16970 |
| 3236 | Jan. 28, 1998 | 295 | RTA00000181AR.i.19.2 | M00001452C:B06 | 16970 |
| 3237 | Jan. 28, 1998 | 288 | RTA00000181AR.i.06.3 | M00001452A:C07 | 19119 |
| 3237 | Feb. 24, 1998 | 198 | RTA00000339R.l.14.1 | M00001452A:C07 | 19119 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3238 | Jan. 28, 1998 | 288 | RTA00000181AR.i.06.3 | M00001452A:C07 | 19119 |
| 3238 | Feb. 24, 1998 | 198 | RTA00000339R.l.14.1 | M00001452A:C07 | 19119 |
| 3239 | Jan. 28, 1998 | 109 | RTA00000197AF.d.12.1 | M00001451D:C10 | 39546 |
| 3240 | Jan. 28, 1998 | 149 | RTA00000181AR.h.06.3 | M00001450D:D04 | 87226 |
| 3241 | Jan. 28, 1998 | 75 | RTA00000180AR.h.19.2 | M00001428A:H10 | 84182 |
| 3242 | Jan. 28, 1998 | 21 | RTA00000131A.g.19.2 | M00001449A:G10 | 36535 |
| 3243 | Jan. 28, 1998 | 308 | RTA00000178AF.j.20.1 | M00001380C:E05 | 15066 |
| 3244 | Jan. 28, 1998 | 253 | RTA00000181AF.e.17.3 | M00001448D:C09 | 8 |
| 3244 | Jan. 28, 1998 | 252 | RTA00000181AF.e.18.3 | M00001448D:C09 | 8 |
| 3245 | Jan. 28, 1998 | 252 | RTA00000181AF.e.18.3 | M00001448D:C09 | 8 |
| 3245 | Jan. 28, 1998 | 253 | RTA00000181AF.e.17.3 | M00001448D:C09 | 8 |
| 3246 | Jan. 28, 1998 | 253 | RTA00000181AF.e.17.3 | M00001448D:C09 | 8 |
| 3246 | Jan. 28, 1998 | 252 | RTA00000181AF.e.18.3 | M00001448D:C09 | 8 |
| 3247 | Jan. 28, 1998 | 136 | RTA00000197AF.c.10.1 | M00001448B:F06 | 10400 |
| 3248 | Jan. 28, 1998 | 177 | RTA00000197AF.c.3.1 | M00001447C:C01 | 3145 |
| 3249 | Jan. 28, 1998 | 204 | RTA00000180AR.o.5.2 | M00001437D:C04 | 7848 |
| 3250 | Jan. 28, 1998 | 362 | RTA00000197AR.c.24.1 | M00001450A:B12 | 82498 |
| 3251 | Jan. 28, 1998 | 81 | RTA00000196AF.b.15.1 | M00001347B:E01 | 5102 |
| 3252 | Jan. 28, 1998 | 342 | RTA00000196AF.d.10.1 | M00001354C:B06 | 22256 |
| 3253 | Jan. 28, 1998 | 113 | RTA00000196AF.d.09.1 | M00001354B:B10 | 16934 |
| 3254 | Jan. 28, 1998 | 463 | RTA00000177AR.k.23.4 | M00001352D:D02 | 35550 |
| 3254 | Jan. 28, 1998 | 168 | RTA00000177AR.k.23.1 | M00001352D:D02 | 35550 |
| 3255 | Jan. 28, 1998 | 463 | RTA00000177AR.k.23.4 | M00001352D:D02 | 35550 |
| 3255 | Jan. 28, 1998 | 168 | RTA00000177AR.k.23.1 | M00001352D:D02 | 35550 |
| 3256 | Jan. 28, 1998 | 135 | RTA00000196AF.c.22.1 | M00001352D:C05 | 22548 |
| 3257 | Jan. 28, 1998 | 270 | RTA00000178R.l.08.1 | M00001383A:C03 | 39648 |
| 3258 | Jan. 28, 1998 | 359 | RTA00000196AF.b.17.1 | M00001348A:D04 | 12193 |
| 3259 | Jan. 28, 1998 | 493 | RTA00000177AF.m.17.1 | M00001355B:G10 | 14391 |
| 3259 | Jan. 28, 1998 | 337 | RTA00000177AR.m.17.3 | M00001355B:G10 | 14391 |
| 3259 | Jan. 28, 1998 | 330 | RTA00000177AR.m.17.4 | M000013558:G10 | 14391 |
| 3260 | Jan. 28, 1998 | 361 | RTA00000177AR.g.16.4 | M00001347A:B10 | 13576 |
| 3261 | Jan. 28, 1998 | 265 | RTA00000177AF.e.14.1 | M00001343D:H07 | 23255 |
| 3262 | Jan. 28, 1998 | 56 | RTA00000177AF.e.9.1 | M00001343D:C04 | 37442 |
| 3263 | Jan. 28, 1998 | 48 | RTA00000177AR.a.23.5 | M00001339D:G02 | 6995 |
| 3264 | Feb. 24, 1998 | 308 | RTA00000353R.d.11.1 | M00004692A:H08 | 0 |
| 3265 | Jan. 28, 1998 | 164 | RTA00000193AR.i.14.4 | M00004307C:A06 | 9457 |
| 3266 | Jan. 28, 1998 | 283 | RTA00000177AF.i.8.4 | M00001350A:H01 | 7187 |
| 3267 | Jan. 28, 1998 | 15 | RTA00000177AR.n.8.1 | M00001356D:F06 | 4188 |
| 3267 | Jan. 28, 1998 | 89 | RTA00000177AF.n.8.3 | M00001356D:F06 | 4188 |
| 3268 | Jan. 28, 1998 | 383 | RTA00000199F.f.20.2 | M00003847B:G03 | 0 |
| 3269 | Jan. 28, 1998 | 132 | RTA00000178AF.f.20.3 | M00001372C:F07 | 39881 |
| 3270 | Jan. 28, 1998 | 296 | RTA00000196AF.f.20.1 | M00001371D:G01 | 22774 |
| 3271 | Jan. 28, 1998 | 297 | RTA00000178AF.f.9.3 | M00001371C:E09 | 7172 |
| 3272 | Jan. 28, 1998 | 240 | RTA00000178AF.e.1.1 | M00001369A:H12 | 2664 |
| 3273 | Jan. 28, 1998 | 16 | RTA00000196AF.e.16.1 | M00001363C:H02 | 39252 |
| 3274 | Jan. 28, 1998 | 112 | RTA00000177AF.m.8.1 | M00001354C:C10 | 8010 |
| 3275 | Jan. 28, 1998 | 154 | RTA00000196F.e.7.1 | M00001360D:E11 | 1039 |
| 3276 | Jan. 28, 1998 | 330 | RTA00000177AR.m.17.4 | M00001355B:G10 | 14391 |
| 3276 | Jan. 28, 1998 | 493 | RTA00000177AF.m.17.1 | M00001355B:G10 | 14391 |
| 3276 | Jan. 28, 1998 | 337 | RTA00000177AR.m.17.3 | M00001355B:G10 | 14391 |
| 3277 | Jan. 28, 1998 | 89 | RTA00000177AF.n.8.3 | M00001356D:F06 | 4188 |
| 3277 | Jan. 28, 1998 | 15 | RTA00000177AR.n.8.1 | M00001356D:F06 | 4188 |
| 3278 | Jan. 28, 1998 | 493 | RTA00000177AF.m.17.1 | M00001355B:G10 | 14391 |
| 3278 | Jan. 28, 1998 | 337 | RTA00000177AR.m.17.3 | M00001355B:G10 | 14391 |
| 3278 | Jan. 28, 1998 | 330 | RTA00000177AR.m.17.4 | M00001355B:G10 | 14391 |
| 3279 | Jan. 28, 1998 | 337 | RTA00000177AR.m.17.3 | M00001355B:G10 | 14391 |
| 3279 | Jan. 28, 1998 | 330 | RTA00000177AR.m.17.4 | M00001355B:G10 | 14391 |
| 3279 | Jan. 28, 1998 | 493 | RTA00000177AF.m.17.1 | M00001355B:G10 | 14391 |
| 3280 | Jan. 28, 1998 | 330 | RTA00000177AR.m.17.4 | M00001355B:G10 | 14391 |
| 3280 | Jan. 28, 1998 | 493 | RTA00000177AF.m.17.1 | M00001355B:G10 | 14391 |
| 3280 | Jan. 28, 1998 | 337 | RTA00000177AR.m.17.3 | M00001355B:G10 | 14391 |
| 3281 | Jan. 28, 1998 | 337 | RTA00000177AR.m.17.3 | M000013558:G10 | 14391 |
| 3281 | Jan. 28, 1998 | 493 | RTA00000177AF.m.17.1 | M00001355B:G10 | 14391 |
| 3281 | Jan. 28, 1998 | 330 | RTA00000177AR.m.17.4 | M00001355B:G10 | 14391 |
| 3282 | Jan. 28, 1998 | 169 | RTA00000196AF.g.24.1 | M00001380C:F02 | 8685 |
| 3283 | Jan. 28, 1998 | 363 | RTA00000196AF.e.14.1 | M00001362C:A10 | 12850 |
| 3284 | Jan. 28, 1998 | 92 | RTA00000198AF.j.18.1 | M00001653B:G07 | 22759 |
| 3284 | Jan. 28, 1998 | 433 | RTA00000198R.j.18.1 | M00001653B:G07 | 22759 |
| 3285 | Jan. 28, 1998 | 537 | RTA00000188AF.g.14.1 | M00003774C:D02 | 0 |
| 3286 | Jan. 28, 1998 | 434 | RTA00000187AR.d.2.2 | M00001664C:H10 | 4892 |
| 3287 | Jan. 28, 1998 | 703 | RTA00000198F.l.09.1 | M00001664B:D06 | 3611 |
| 3288 | Jan. 28, 1998 | 430 | RTA00000198R.k.23.1 | M00001661B:C08 | 8995 |
| 3288 | Jan. 28, 1998 | 294 | RTA00000198AF.k.23.1 | M00001661B:C08 | 8995 |
| 3289 | Jan. 28, 1998 | 294 | RTA00000198AF.k.23.1 | M00001661B:C08 | 8995 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3289 | Jan. 28, 1998 | 430 | RTA00000198R.k.23.1 | M00001661B:C08 | 8995 |
| 3290 | Jan. 28, 1998 | 754 | RTA00000187AF.l.11.1 | M00001681A:F03 | 4482 |
| 3291 | Jan. 28, 1998 | 732 | RTA00000186AF.p.01.2 | M00001654D:G11 | 40440 |
| 3292 | Jan. 28, 1998 | 475 | RTA00000187AR.m.3.3 | M00001682C:B12 | 17055 |
| 3293 | Jan. 28, 1998 | 433 | RTA00000198R.j.18.1 | M00001653B:G07 | 22759 |
| 3293 | Jan. 28, 1998 | 92 | RTA00000198AF.j.18.1 | M00001653B:G07 | 22759 |
| 3294 | Jan. 28, 1998 | 555 | RTA00000198AF.j.08.1 | M00001651B:A11 | 10983 |
| 3295 | Jan. 28, 1998 | 399 | RTA00000186AF.m.15.2 | M00001649C:B10 | 40122 |
| 3296 | Jan. 28, 1998 | 575 | RTA00000186AF.l.12.2 | M00001645A:C12 | 19267 |
| 3297 | Jan. 28, 1998 | 666 | RTA00000198F.i.10.1 | M00001640B:F03 | 12792 |
| 3298 | Jan. 28, 1998 | 654 | RTA00000186AF.j.21.2 | M00001639D:B07 | 22506 |
| 3299 | Jan. 28, 1998 | 670 | RTA00000186AF.p.17.3 | M00001656B:A07 | 38383 |
| 3300 | Jan. 28, 1998 | 393 | RTA00000188AF.b.14.1 | M00003754D:D02 | 0 |
| 3301 | Jan. 28, 1998 | 422 | RTA00000189AF.b.12.1 | M00003829B:G03 | 17233 |
| 3301 | Jan. 28, 1998 | 210 | RTA00000189AR.b.12.1 | M00003829B:G03 | 17233 |
| 3302 | Jan. 28, 1998 | 587 | RTA00000199F.a.3.1 | M00003772D:E10 | 16617 |
| 3303 | Jan. 28, 1998 | 394 | RTA00000198AF.p.22.1 | M00003771A:G10 | 0 |
| 3304 | Jan. 28, 1998 | 542 | RTA00000198R.p.12.1 | M00003763D:E10 | 8878 |
| 3304 | Jan. 28, 1998 | 64 | RTA00000198AF.p.12.1 | M00003763D:E10 | 8878 |
| 3305 | Jan. 28, 1998 | 64 | RTA00000198AF.p.12.1 | M00003763D:E10 | 8878 |
| 3305 | Jan. 28, 1998 | 542 | RTA00000198R.p.12.1 | M00003763D:E10 | 8878 |
| 3306 | Jan. 28, 1998 | 465 | RTA00000187AF.k.20.1 | M00001680B:C01 | 3648 |
| 3307 | Jan. 28, 1998 | 423 | RTA00000188AR.b.17.1 | M00003755A:B03 | 10662 |
| 3308 | Jan. 28, 1998 | 711 | RTA00000198F.i.2.1 | M00001637B:E07 | 8076 |
| 3309 | Jan. 28, 1998 | 497 | RTA00000198AF.o.09.1 | M00003751B:A05 | 4310 |
| 3309 | Jan. 28, 1998 | 506 | RTA00000198R.o.09.1 | M00003751B:A05 | 4310 |
| 3310 | Jan. 28, 1998 | 506 | RTA00000198R.o.09.1 | M00003751B:A05 | 4310 |
| 3310 | Jan. 28, 1998 | 497 | RTA00000198AF.o.09.1 | M00003751B:A05 | 4310 |
| 3311 | Jan. 28, 1998 | 432 | RTA00000198AF.o.05.1 | M00003750A:D01 | 26702 |
| 3311 | Jan. 28, 1998 | 49 | RTA00000198R.o.05.1 | M00003750A:D01 | 26702 |
| 3312 | Jan. 28, 1998 | 49 | RTA00000198R.o.05.1 | M00003750A:D01 | 26702 |
| 3312 | Jan. 28, 1998 | 432 | RTA00000198AF.o.05.1 | M00003750A:D01 | 26702 |
| 3313 | Jan. 28, 1998 | 585 | RTA00000198AF.n.18.1 | M00001771A:A07 | 16715 |
| 3314 | Jan. 28, 1998 | 527 | RTA00000198R.m.23.1 | M00001684B:G03 | 38469 |
| 3315 | Jan. 28, 1998 | 471 | RTA00000188AF.e.2.1 | M00003763B:H01 | 0 |
| 3316 | Jan. 28, 1998 | 171 | RTA00000198R.c.07.1 | M00001575D:G05 | 19181 |
| 3316 | Jan. 28, 1998 | 525 | RTA00000198AF.c.7.1 | M00001575D:G05 | 19181 |
| 3317 | Jan. 28, 1998 | 557 | RTA00000198AF.d.9.1 | M00001587D:A10 | 8841 |
| 3318 | Jan. 28, 1998 | 523 | RTA00000198AF.d.4.1 | M00001586D:E02 | 22435 |
| 3319 | Jan. 28, 1998 | 441 | RTA00000185AF.e.6.1 | M00001583B:E10 | 0 |
| 3320 | Jan. 28, 1998 | 439 | RTA00000185AF.d.14.2 | M00001579D:G07 | 8071 |
| 3321 | Jan. 28, 1998 | 561 | RTA00000185AR.d.10.1 | M00001579C:H10 | 0 |
| 3322 | Jan. 28, 1998 | 277 | RTA00000198AR.i.08.1 | M00001639A:F10 | 9807 |
| 3322 | Jan. 28, 1998 | 487 | RTA00000198F.i.8.1 | M00001639A:F10 | 9807 |
| 3323 | Jan. 28, 1998 | 525 | RTA00000198AF.c.7.1 | M00001575D:G05 | 19181 |
| 3323 | Jan. 28, 1998 | 171 | RTA00000198R.c.07.1 | M00001575D:G05 | 19181 |
| 3324 | Feb. 24, 1998 | 317 | RTA00000195AF.b.21.1 | M00001595B:A09 | 39055 |
| 3324 | Jan. 28, 1998 | 602 | RTA00000195AF.b.21.1 | M00001595B:A09 | 39055 |
| 3325 | Jan. 28, 1998 | 507 | RTA00000198AF.c.5.1 | M00001573D:F10 | 53802 |
| 3326 | Jan. 28, 1998 | 414 | RTA00000185AR.b.15.1 | M00001573D:F04 | 39813 |
| 3326 | Jan. 28, 1998 | 428 | RTA00000185AF.b.15.2 | M00001573D:F04 | 39813 |
| 3327 | Jan. 28, 1998 | 428 | RTA00000185AF.b.15.2 | M00001573D:F04 | 39813 |
| 3327 | Jan. 28, 1998 | 414 | RTA00000185AR.b.15.1 | M00001573D:F04 | 39813 |
| 3328 | Jan. 28, 1998 | 414 | RTA00000155AR.b.15.1 | M00001573D:F04 | 39813 |
| 3328 | Jan. 28, 1998 | 428 | RTA00000185AF.b.15.2 | M00001573D:F04 | 39813 |
| 3329 | Jan. 28, 1998 | 428 | RTA00000185AF.b.15.2 | M00001573D:F04 | 39813 |
| 3329 | Jan. 28, 1998 | 414 | RTA00000185AR.b.15.1 | M00001573D:F04 | 39813 |
| 3330 | Jan. 28, 1998 | 392 | RTA00000185AF.b.11.2 | M00001573C:D03 | 9024 |
| 3331 | Jan. 28, 1998 | 549 | RTA00000198AF.c.16.1 | M00001579C:B11 | 26801 |
| 3332 | Jan. 28, 1998 | 628 | RTA00000198AF.g.16.1 | M00001621D:D03 | 6602 |
| 3333 | Jan. 28, 1998 | 616 | RTA00000188AF.m.07.1 | M00003798D:E03 | 23183 |
| 3334 | Jan. 28, 1998 | 489 | RTA00000186AF.h.22.1 | M00001634B:C10 | 16485 |
| 3335 | Jan. 28, 1998 | 655 | RTA00000186AF.g.8.2 | M00001630B:A11 | 8065 |
| 3336 | Jan. 28, 1998 | 592 | RTA00000186AF.e.18.1 | M00001624C:A06 | 0 |
| 3337 | Jan. 28, 1998 | 713 | RTA00000198AF.g.21.1 | M00001624A:F09 | 6273 |
| 3338 | Jan. 28, 1998 | 554 | RTA00000186AR.e.07.4 | M00001623D:G03 | 4175 |
| 3338 | Jan. 28, 1998 | 400 | RTA00000186AR.e.07.3 | M00001623D:G03 | 4175 |
| 3339 | Jan. 28, 1998 | 467 | RTA00000195AF.b.19.1 | M00001589A:D12 | 77678 |
| 3340 | Jan. 28, 1998 | 646 | RTA00000186AF.d.24.1 | M00001623C:H07 | 3114 |
| 3341 | Jan. 28, 1998 | 740 | RTA00000198AF.d.15.1 | M00001590C:H08 | 5997 |
| 3342 | Jan. 28, 1998 | 504 | RTA00000198AF.g.2.1 | M00001615C:D02 | 16640 |
| 3343 | Jan. 28, 1998 | 470 | RTA00000198AF.f.16.1 | M00001614A:E06 | 0 |
| 3344 | Jan. 28, 1998 | 388 | RTA00000185AF.n.17.1 | M00001609B:A11 | 5336 |
| 3345 | Jan. 28, 1998 | 495 | RTA00000185AF.j.21.1 | M00001597A:E12 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3346 | Feb. 24, 1998 | 317 | RTA00000195AF.b.21.1 | M00001595B:A09 | 39055 |
| 3346 | Jan. 28, 1998 | 602 | RTA00000195AF.b.21.1 | M00001595B:A09 | 39055 |
| 3347 | Jan. 28, 1998 | 487 | RTA00000198F.i.8.1 | M00001639A:F10 | 9807 |
| 3347 | Jan. 28, 1998 | 277 | RTA00000198AR.i.08.1 | M00001639A:F10 | 9807 |
| 3348 | Jan. 28, 1998 | 554 | RTA00000186AR.e.07.4 | M00001623D:G03 | 4175 |
| 3348 | Jan. 28, 1998 | 400 | RTA00000186AR.e.07.3 | M00001623D:G03 | 4175 |
| 3349 | Jan. 28, 1998 | 699 | RTA00000178AF.a.12.1 | M00001362B:H06 | 0 |
| 3350 | Jan. 28, 1998 | 416 | RTA00000199F.a.5.1 | M00003773B:G01 | 22134 |
| 3351 | Jan. 28, 1998 | 656 | RTA00000178AR.h.22.3 | M00001376B:A08 | 19230 |
| 3351 | Jan. 28, 1998 | 657 | RTA00000178AR.h.22.2 | M00001376B:A08 | 19230 |
| 3351 | Feb. 24, 1998 | 1137 | RTA00000345F.d.03.1 | M00001376B:A08 | 19230 |
| 3352 | Jan. 28, 1998 | 656 | RTA00000178AR.h.22.3 | M00001376B:A08 | 19230 |
| 3352 | Jan. 28, 1998 | 657 | RTA00000178AR.h.22.2 | M00001376B:A08 | 19230 |
| 3352 | Feb. 24, 1998 | 1137 | RTA00000345F.d.03.1 | M00001376B:A08 | 19230 |
| 3353 | Jan. 28, 1998 | 522 | RTA00000178AR.h.17.2 | M00001376A:C05 | 23824 |
| 3353 | Feb. 24, 1998 | 1095 | RTA00000345F.c.12.1 | M00001376A:C05 | 23824 |
| 3354 | Jan. 28, 1998 | 522 | RTA00000178AR.h.17.2 | M00001376A:C05 | 23824 |
| 3354 | Feb. 24, 1998 | 1095 | RTA00000345F.c.12.1 | M00001376A:C05 | 23824 |
| 3355 | Jan. 28, 1998 | 656 | RTA00000178AR.h.22.3 | M00001376B:A08 | 19230 |
| 3355 | Jan. 28, 1998 | 657 | RTA00000178AR.h.22.2 | M00001376B:A08 | 19230 |
| 3355 | Feb. 24, 1998 | 1137 | RTA00000345F.d.03.1 | M00001376B:A08 | 19230 |
| 3356 | Jan. 28, 1998 | 566 | RTA00000195F.a.4.1 | M00001372C:G12 | 20470 |
| 3357 | Jan. 28, 1998 | 657 | RTA00000178AR.h.22.2 | M00001376B:A08 | 19230 |
| 3357 | Jan. 28, 1998 | 656 | RTA00000178AR.h.22.3 | M00001376B:A08 | 19230 |
| 3357 | Feb. 24, 1998 | 1137 | RTA00000345F.d.03.1 | M00001376B:A08 | 19230 |
| 3358 | Jan. 28, 1998 | 605 | RTA00000196F.e.9.1 | M00001361A:H07 | 23300 |
| 3359 | Jan. 28, 1998 | 532 | RTA00000177AF.o.4.1 | M00001358C:C06 | 0 |
| 3360 | Jan. 28, 1998 | 493 | RTA00000177AF.m.17.1 | M00001355B:G10 | 14391 |
| 3360 | Jan. 28, 1998 | 330 | RTA00000177AR.m.17.4 | M00001355B:G10 | 14391 |
| 3360 | Jan. 28, 1998 | 337 | RTA00000177AR.m.17.3 | M00001355B:G10 | 14391 |
| 3361 | Jan. 28, 1998 | 330 | RTA00000177AR.m.17.4 | M00001355B:G10 | 14391 |
| 3361 | Jan. 28, 1998 | 493 | RTA00000177AF.m.17.1 | M00001355B:G10 | 14391 |
| 3361 | Jan. 28, 1998 | 337 | RTA00000177AR.m.17.3 | M00001355B:G10 | 14391 |
| 3362 | Jan. 28, 1998 | 337 | RTA00000177AR.m.17.3 | M00001355B:G10 | 14391 |
| 3362 | Jan. 28, 1998 | 493 | RTA00000177AF.m.17.1 | M00001355B:G10 | 14391 |
| 3362 | Jan. 28, 1998 | 330 | RTA00000177AR.m.17.4 | M00001355B:G10 | 14391 |
| 3363 | Jan. 28, 1998 | 742 | RTA00000177AF.m.1.1 | M00001353D:D10 | 14929 |
| 3364 | Jan. 28, 1998 | 547 | RTA00000196AF.g.8.1 | M00001375B:G12 | 39665 |
| 3365 | Jan. 28, 1998 | 510 | RTA00000178AF.n.23.1 | M00001387B:E02 | 3298 |
| 3366 | Jan. 28, 1998 | 606 | RTA00000179AR.e.01.4 | M00001395A:C09 | 2493 |
| 3367 | Feb. 24, 1998 | 1065 | RTA00000195R.a.06.1 | M00001394A:E04 | 35265 |
| 3367 | Jan. 28, 1998 | 595 | RTA00000195R.a.06.1 | M00001394A:E04 | 35265 |
| 3368 | Feb. 24, 1998 | 1065 | RTA00000195R.a.06.1 | M00001394A:E04 | 35265 |
| 3368 | Jan. 28, 1998 | 595 | RTA00000195R.a.06.1 | M00001394A:E04 | 35265 |
| 3369 | Jan. 28, 1998 | 370 | RTA00000179AF.c.15.3 | M00001392D:H06 | 2995 |
| 3369 | Jan. 28, 1998 | 460 | RTA00000179AF.c.15.1 | M00001392D:H06 | 2995 |
| 3370 | Jan. 28, 1998 | 370 | RTA00000179AF.c.15.3 | M00001392D:H06 | 2995 |
| 3370 | Jan. 28, 1998 | 460 | RTA00000179AF.c.15.1 | M00001392D:H06 | 2995 |
| 3371 | Jan. 28, 1998 | 657 | RTA00000178AR.h.22.2 | M00001376B:A08 | 19230 |
| 3371 | Jan. 28, 1998 | 656 | RTA00000178AR.h.22.3 | M00001376B:A08 | 19230 |
| 3371 | Feb. 24, 1998 | 1137 | RTA00000345F.d.03.1 | M00001376B:A08 | 19230 |
| 3372 | Jan. 28, 1998 | 675 | RTA00000179AR.b.21.3 | M00001392C:D05 | 4366 |
| 3372 | Feb. 24, 1998 | 1264 | RTA00000345F.e.13.1 | M00001392C:D05 | 4366 |
| 3373 | Jan. 28, 1998 | 168 | RTA00000177AR.k.23.1 | M00001352D:D02 | 35550 |
| 3373 | Jan. 28, 1998 | 463 | RTA00000177AR.k.23.4 | M00001352D:D02 | 35550 |
| 3374 | Jan. 28, 1998 | 652 | RTA00000178AR.m.21.4 | M00001385A:F12 | 786 |
| 3374 | Jan. 28, 1998 | 653 | RTA00000178AR.m.21.5 | M00001385A:F12 | 7861 |
| 3375 | Jan. 28, 1998 | 653 | RTA00000178AR.m.21.5 | M00001385A:F12 | 7861 |
| 3375 | Jan. 28, 1998 | 652 | RTA00000178AR.m.21.4 | M00001385A:F12 | 7861 |
| 3376 | Jan. 28, 1998 | 672 | RTA00000196AF.h.09.1 | M00001382B:F12 | 8015 |
| 3377 | Jan. 28, 1998 | 668 | RTA00000178AF.i.17.1 | M00001377C:E12 | 0 |
| 3378 | Jan. 28, 1998 | 746 | RTA00000178AF.i.01.2 | M00001376B:F03 | 4 |
| 3379 | Jan. 28, 1998 | 656 | RTA00000178AR.h.22.3 | M00001376B:A08 | 19230 |
| 3379 | Jan. 28, 1998 | 657 | RTA00000178AR.h.22.2 | M00001376B:A08 | 19230 |
| 3379 | Feb. 24, 1998 | 1137 | RTA00000345F.d.03.1 | M00001376B:A08 | 19230 |
| 3380 | Jan. 28, 1998 | 675 | RTA00000179AR.b.21.3 | M00001392C:D05 | 4366 |
| 3380 | Feb. 24, 1998 | 1264 | RTA00000345F.e.13.1 | M00001392C:D05 | 4366 |
| 3381 | Jan. 28, 1998 | 651 | RTA00000189AR.d.22.2 | M00003844C:B11 | 6539 |
| 3382 | Jan. 28, 1998 | 444 | RTA00000189AF.l.16.1 | M00003879A:G05 | 0 |
| 3383 | Jan. 28, 1998 | 648 | RTA00000199F.i.9.1 | M00003878C:E04 | 7 |
| 3384 | Feb. 24, 1998 | 678 | RTA00000195AF.c.24.1 | M00003860D:H07 | 0 |
| 3384 | Jan. 28, 1998 | 412 | RTA00000195AF.c.24.1 | M00003860D:H07 | 0 |
| 3385 | Jan. 28, 1998 | 412 | RTA00000195AF.c.24.1 | M00003860D:H07 | 0 |
| 3385 | Feb. 24, 1998 | 678 | RTA00000Z95AF.c.24.1 | M00003860D:H07 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3386 | Jan. 28, 1998 | 484 | RTA00000199F.g.20.2 | M00003860D:A01 | 15767 |
| 3387 | Jan. 28, 1998 | 398 | RTA00000177AR.l.13.3 | M00001353A:G12 | 8078 |
| 3388 | Jan. 28, 1998 | 556 | RTA00000199F.f.17.2 | M00003845D:B04 | 22905 |
| 3389 | Jan. 28, 1998 | 545 | RTA00000196F.a.2.1 | M00001338B:E02 | 3575 |
| 3390 | Jan. 28, 1998 | 406 | RTA00000199F.f.09.2 | M00003842B:D09 | 22907 |
| 3390 | Jan. 28, 1998 | 78 | RTA00000199R.f.09.1 | M00003842B:D09 | 22907 |
| 3391 | Jan. 28, 1998 | 78 | RTA00000199R.f.09.1 | M00003842B:D09 | 22907 |
| 3391 | Jan. 28, 1998 | 406 | RTA00000199F.f.09.2 | M00003842B:D09 | 22907 |
| 3392 | Jan. 28, 1998 | 692 | RTA00000199F.e.4.1 | M00003820B:C05 | 0 |
| 3393 | Jan. 28, 1998 | 458 | RTA00000199R.d.16.1 | M00003812C:A05 | 24191 |
| 3394 | Jan. 28, 1998 | 755 | RTA00000199F.c.21.2 | M00003803C:D09 | 5070 |
| 3395 | Jan. 28, 1998 | 505 | RTA00000188AF.n.03.1 | M00003801B:B10 | 9443 |
| 3396 | Jan. 28, 1998 | 714 | RTA00000199R.g.07.1 | M00003853D:D03 | 0 |
| 3397 | Jan. 28, 1998 | 724 | RTA00000177AR.f.15.4 | M00001345B:E10 | 9062 |
| 3398 | Jan. 28, 1998 | 623 | RTA00000198R.b.24.1 | M00001571D:B11 | 19047 |
| 3398 | Jan. 28, 1998 | 748 | RTA00000198AF.b.24.1 | M00001571D:B11 | 19047 |
| 3399 | Jan. 28, 1998 | 395 | RTA00000196R.c.21.2 | M00001352C:H10 | 0 |
| 3400 | Jan. 28, 1998 | 593 | RTA00000196R.c.14.2 | M00001352B:F04 | 23105 |
| 3400 | Jan. 28, 1998 | 485 | RTA00000196AF.c.14.1 | M00001352B:F04 | 23105 |
| 3401 | Jan. 28, 1998 | 485 | RTA00000196AF.c.14.1 | M00001352B:F04 | 23105 |
| 3401 | Jan. 28, 1998 | 593 | RTA00000196R.c.14.2 | M00001352B:F04 | 23105 |
| 3402 | Jan. 28, 1998 | 645 | RTA00000177AF.k.9.1 | M00001352A:E02 | 16245 |
| 3403 | Jan. 28, 1998 | 576 | RTA00000196AF.c.7.1 | M00001350B:G11 | 0 |
| 3404 | Jan. 28, 1998 | 737 | RTA00000189AR.m.9.1 | M00003880B:C08 | 2917 |
| 3405 | Jan. 28, 1998 | 728 | RTA00000177AR.f.17.4 | M00001345C:B01 | 8594 |
| 3406 | Jan. 28, 1998 | 453 | RTA00000199AF.i.20.1 | M00003881A:D09 | 9544 |
| 3407 | Jan. 28, 1998 | 440 | RTA00000177AR.f.13.4 | M00001345A:G11 | 10480 |
| 3408 | Jan. 28, 1998 | 680 | RTA00000177AF.f.10.1 | M00001345A:E01 | 6420 |
| 3409 | Jan. 28, 1998 | 573 | RTA00000196AF.b.7.1 | M00001344A:G07 | 7774 |
| 3410 | Jan. 28, 1998 | 402 | RTA00000177AF.b.21.4 | M00001341A:F12 | 4443 |
| 3411 | Jan. 28, 1998 | 702 | RTA00000177AR.b.8.5 | M00001340B:A06 | 17062 |
| 3412 | Jan. 28, 1998 | 463 | RTA00000177AR.k.23.4 | M00001352D:D02 | 35550 |
| 3412 | Jan. 28, 1998 | 168 | RTA00000177AR.k.23.1 | M00001352D:D02 | 35550 |
| 3413 | Jan. 28, 1998 | 600 | RTA00000177AF.g.4.1 | M00001346B:B07 | 4119 |
| 3414 | Jan. 28, 1998 | 280 | RTA00000193AF.b.18.1 | M00004233C:H09 | 7542 |
| 3415 | Jan. 28, 1998 | 748 | RTA00000198AF.b.24.1 | M00001571D:B11 | 19047 |
| 3415 | Jan. 28, 1998 | 623 | RTA00000198R.b.24.1 | M00001571D:B11 | 19047 |
| 3416 | Jan. 28, 1998 | 249 | RTA00000200R.o.03.2 | M00004257C:H06 | 22807 |
| 3416 | Jan. 28, 1998 | 178 | RTA00000200F.o.03.1 | M00004257C:H06 | 22807 |
| 3416 | Jan. 28, 1998 | 85 | RTA00000200R.o.03.1 | M00004257C:H06 | 22807 |
| 3417 | Jan. 28, 1998 | 282 | RTA00000193AF.c.15.1 | M00004248B:E08 | 3726 |
| 3418 | Jan. 28, 1998 | 307 | RTA00000200F.n.05.2 | M00004246C:A09 | 18989 |
| 3418 | Jan. 28, 1998 | 319 | RTA00000200F.n.05.1 | M00004246C:A09 | 18989 |
| 3419 | Jan. 28, 1998 | 319 | RTA00000200F.n.05.1 | M00004246C:A09 | 18989 |
| 3419 | Jan. 28, 1998 | 307 | RTA00000200F.n.05.2 | M00004246C:A09 | 18989 |
| 3420 | Jan. 28, 1998 | 85 | RTA00000200R.o.03.1 | M00004257C:H06 | 22807 |
| 3420 | Jan. 28, 1998 | 249 | RTA00000200R.o.03.2 | M00004257C:H06 | 22807 |
| 3420 | Jan. 28, 1998 | 178 | RTA00000200F.o.03.1 | M00004257C:H06 | 22807 |
| 3421 | Jan. 28, 1998 | 307 | RTA00000200F.n.05.2 | M00004246C:A09 | 18989 |
| 3421 | Jan. 28, 1998 | 319 | RTA00000200F.n.05.1 | M00004246C:A09 | 18989 |
| 3422 | Jan. 28, 1998 | 50 | RTA00000201R.a.02.1 | M00004295B:D02 | 35362 |
| 3422 | Jan. 28, 1998 | 235 | RTA00000201AF.a.02.1 | M00004295B:D02 | 35362 |
| 3423 | Jan. 28, 1998 | 251 | RTA00000192AF.n.13.1 | M00004197D:H01 | 8210 |
| 3424 | Jan. 28, 1998 | 47 | RTA00000192AF.m.12.1 | M00004191D:B11 | 0 |
| 3425 | Jan. 28, 1998 | 494 | RTA00000200AF.k.1.1 | M00004188C:A09 | 40049 |
| 3425 | Jan. 28, 1998 | 194 | RTA00000200R.k.01.1 | M00004188C:A09 | 40049 |
| 3426 | Jan. 28, 1998 | 494 | RTA00000200AF.k.1.1 | M00004185C:A09 | 40049 |
| 3426 | Jan. 28, 1998 | 194 | RTA00000200R.k.01.1 | M00004185C:A09 | 40049 |
| 3427 | Jan. 28, 1998 | 231 | RTA00000192AF.l.13.2 | M00004185C:C03 | 11443 |
| 3428 | Jan. 28, 1998 | 382 | RTA00000200AF.j.6.1 | M00004176B:E08 | 22902 |
| 3429 | Jan. 28, 1998 | 307 | RTA00000200F.n.05.2 | M00004246C:A09 | 18989 |
| 3429 | Jan. 28, 1998 | 319 | RTA00000200F.n.05.1 | M00004246C:A09 | 18989 |
| 3430 | Jan. 28, 1998 | 52 | RTA00000201R.b.02.1 | M00004319D:G09 | 22660 |
| 3431 | Jan. 28, 1998 | 271 | RTA00000201F.d.02.1 | M00004375A:H01 | 2599 |
| 3431 | Jan. 28, 1998 | 239 | RTA00000201R.d.02.1 | M00004375A:H01 | 2599 |
| 3431 | Jan. 28, 1998 | 227 | RTA00000201R.d.02.2 | M00004375A:H01 | 2599 |
| 3432 | Jan. 28, 1998 | 227 | RTA00000201R.d.02.2 | M00004375A:H01 | 2599 |
| 3432 | Jan. 28, 1998 | 239 | RTA00000201R.d.02.1 | M00004375A:H01 | 2599 |
| 3432 | Jan. 28, 1998 | 271 | RTA00000201F.d.02.1 | M00004375A:H01 | 2599 |
| 3433 | Jan. 28, 1998 | 227 | RTA00000201R.d.02.2 | M00004375A:H01 | 2599 |
| 3433 | Jan. 28, 1998 | 271 | RTA00000201F.d.02.1 | M00064375A:H01 | 2599 |
| 3433 | Jan. 28, 1998 | 239 | RTA00000201R.d.02.1 | M00004375A:H01 | 2599 |
| 3434 | Jan. 28, 1998 | 271 | RTA00000201F.d.02.1 | M00004375A:H01 | 2599 |
| 3434 | Jan. 28, 1998 | 239 | RTA01000201R.d.02.1 | M00004375A:H01 | 2599 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3434 | Jan. 28, 1998 | 227 | RTA00000201R.d.02.2 | M00004375A:H01 | 2599 |
| 3435 | Jan. 28, 1998 | 227 | RTA00000201R.d.02.2 | M00004375A:H01 | 2599 |
| 3435 | Jan. 28, 1998 | 271 | RTA00000201F.d.02.1 | M00004375A:H01 | 2599 |
| 3435 | Jan. 28, 1998 | 239 | RTA00000201R.d.02.1 | M00004375A:H01 | 2599 |
| 3436 | Jan. 28, 1998 | 178 | RTA00000200F.o.03.1 | M00004257C:H06 | 22807 |
| 3436 | Jan. 28, 1998 | 249 | RTA00000200R.o.03.2 | M00004257C:H06 | 22807 |
| 3436 | Jan. 28, 1998 | 85 | RTA00000200R.o.03.1 | M00004257C:H06 | 22807 |
| 3437 | Jan. 28, 1998 | 273 | RTA00000201F.c.08.1 | M00004353C:H07 | 0 |
| 3438 | Jan. 28, 1998 | 328 | RTA00000200AF.g.09.1 | M00004131B:H09 | 22785 |
| 3438 | Jan. 28, 1998 | 26 | RTA00000200R.g.09.1 | M00004131B:H09 | 22785 |
| 3439 | Feb. 24, 1998 | 571 | RTA00000355R.e.14.1 | M00004314B:G07 | 16837 |
| 3439 | Jan. 28, 1998 | 343 | RTA00000201F.a.18.1 | M00004314B:G07 | 16837 |
| 3440 | Jan. 28, 1998 | 343 | RTA00000201F.a.18.1 | M00004314B:G07 | 16837 |
| 3440 | Feb. 24, 1998 | 571 | RTA00000355R.e.14.1 | M00004314B:G07 | 16837 |
| 3441 | Jan. 28, 1998 | 164 | RTA00000193AR.i.14.4 | M00004307C:A06 | 9457 |
| 3442 | Jan. 28, 1998 | 50 | RTA00000201R.a.02.1 | M00004295B:D02 | 35362 |
| 3442 | Jan. 28, 1998 | 235 | RTA00000201AF.a.02.1 | M00004295B:D02 | 35362 |
| 3443 | Jan. 28, 1998 | 235 | RTA00000201AF.a.02.1 | M00004295B:D02 | 35362 |
| 3443 | Jan. 28, 1998 | 50 | RTA00000201R.a.02.1 | M00004295B:D02 | 35362 |
| 3444 | Jan. 28, 1998 | 50 | RTA00000201R.a.02.1 | M00004295B:D02 | 35362 |
| 3444 | Jan. 28, 1998 | 235 | RTA00000201AF.a.02.1 | M00004295B:D02 | 35362 |
| 3445 | Jan. 28, 1998 | 227 | RTA00000201R.d.02.2 | M00004375A:H01 | 2599 |
| 3445 | Jan. 28, 1998 | 271 | RTA00000201F.d.02.1 | M00004375A:H01 | 2599 |
| 3445 | Jan. 28, 1998 | 239 | RTA00000201R.d.02.1 | M00004375A:H01 | 2599 |
| 3446 | Jan. 28, 1998 | 13 | RTA00000190AF.i.5.1 | M00003919A:A10 | 0 |
| 3447 | Jan. 28, 1998 | 72 | RTA00000200F.a.6.1 | M00004029B:F11 | 36952 |
| 3448 | Jan. 28, 1998 | 101 | RTA00000191AF.d.08.2 | M00003997B:G07 | 970 |
| 3449 | Jan. 28, 1998 | 79 | RTA00000199AF.p.4.1 | M00003985C:F01 | 10282 |
| 3450 | Jan. 28, 1998 | 121 | RTA00000199AF.o.16.1 | M00003979A:F03 | 16721 |
| 3451 | Jan. 28, 1998 | 193 | RTA00000199AF.n.3.1 | M00003946D:C11 | 0 |
| 3452 | Jan. 28, 1998 | 165 | RTA00000192AF.g.23.1 | M00004157C:A09 | 6455 |
| 3453 | Jan. 28, 1998 | 381 | RTA00000199AF.m.14.1 | M00003938A:B04 | 10580 |
| 3454 | Jan. 28, 1998 | 123 | RTA00000191AF.k.6.1 | M00004078B:A11 | 5451 |
| 3455 | Jan. 28, 1998 | 102 | RTA00000199R.j.08.1 | M00003884D:G07 | 37844 |
| 3456 | Jan. 28, 1998 | 86 | RTA00000189AF.l.22.1 | M00003879C:G10 | 33333 |
| 3457 | Jan. 28, 1998 | 148 | RTA00000199F.h.17.2 | M00003871A:A05 | 36254 |
| 3458 | Jan. 28, 1998 | 143 | RTA00000199R.h.09.1 | M00003867C:H09 | 76020 |
| 3459 | Jan. 28, 1998 | 266 | RTA00000199F.f.21.2 | M00003847C:E09 | 13344 |
| 3460 | Feb. 24, 1998 | 153 | RTA00000422F.g.22.1 | M00001585B:A06 | 22561 |
| 3461 | Jan. 28, 1998 | 292 | RTA00000199AF.m.18.1 | M00003939C:F04 | 0 |
| 3462 | Jan. 28, 1998 | 275 | RTA00000191AF.o.17.2 | M00004102A:H02 | 5957 |
| 3462 | Jan. 28, 1998 | 274 | RTA00000191AF.o.17.1 | M00004102A:H02 | 5957 |
| 3463 | Jan. 28, 1998 | 239 | RTA00000201R.d.02.1 | M00004375A:H01 | 2599 |
| 3463 | Jan. 28, 1998 | 271 | RTA00000201F.d.02.1 | M00004375A:H01 | 2599 |
| 3463 | Jan. 28, 1998 | 227 | RTA00000201R.d.02.2 | M00004375A:H01 | 2599 |
| 3464 | Jan. 28, 1998 | 328 | RTA00000200AF.g.09.1 | M00004131B:H09 | 22785 |
| 3464 | Jan. 28, 1998 | 26 | RTA00000200R.g.09.1 | M00004131B:H09 | 22785 |
| 3465 | Jan. 28, 1998 | 214 | RTA00000200AF.f.22.1 | M00004121C:F06 | 16521 |
| 3466 | Jan. 28, 1998 | 160 | RTA00000192AF.b.20.1 | M00004118D:E08 | 0 |
| 3467 | Jan. 28, 1998 | 98 | RTA00000200AF.f.14.1 | M00004115D:C08 | 22051 |
| 3467 | Jan. 28, 1998 | 100 | RTAG0000200R.f.14.1 | M00004115D:C08 | 22051 |
| 3468 | Jan. 28, 1998 | 98 | RTA00000200AF.f.14.1 | M00004115D:C08 | 22051 |
| 3468 | Jan. 28, 1998 | 100 | RTA00000200R.f.14.1 | M00004115D:C08 | 22051 |
| 3469 | Jan. 28, 1998 | 305 | RTA00000200AF.b.15.1 | M00004040D:F01 | 10627 |
| 3470 | Jan. 28, 1998 | 98 | RTA00000200AF.f.14.1 | M00004115D:C08 | 22051 |
| 3470 | Jan. 28, 1998 | 100 | RTA00000200R.f.14.1 | M00004115D:C08 | 22051 |
| 3471 | Jan. 28, 1998 | 29 | RTA00000200AF.b.19.1 | M00004042D:H02 | 22847 |
| 3472 | Jan. 28, 1998 | 274 | RTA00000191AF.o.17.1 | M00004102A:H02 | 5957 |
| 3472 | Jan. 28, 1998 | 275 | RTA00000191AF.o.17.2 | M00004102A:H02 | 5957 |
| 3473 | Jan. 28, 1998 | 274 | RTA00000191AF.o.17.1 | M00004102A:H02 | 5957 |
| 3473 | Jan. 28, 1998 | 275 | RTA00000191AF.o.17.2 | M00004102A:H02 | 5957 |
| 3474 | Jan. 28, 1998 | 275 | RTA00000191AF.o.17.2 | M00004102A:H02 | 5957 |
| 3474 | Jan. 28, 1998 | 274 | RTA00000191AF.o.17.1 | M00004102A:H02 | 5957 |
| 3475 | Jan. 28, 1998 | 226 | RTA00000191AR.o.09.4 | M00004096A:G02 | 0 |
| 3476 | Jan. 28, 1998 | 40 | RTA00000200AR.e.02.1 | M00004090A:F09 | 36059 |
| 3477 | Jan. 28, 1998 | 175 | RTA00000200F.i.5.1 | M00004156B:A12 | 22892 |
| 3478 | Jan. 28, 1998 | 98 | RTA00000200AF.f.14.1 | M00004115D:C08 | 22051 |
| 3478 | Jan. 28, 1998 | 100 | RTA00000200R.f.14.1 | M00004115D:C08 | 22051 |
| 3479 | Jan. 28, 1998 | 643 | RTA00000184AF.c.9.1 | M00001546C:G10 | 16245 |
| 3480 | Jan. 28, 1998 | 615 | RTA00000197R.p.20.1 | M00001554B:B07 | 22795 |
| 3480 | Jan. 28, 1998 | 559 | RTA00000197AF.p.20.1 | M00001554B:B07 | 22795 |
| 3481 | Jan. 28, 1998 | 660 | RTA00000197AF.p.16.1 | M00001552D:G08 | 6013 |
| 3482 | Jan. 28, 1998 | 521 | RTA00000197AF.p.12.1 | M00001552B:G05 | 0 |
| 3483 | Jan. 28, 1998 | 403 | RTA00000184AF.f.13.1 | M00001550D:H02 | 3784 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3484 | Jan. 28, 1998 | 517 | RTA00000184AF.e.14.1 | M00001549C:D02 | 16347 |
| 3485 | Jan. 28, 1998 | 676 | RTA00000197AR.m.14.1 | M00001531B:E09 | 14879 |
| 3486 | Jan. 28, 1998 | 596 | RTA00000184AF.d.9.1 | M00001548A:B11 | 6515 |
| 3487 | Jan. 28, 1998 | 559 | RTA00000197AF.p.20.1 | M00001554B:B07 | 22795 |
| 3487 | Jan. 28, 1998 | 615 | RTA00000197R.p.20.1 | M00001554B:B07 | 22795 |
| 3488 | Jan. 28, 1998 | 729 | RTA00000184AF.a.19.1 | M00001544C:C06 | 2628 |
| 3489 | Jan. 28, 1998 | 682 | RTA00000125A.j.16.1 | M00001544A:E06 | 0 |
| 3490 | Jan. 28, 1998 | 723 | RTA00000183AF.p.24.1 | M00001543C:F01 | 3116 |
| 3491 | Jan. 28, 1998 | 509 | RTA00000183AF.p.17.1 | M00001543A:H12 | 5158 |
| 3492 | Jan. 28, 1998 | 738 | RTA00000183AF.o.8.1 | M00001540C:B10 | 8927 |
| 3493 | Jan. 28, 1998 | 227 | RTA00000201R.d.02.2 | M00004375A:H01 | 2599 |
| 3493 | Jan. 28, 1998 | 271 | RTA00000201F.d.02.1 | M00004375A:H01 | 2599 |
| 3493 | Jan. 28, 1998 | 239 | RTA00000201R.d.02.1 | M00004375A:H01 | 2599 |
| 3494 | Jan. 28, 1998 | 502 | RTA00000197AF.o.23.1 | M00001549A:A09 | 12682 |
| 3495 | Jan. 28, 1998 | 468 | RTA00000198AF.a.18.1 | M00001561C:E11 | 0 |
| 3496 | Jan. 28, 1998 | 210 | RTA00000189AR.b.12.1 | M00003829B:G03 | 17233 |
| 3496 | Jan. 28, 1998 | 422 | RTA00000189AF.b.12.1 | M00003829B:G03 | 17233 |
| 3497 | Jan. 28, 1998 | 748 | RTA00000198AF.b.24.1 | M00001571D:B11 | 19047 |
| 3497 | Jan. 28, 1998 | 623 | RTA00000198R.b.24.1 | M00001571D:B11 | 19047 |
| 3498 | Jan. 28, 1998 | 397 | RTA00000198AF.b.22.1 | M00001571B:E03 | 38956 |
| 3499 | Jan. 28, 1998 | 571 | RTA00000198AF.b.14.1 | M00001569C:B06 | 801 |
| 3500 | Jan. 28, 1998 | 492 | RTA00000198AF.b.8.1 | M00001567C:H12 | 22636 |
| 3500 | Jan. 28, 1998 | 23 | RTA00000198R.b.08.1 | M00001567C:H12 | 22636 |
| 3501 | Jan. 28, 1998 | 492 | RTA00000198AF.b.8.1 | M00001567C:H12 | 22636 |
| 3501 | Jan. 28, 1998 | 23 | RTA00000198R.b.08.1 | M00001567C:H12 | 22636 |
| 3502 | Jan. 28, 1998 | 559 | RTA00000197AF.p.20.1 | M00001554B:B07 | 22795 |
| 3502 | Jan. 28, 1998 | 615 | RTA00000197R.p.20.1 | M00001554B:B07 | 22795 |
| 3503 | Jan. 28, 1998 | 727 | RTA00000184AF.n.12.2 | M00001561D:C11 | 3727 |
| 3504 | Jan. 28, 1998 | 559 | RTA00000197AF.p.20.1 | M00001554B:B07 | 22795 |
| 3504 | Jan. 28, 1998 | 615 | RTA00000197R.p.20.1 | M00001554B:B07 | 22795 |
| 3505 | Jan. 28, 1998 | 641 | RTA00000198F.a.10.1 | M00001558A:E11 | 6695 |
| 3506 | Jan. 28, 1998 | 731 | RTA00000184F.k.02.1 | M00001557B:H10 | 5192 |
| 3507 | Jan. 28, 1998 | 597 | RTA00000198F.a.4.1 | M00001557A:F01 | 9635 |
| 3508 | Jan. 28, 1998 | 560 | RTA00000184AF.i.23.3 | M00001556A:F11 | 1577 |
| 3509 | Jan. 28, 1998 | 601 | RTA00000184AF.i.10.2 | M00001555A:B01 | 3744 |
| 3510 | Jan. 28, 1998 | 700 | RTA00000183AF.i.18.2 | M00001529D:H02 | 40129 |
| 3511 | Jan. 28, 1998 | 437 | RTA00000198R.a.23.1 | M00001563B:D11 | 10700 |
| 3512 | Jan. 28, 1998 | 591 | RTA00000197AF.h.1.1 | M00001470A:H01 | 13075 |
| 3512 | Jan. 28, 1998 | 110 | RTA00000197R.h.01.1 | M00001470A:H01 | 13075 |
| 3513 | Jan. 28, 1998 | 259 | RTA00000197AF.j.4.1 | M00001492D:A11 | 17209 |
| 3513 | Jan. 28, 1998 | 386 | RTA00000197AR.j.04.1 | M00001492D:A11 | 17209 |
| 3514 | Jan. 28, 1998 | 386 | RTA00000197AR.j.04.1 | M00001492D:A11 | 17209 |
| 3514 | Jan. 28, 1998 | 259 | RTA00000197AF.j.4.1 | M00001492D:A11 | 17209 |
| 3515 | Jan. 28, 1998 | 644 | RTA00000197F.i.12.1 | M00001489B:A06 | 3605 |
| 3516 | Jan. 28, 1998 | 633 | RTA00000197F.i.8.1 | M00001488A:E01 | 6292 |
| 3517 | Jan. 28, 1998 | 546 | RTA00000197F.i.6.1 | M00001487C:D06 | 12149 |
| 3518 | Jan. 28, 1998 | 650 | RTA00000183AR.n.17.1 | M00001539B:H06 | 9800 |
| 3519 | Jan. 28, 1998 | 513 | RTA00000197AF.h.14.1 | M00001477B:F04 | 7045 |
| 3520 | Jan. 28, 1998 | 519 | RTA00000183AF.a.24.2 | M00001499B:A11 | 10539 |
| 3521 | Jan. 28, 1998 | 110 | RTA00000197R.h.01.1 | M00001470A:H01 | 13075 |
| 3521 | Jan. 28, 1998 | 591 | RTA00000197AF.h.1.1 | M00001470A:H01 | 13075 |
| 3522 | Jan. 28, 1998 | 446 | RTA00000182AF.a.23.3 | M00001463A:F06 | 9755 |
| 3523 | Jan. 28, 1998 | 739 | RTA00000181AF.p.12.3 | M00001460C:H02 | 22204 |
| 3524 | Jan. 28, 1998 | 635 | RTA00000181AF.p.7.3 | M00001460A:E01 | 38773 |
| 3525 | Jan. 28, 1998 | 720 | RTA00000197AF.f.14.1 | M00001459B:C09 | 3732 |
| 3526 | Jan. 28, 1998 | 623 | RTA00000198R.b.24.1 | M00001571D:B11 | 19047 |
| 3526 | Jan. 28, 1998 | 748 | RTA00000198AF.b.24.1 | M00001571D:B11 | 19047 |
| 3527 | Jan. 28, 1998 | 419 | RTA00000182AF.j.20.1 | M00001483B:D03 | 4769 |
| 3528 | Jan. 28, 1998 | 632 | RTA00000183AR.g.03.1 | M00001512D:G09 | 3956 |
| 3528 | Jan. 28, 1998 | 630 | RTA00000183AR.g.03.2 | M00001512D:G09 | 3956 |
| 3529 | Jan. 28, 1998 | 695 | RTA00000197F.m.5.1 | M00001528C:H04 | 10872 |
| 3530 | Jan. 28, 1998 | 479 | RTA00000197R.l.22.1 | M00001528A:C11 | 6962 |
| 3530 | Jan. 28, 1998 | 665 | RTA00000197AF.l.22.1 | M00001528A:C11 | 6962 |
| 3531 | Jan. 28, 1998 | 479 | RTA00000197R.l.22.1 | M00001528A:C11 | 6962 |
| 3531 | Jan. 28, 1998 | 665 | RTA00000197AF.l.22.1 | M00001528A:C11 | 6962 |
| 3532 | Jan. 28, 1998 | 479 | RTA00000197R.l.22.1 | M00001528A:C11 | 6962 |
| 3532 | Jan. 28, 1998 | 665 | RTA00000197AF.l.22.1 | M00001528A:C11 | 6962 |
| 3533 | Jan. 28, 1998 | 479 | RTA00000197R.l.22.1 | M00001528A:C11 | 6962 |
| 3533 | Jan. 28, 1998 | 665 | RTA00000197AF.l.22.1 | M00001528A:C11 | 6962 |
| 3534 | Jan. 28, 1998 | 550 | RTA00000183AF.g.14.1 | M00001513D:A03 | 0 |
| 3535 | Jan. 28, 1998 | 404 | RTA00000195AF.b.6.1 | M00001496C:G10 | 39490 |
| 3536 | Jan. 28, 1998 | 630 | RTA00000183AR.g.03.2 | M00001512D:G09 | 3956 |
| 3536 | Jan. 28, 1998 | 632 | RTA00000183AR.g.03.1 | M00001512D:G09 | 3956 |
| 3537 | Jan. 28, 1998 | 570 | RTA00000183AF.a.19.2 | M00001499A:A05 | 3788 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3538 | Jan. 28, 1998 | 630 | RTA00000183AR.g.03.2 | M00001512D:009 | 3956 |
| 3538 | Jan. 28, 1998 | 632 | RTA00000183AR.g.03.1 | M00001512D:G09 | 3956 |
| 3539 | Jan. 28, 1998 | 603 | RTA00000183AR.d.11.3 | M00001504D:G06 | 6420 |
| 3540 | Jan. 28, 1998 | 715 | RTA00000197AR.k.11.1 | M00001500D:E10 | 53758 |
| 3541 | Jan. 28, 1998 | 503 | RTA00000197AF.k.9.1 | M00001500C:C08 | 3138 |
| 3542 | Jan. 28, 1998 | 719 | RTA00000183AF.b.12.1 | M00001500A:B02 | 0 |
| 3543 | Jan. 28, 1998 | 271 | RTA00000201F.d.02.1 | M00004375A:H01 | 2599 |
| 3543 | Jan. 28, 1998 | 239 | RTA00000201R.d.02.1 | M00004375A:H01 | 2599 |
| 3543 | Jan. 28, 1998 | 227 | RTA00000201R.d.02.2 | M00004375A:H01 | 2599 |
| 3544 | Jan. 28, 1998 | 630 | RTA00000183AR.g.03.2 | M00001512D:G09 | 3956 |
| 3544 | Jan. 28, 1998 | 632 | RTA00000183AR.g.03.1 | M00001512D:G09 | 3956 |
| 3545 | Mar. 24, 1998 | 15 | RTA00000425F.j.14.1 | M00001639D:C12 | 73397 |
| 3546 | Mar. 24, 1998 | 111 | RTA00000425F.d.08.1 | M00001631A:F06 | 74350 |
| 3547 | Mar. 24, 1998 | 152 | RTA00000425F.d.07.1 | M00001631A:F12 | 43197 |
| 3548 | Mar. 24, 1998 | 147 | RTA00000425F.d.21.1 | M00001631B:H04 | 78920 |
| 3549 | Mar. 24, 1998 | 77 | RTA00000425F.i.17.1 | M00001633A:F11 | 43213 |
| 3550 | Mar. 24, 1998 | 418 | RTA00000425F.i.18.1 | M00001633A:G10 | 42255 |
| 3551 | Mar. 24, 1998 | 197 | RTA00000425F.j.20.1 | M00001633B:A12 | 26760 |
| 3552 | Mar. 24, 1998 | 143 | RTA00000425F.j.22.1 | M00001633B:E03 | 73882 |
| 3553 | Mar. 24, 1998 | 283 | RTA00000425F.k.20.1 | M00001633C:A08 | 74048 |
| 3554 | Mar. 24, 1998 | 139 | RTA00000425F.k.22.1 | M00001633C:E12 | 78123 |
| 3555 | Feb. 24, 1998 | 870 | RTA00000418F.n.24.1 | M00001659D:C09 | 73153 |
| 3556 | Mar. 24, 1998 | 403 | RTA00000425F.n.17.1 | M00001636A:H12 | 78304 |
| 3557 | Feb. 24, 1998 | 1109 | RTA00000422F.f.22.1 | M00001584A:G03 | 38703 |
| 3558 | Mar. 24, 1998 | 150 | RTA00000424F.d.04.1 | M00001478A:F12 | 76505 |
| 3558 | Mar. 24, 1998 | 149 | RTA00000424F.d.04.3 | M00001478A:F12 | 76505 |
| 3559 | Mar. 24, 1998 | 358 | RTA00000425F.n.19.1 | M00001638B:C08 | 78324 |
| 3560 | Mar. 24, 1998 | 165 | RTA00000425F.e.21.1 | M00001629D:D10 | 77203 |
| 3561 | Mar. 24, 1998 | 443 | RTA00000425F.k.16.1 | M00001640A:F05 | 75282 |
| 3562 | Mar. 24, 1998 | 252 | RTA00000425F.m.03.1 | M00001642D:G08 | 76045 |
| 3563 | Mar. 24, 1998 | 116 | RTA00000425F.n.05.1 | M00001647D:G07 | 73965 |
| 3564 | Mar. 24, 1998 | 425 | RTA00000522F.i.07.2 | M00001649A:E10 | 78377 |
| 3565 | Mar. 24, 1998 | 445 | RTA00000522F.j.08.2 | M00001650D:D10 | 76613 |
| 3566 | Mar. 24, 1998 | 371 | RTA00000522F.j.09.2 | M00001650D:F11 | 78522 |
| 3567 | Mar. 24, 1998 | 97 | RTA00000522F.j.14.2 | M00001651C:D11 | 73123 |
| 3568 | Mar. 24, 1998 | 69 | RTA00000522F.j.15.1 | M00001651C:G12 | 76535 |
| 3569 | Mar. 24, 1998 | 373 | RTA00000522F.j.19.2 | M00001652B:D06 | 76224 |
| 3570 | Mar. 24, 1998 | 93 | RTA00000522F.k.14.1 | M00001652D:G02 | 74280 |
| 3571 | Mar. 24, 1998 | 50 | RTA00000522F.k.15.1 | M00001652D:G06 | 76866 |
| 3572 | Mar. 24, 1998 | 141 | RTA00000522F.k.19.1 | M00001653A:A05 | 32625 |
| 3573 | Mar. 24, 1998 | 409 | RTA00000425F.l.10.1 | M00001638A:C08 | 26893 |
| 3574 | Feb. 24, 1998 | 443 | RTA00000414F.f.15.1 | M00005260A:A12 | 0 |
| 3575 | Feb. 24, 1998 | 886 | RTA00000420F.m.15.1 | M00005235B:F10 | 0 |
| 3576 | Feb. 24, 1998 | 260 | RTA00000414F.e.08.1 | M00005236A:E04 | 0 |
| 3577 | Feb. 24, 1998 | 734 | RTA00000414F.e.09.1 | M00005236A:G10 | 0 |
| 3578 | Feb. 24, 1998 | 1077 | RTA00000414F.e.11.1 | M00005236B:A12 | 0 |
| 3579 | Feb. 24, 1998 | 970 | RTA00000414F.e.15.1 | M00005236B:G03 | 0 |
| 3580 | Feb. 24, 1998 | 271 | RTA00000414F.e.16.1 | M00005236B:H10 | 0 |
| 3581 | Feb. 24, 1998 | 58 | RTA00000420F.m.18.1 | M00005254D:A10 | 0 |
| 3582 | Feb. 24, 1998 | 289 | RTA00000420F.n.08.1 | Mb0005257A:H11 | 0 |
| 3583 | Feb. 24, 1998 | 1033 | RTA00000414F.e.19.1 | M00005257C:E05 | 0 |
| 3584 | Feb. 24, 1998 | 793 | RTA00000414F.e.21.1 | M00005257C:G01 | 0 |
| 3585 | Feb. 24, 1998 | 36 | RTA00000414F.e.22.1 | M00005257D:A06 | 0 |
| 3586 | Feb. 24, 1998 | 852 | RTA00000414F.f.03.1 | M00005257D:G07 | 0 |
| 3587 | Mar. 24, 1998 | 341 | RTA00000425F.d.06.1 | M00001631A:D03 | 77660 |
| 3588 | Feb. 24, 1998 | 961 | RTA00000420F.n.21.2 | M00005259B:D12 | 0 |
| 3589 | Mar. 24, 1998 | 441 | RTA00000528F.g.22.2 | M00001630C:F09 | 920 |
| 3590 | Feb. 24, 1998 | 940 | RTA00000414F.f.17.1 | M00005260A:F04 | 0 |
| 3591 | Feb. 24, 1998 | 160 | RTA00000414F.f.19.1 | M00005260B:E11 | 0 |
| 3592 | Mar. 24, 1998 | 140 | RTA00000424F.m.14.1 | M00001612D:D12 | 77491 |
| 3593 | Mar. 24, 1998 | 34 | RTA00000424F.m.15.1 | M00001612D:F06 | 73759 |
| 3594 | Mar. 24, 1998 | 212 | RTA00000424F.n.06.1 | M00001613A:D02 | 74737 |
| 3595 | Mar. 24, 1998 | 308 | RTA00000424F.k.23.1 | M00001614A:B10 | 31061 |
| 3596 | Mar. 24, 1998 | 372 | RTA00000424F.m.24.1 | M00001614C:G07 | 77045 |
| 3597 | Mar. 24, 1998 | 396 | RTA00000528F.g.05.2 | M00001615C:E07 | 3770 |
| 3598 | Mar. 24, 1998 | 296 | RTA00000425F.e.02.1 | M00001625C:F10 | 76141 |
| 3599 | Mar. 24, 1998 | 99 | RTA00000425F.c.20.1 | M00001626D:A02 | 73581 |
| 3600 | Mar. 24, 1998 | 442 | RTA00000425F.d.14.1 | M00001629A:H09 | 13417 |
| 3601 | Mar. 24, 1998 | 357 | RTA00000425F.e.19.1 | M00001629D:B10 | 73409 |
| 3602 | Feb. 24, 1998 | 210 | RTA00000419F.p.24.1 | M00004039B:E12 | 63477 |
| 3603 | Feb. 24, 1998 | 501 | RTA00000414F.f.05.1 | M00005257D:H11 | 0 |
| 3604 | Feb. 24, 1998 | 561 | RTA00000420F.e.10.1 | M00004108D:G04 | 65899 |
| 3605 | Feb. 24, 1998 | 758 | RTA00000407F.a.01.1 | M00004039A:H11 | 12501 |
| 3606 | Feb. 24, 1998 | 688 | RTA00000413F.d.23.1 | M00004090B:H06 | 66030 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3607 | Feb. 24, 1998 | 124 | RTA00000420F.d.05.1 | M00004092B:E05 | 64432 |
| 3608 | Feb. 24, 1998 | 329 | RTA00000413F.e.16.1 | M00004093C:C02 | 63836 |
| 3609 | Feb. 24, 1998 | 359 | RTA00000420F.d.12.1 | M00004096D:H03 | 64095 |
| 3610 | Feb. 24, 1998 | 429 | RTA00000422F.c.17.1 | M00004099D:F01 | 1360 |
| 3611 | Feb. 24, 1998 | 630 | RTA00000413F.f.19.1 | M00004100B:C07 | 65189 |
| 3612 | Feb. 24, 1998 | 439 | RTA00000413F.g.23.1 | M00004103B:E09 | 40700 |
| 3613 | Feb. 24, 1998 | 3 | RTA00000420F.d.18.1 | M00004105C:B05 | 63074 |
| 3614 | Feb. 24, 1998 | 1064 | RTA00000420F.d.19.1 | M00004105C:C08 | 43146 |
| 3615 | Feb. 24, 1998 | 671 | RTA00000413F.h.12.1 | M00004107A:A12 | 66929 |
| 3616 | Feb. 24, 1998 | 507 | RTA00000420F.e.02.1 | M00004107B:D07 | 40259 |
| 3617 | Feb. 24, 1998 | 319 | RTA00000420F.b.21.1 | M00004088D:B10 | 65057 |
| 3618 | Feb. 24, 1998 | 931 | RTA00000420F.e.09.1 | M00004108D:E07 | 66325 |
| 3619 | Feb. 24, 1998 | 840 | RTA00000420F.b.20.1 | M00004088D:B05 | 0 |
| 3620 | Feb. 24, 1998 | 545 | RTA00000420F.e.15.1 | M00004110A:A10 | 20190 |
| 3621 | Feb. 24, 1998 | 981 | RTA00000420F.e.20.1 | M00004110B:A07 | 64762 |
| 3622 | Mar. 24, 1998 | 370 | RTA00000424F.d.19.3 | M00001448B:A07 | 73180 |
| 3623 | Mar. 24, 1998 | 370 | RTA00000424F.d.19.3 | M00001448B:A07 | 73180 |
| 3624 | Mar. 24, 1998 | 189 | RTA00000424F.d.22.3 | M00001448B:G07 | 76189 |
| 3625 | Mar. 24, 1998 | 189 | RTA00000424F.d.22.3 | M00001448B:G07 | 76189 |
| 3626 | Mar. 24, 1998 | 92 | RTA00000424F.a.24.4 | M00001448D:E11 | 73951 |
| 3627 | Mar. 24, 1998 | 92 | RTA00000424F.a.24.4 | M00001448D:E11 | 73951 |
| 3628 | Mar. 24, 1998 | 279 | RTA00000528F.b.03.1 | M00001455A:D10 | 2078 |
| 3629 | Mar. 24, 1998 | 279 | RTA00000528F.b.03.1 | M00001455A:D10 | 2078 |
| 3630 | Mar. 24, 1998 | 480 | RTA00000424F.d.17.3 | M00001455A:E11 | 73958 |
| 3631 | Mar. 24, 1998 | 480 | RTA00000424F.d.17.3 | M00001455A:E11 | 73958 |
| 3632 | Feb. 24, 1998 | 583 | RTA00000406F.i.17.1 | M00003904B:C03 | 37902 |
| 3633 | Feb. 24, 1998 | 590 | RTA00000407F.b.22.1 | M00004105B:B02 | 37487 |
| 3634 | Feb. 24, 1998 | 1075 | RTA00000413F.b.17.1 | M00004078A:F07 | 21704 |
| 3635 | Feb. 24, 1998 | 544 | RTA00000420F.l.21.2 | M00005232A:H12 | 0 |
| 3636 | Jan. 28, 1998 | 684 | RTA00000200AR.b.11.1 | M00004040A:G12 | 12043 |
| 3636 | Feb. 24, 1998 | 1166 | RTA00000347F.h.01.1 | M00004040A:G12 | 12043 |
| 3637 | Jan. 28, 1998 | 684 | RTA00000200AR.b.11.1 | M00004040A:G12 | 12043 |
| 3637 | Feb. 24, 1998 | 1166 | RTA00000347F.h.01.1 | M00004040A:G12 | 12043 |
| 3638 | Feb. 24, 1998 | 1087 | RTA00000401F.o.13.1 | M00004040C:A01 | 3220 |
| 3639 | Feb. 24, 1998 | 114 | RTA00000341F.m.21.1 | M00004051D:E01 | 0 |
| 3640 | Feb. 24, 1998 | 811 | RTA00000413F.a.12.1 | M00004072D:F09 | 63403 |
| 3641 | Feb. 24, 1998 | 714 | RTA00000420F.a.08.1 | M00004073A:D10 | 19473 |
| 3642 | Jan. 28, 1998 | 387 | RTA00000191AF.j.14.1 | M00004073A:H12 | 1002 |
| 3642 | Feb. 24, 1998 | 632 | RTA00000191AF.j.14.1 | M00004073A:H12 | 1002 |
| 3643 | Jan. 28, 1998 | 387 | RTA00000191AF.j.14.1 | M00004073A:H12 | 1002 |
| 3643 | Feb. 24, 1998 | 632 | RTA00000191AF.j.14.1 | M00004073A:H12 | 1002 |
| 3644 | Feb. 24, 1998 | 964 | RTA00000423F.l.15.1 | M00004075B:G09 | 11219 |
| 3645 | Feb. 24, 1998 | 355 | RTA00000420F.a.19.1 | M00004076A:D12 | 34192 |
| 3646 | Feb. 24, 1998 | 745 | RTA00000413F.b.04.1 | M00004076D:H07 | 66427 |
| 3647 | Feb. 24, 1998 | 64 | RTA00000413F.d.18.1 | M00004090B:B04 | 65305 |
| 3648 | Feb. 24, 1998 | 698 | RTA00000413F.b.16.1 | M00004078A:E05 | 65126 |
| 3649 | Feb. 24, 1998 | 190 | RTA00000419F.p.23.1 | M00004039B:A05 | 64748 |
| 3650 | Feb. 24, 1998 | 903 | RTA00000420F.a.21.1 | M00004078B:C11 | 66241 |
| 3651 | Feb. 24, 1998 | 588 | RTA00000420F.a.23.1 | M00004078B:F12 | 42158 |
| 3652 | Feb. 24, 1998 | 1185 | RTA00000413F.b.20.1 | M00004079D:G08 | 66063 |
| 3653 | Feb. 24, 1998 | 619 | RTA00000420F.b.04.1 | M00004081A:E02 | 63820 |
| 3654 | Feb. 24, 1998 | 988 | RTA00000407F.a.22.1 | M00004081A:G01 | 15570 |
| 3655 | Feb. 24, 1998 | 705 | RTA00000407F.a.23.1 | M00004081C:A10 | 23489 |
| 3656 | Feb. 24, 1998 | 282 | RTA00000407F.a.24.1 | M00004083A:E08 | 37560 |
| 3657 | Feb. 24, 1998 | 835 | RTA00000413F.c.10.1 | M00004083B:C01 | 65600 |
| 3658 | Feb. 24, 1998 | 598 | RTA00000420F.b.18.1 | M00004086D:G08 | 66136 |
| 3659 | Feb. 24, 1998 | 335 | RTA00000413F.d.02.1 | M00004087B:A12 | 66172 |
| 3660 | Feb. 24, 1998 | 504 | RTA00000413F.d.05.1 | M00004087C:A01 | 64788 |
| 3661 | Feb. 24, 1998 | 76 | RTA00000413F.d.16.1 | M00004088C:F01 | 63331 |
| 3662 | Feb. 24, 1998 | 726 | RTA00000420F.b.19.1 | M00004088D:A11 | 36873 |
| 3663 | Feb. 24, 1998 | 521 | RTA00000413F.b.14.1 | M00004078A:C11 | 66591 |
| 3664 | Feb. 24, 1998 | 255 | RTA00000419F.o.16.1 | M00003989C:G05 | 62867 |
| 3665 | Feb. 24, 1998 | 665 | RTA00000419F.p.20.1 | M00004039A:C03 | 9458 |
| 3666 | Feb. 24, 1998 | 1234 | RTA00000352R.c.20.1 | M00003982A:B12 | 7339 |
| 3667 | Feb. 24, 1998 | 247 | RTA00000412F.j.17.1 | M00003982C:G04 | 64071 |
| 3668 | Feb. 24, 1998 | 1145 | RTA00000423F.k.21.2 | M00003984D:B08 | 37499 |
| 3669 | Feb. 24, 1998 | 993 | RTA00000406F.o.05.1 | M00003985B:G04 | 37894 |
| 3670 | Feb. 24, 1998 | 328 | RTA00000423F.k.19.2 | M00003985D:E10 | 17615 |
| 3671 | Feb. 24, 1998 | 254 | RTA00000341F.l.15.1 | M00003986B:A08 | 5294 |
| 3672 | Feb. 24, 1998 | 948 | RTA00000419F.o.06.1 | M00003986C:D09 | 64643 |
| 3673 | Feb. 24, 1998 | 661 | RTA00000341F.l.16.1 | M00003986D:C08 | 8479 |
| 3674 | Feb. 24, 1998 | 117 | RTA00000341F.m.13.1 | M00003987B:E12 | 26502 |
| 3675 | Feb. 24, 1998 | 1210 | RTA00000419F.o.09.1 | M00003987B:F08 | 66396 |
| 3676 | Feb. 24, 1998 | 460 | RTA00000341F.j.12.1 | M00003987C:G03 | 12195 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3677 | Feb. 24, 1998 | 486 | RTA00000346F.l.13.1 | M00003980B:C11 | 7542 |
| 3678 | Feb. 24, 1998 | 723 | RTA00000419F.o.15.1 | M00003989C:D03 | 32487 |
| 3679 | Feb. 24, 1998 | 897 | RTA00000419F.n.24.1 | M00003980A:F04 | 65995 |
| 3680 | Feb. 24, 1998 | 92 | RTA00000412F.l.04.1 | M00003989D:F12 | 66372 |
| 3681 | Feb. 24, 1998 | 1014 | RTA00000412F.l.14.1 | M00004029B:F01 | 62792 |
| 3682 | Feb. 24, 1998 | 348 | RTA00000412F.l.19.1 | M00004029C:C05 | 65825 |
| 3683 | Feb. 24, 1998 | 284 | RTA00000412F.l.21.1 | M00004029C:G10 | 65183 |
| 3684 | Feb. 24, 1998 | 188 | RTA00000406F.p.04.1 | M00004030D:F11 | 37458 |
| 3685 | Feb. 24, 1998 | 812 | RTA00000412F.o.05.1 | M00004034A:A01 | 63575 |
| 3686 | Feb. 24, 1998 | 911 | RTA00000406F.p.13.1 | M00004034C:G02 | 8584 |
| 3687 | Feb. 24, 1998 | 230 | RTA00000423F.k.01.1 | M00004034D:E09 | 40426 |
| 3688 | Feb. 24, 1998 | 1076 | RTA00000423F.k.09.1 | M00004035B:H09 | 26630 |
| 3689 | Feb. 24, 1998 | 941 | RTA00000419F.p.08.1 | M00004036D:B04 | 65560 |
| 3690 | Feb. 24, 1998 | 1186 | RTA00000419F.p.10.1 | M00004036D:B09 | 41448 |
| 3691 | Feb. 24, 1998 | 42 | RTA00000423F.k.17.2 | M00004038A:F02 | 37512 |
| 3692 | Feb. 24, 1998 | 934 | RTA00000414F.e.01.1 | M00005233D:H07 | 0 |
| 3693 | Feb. 24, 1998 | 37 | RTA00000406F.o.15.1 | M00003988D:A08 | 37482 |
| 3694 | Feb. 24, 1998 | 1016 | RTA00000406F.n.12.1 | M00003960A:G07 | 37517 |
| 3695 | Jan. 28, 1998 | 584 | RTA00000190AR.c.03.1 | M00003904C:A08 | 0 |
| 3695 | Feb. 24, 1998 | 1069 | RTA00000346F.k.05.1 | M00003904C:A08 | 0 |
| 3696 | Jan. 28, 1998 | 584 | RTA00000190AR.c.03.1 | M00003904C:A08 | 0 |
| 3696 | Feb. 24, 1998 | 1069 | RTA00000346F.k.05.1 | M00003904C:A08 | 0 |
| 3697 | Feb. 24, 1998 | 489 | RTA00000406F.j.19.1 | M00003906A:F12 | 1685 |
| 3698 | Feb. 24, 1998 | 461 | RTA00000412F.d.16.1 | M00003906B:H06 | 26829 |
| 3699 | Feb. 24, 1998 | 558 | RTA00000419F.m.04.1 | M00003906C:C05 | 74367 |
| 3700 | Feb. 24, 1998 | 120 | RTA00000401F.m.02.1 | M00003907A:F01 | 1573 |
| 3701 | Feb. 24, 1998 | 628 | RTA00000412F.d.19.1 | M00003907B:C03 | 75743 |
| 3702 | Feb. 24, 1998 | 792 | RTA00000406F.k.11.1 | M00003907B:D05 | 38715 |
| 3703 | Feb. 24, 1998 | 292 | RTA00000423F.i.18.1 | M00003918A:D08 | 14996 |
| 3704 | Feb. 24, 1998 | 1192 | RTA00000406F.m.17.1 | M00003918A:F09 | 0 |
| 3705 | Feb. 24, 1998 | 9 | RTA00000406F.n.02.1 | M00003918C:H10 | 15051 |
| 3706 | Feb. 24, 1998 | 629 | RTA00000352R.c.04.1 | M00003924A:D08 | 71976 |
| 3707 | Feb. 24, 1998 | 438 | RTA00000195R.d.09.1 | M00003981C:B04 | 8537 |
| 3708 | Feb. 24, 1998 | 433 | RTA00000419F.n.02.1 | M00003958B:H08 | 65963 |
| 3709 | Feb. 24, 1998 | 147 | RTA00000422F.c.02.1 | M00004118B:A03 | 2902 |
| 3710 | Feb. 24, 1998 | 649 | RTA00000412F.g.03.1 | M00003971B:A10 | 64740 |
| 3711 | Feb. 24, 1998 | 1141 | RTA00000347F.f.08.1 | M00003972D:H02 | 5948 |
| 3712 | Feb. 24, 1998 | 252 | RTA00000412F.g.24.1 | M00003973C:C03 | 28741 |
| 3713 | Feb. 24, 1998 | 732 | RTA00000412F.h.11.1 | M00003974B:B11 | 63175 |
| 3714 | Feb. 24, 1998 | 181 | RTA00000412F.h.21.1 | M00003974D:F02 | 64348 |
| 3715 | Feb. 24, 1998 | 345 | RTA00000412F.h.23.2 | M00003974D:H04 | 65118 |
| 3716 | Feb. 24, 1998 | 148 | RTA00000419F.n.04.1 | M00003975C:F07 | 13102 |
| 3717 | Feb. 24, 1998 | 311 | RTA00000419F.n.09.1 | M00003977C:A06 | 66070 |
| 3718 | Feb. 24, 1998 | 1044 | RTA00000419F.n.11.1 | M00003977C:B03 | 66477 |
| 3719 | Feb. 24, 1998 | 652 | RTA00000419F.n.12.1 | M00003977D:A03 | 66086 |
| 3720 | Feb. 24, 1998 | 452 | RTA00000419F.n.13.1 | M00003977D:A06 | 66026 |
| 3721 | Feb. 24, 1998 | 796 | RTA00000419F.n.15.1 | M00003977D:D04 | 63484 |
| 3722 | Feb. 24, 1998 | 1249 | RTA00000419F.n.17.1 | M00003978D:G04 | 63186 |
| 3723 | Feb. 24, 1998 | 860 | RTA00000419F.m.23.1 | M00003958B:E11 | 64263 |
| 3724 | Feb. 24, 1998 | 713 | RTA00000414F.b.10.1 | M00005212D:D09 | 0 |
| 3725 | Feb. 24, 1998 | 1002 | RTA00000419F.p.18.1 | M00004038D:G06 | 63002 |
| 3726 | Feb. 24, 1998 | 1048 | RTA00000413F.o.07.2 | M00005100A:C01 | 0 |
| 3727 | Feb. 24, 1998 | 508 | RTA00000420F.i.20.1 | M00005101C:E12 | 0 |
| 3728 | Feb. 24, 1998 | 1001 | RTA00000413F.p.07.2 | M00005102C:D03 | 0 |
| 3729 | Feb. 24, 1998 | 88 | RTA00000420F.i.24.1 | M00005134B:E08 | 0 |
| 3730 | Feb. 24, 1998 | 93 | RTA00000413F.p.24.1 | M00005139A:H03 | 0 |
| 3731 | Feb. 24, 1998 | 142 | RTA00000420F.j.19.1 | M00005140C:B10 | 0 |
| 3732 | Feb. 24, 1998 | 833 | RTA00000420F.j.20.1 | M00005140D:C06 | 0 |
| 3733 | Feb. 24, 1998 | 316 | RTA00000414F.a.02.1 | M00005178D:H04 | 0 |
| 3734 | Feb. 24, 1998 | 1100 | RTA00000414F.a.12.1 | M00005210A:E06 | 0 |
| 3735 | Feb. 24, 1998 | 1175 | RTA00000414F.b.04.1 | M00005212B:E01 | 0 |
| 3736 | Feb. 24, 1998 | 1236 | RTA00000414F.b.06.1 | M00005212C:C03 | 0 |
| 3737 | Feb. 24, 1998 | 747 | RTA00000413F.n.24.1 | M00004960C:E10 | 0 |
| 3738 | Feb. 24, 1998 | 207 | RTA00000414F.b.08.1 | M00005212C:H02 | 0 |
| 3739 | Feb. 24, 1998 | 935 | RTA00000420F.i.07.1 | M00004960A:B08 | 0 |
| 3740 | Feb. 24, 1998 | 741 | RTA00000414F.b.12.1 | M00005212D:H01 | 0 |
| 3741 | Feb. 24, 1998 | 865 | RTA00000414F.c.03.1 | M00005216A:D09 | 0 |
| 3742 | Feb. 24, 1998 | 862 | RTA00000414F.c.07.1 | M00005216A:H01 | 0 |
| 3743 | Feb. 24, 1998 | 565 | RTA00000420F.k.17.2 | M00005217B:A06 | 0 |
| 3744 | Feb. 24, 1998 | 1226 | RTA00000414F.c.12.1 | M00005218A:F09 | 0 |
| 3745 | Feb. 24, 1998 | 512 | RTA00000414F.c.16.1 | M00005228A:B03 | 0 |
| 3746 | Feb. 24, 1998 | 817 | RTA00000420F.l.08.2 | M00005228C:C05 | 0 |
| 3747 | Feb. 24, 1998 | 573 | RTA00000414F.c.23.1 | M00005229B:G12 | 0 |
| 3748 | Feb. 24, 1998 | 1237 | RTA00000414F.c.24.1 | M00005229B:H04 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3749 | Feb. 24, 1998 | 727 | RTA00000414F.d.02.1 | M00005229B:H06 | 0 |
| 3750 | Feb. 24, 1998 | 566 | RTA00000414F.d.05.1 | M00005229D:H03 | 0 |
| 3751 | Feb. 24, 1998 | 307 | RTA00000420F.l.12.2 | M00005230B:H09 | 0 |
| 3752 | Mar. 24, 1998 | 149 | RTA00000424F.d.04.3 | M00001478A:F12 | 76505 |
| 3752 | Mar. 24, 1998 | 150 | RTA00000424F.d.04.1 | M00001478A:F12 | 76505 |
| 3753 | Feb. 24, 1998 | 946 | RTA00000414F.b.07.1 | M00005212C:D02 | 0 |
| 3754 | Jan. 28, 1998 | 343 | RTA00000201F.a.18.1 | M00004314B:G07 | 16837 |
| 3754 | Feb. 24, 1998 | 571 | RTA00000355R.e.14.1 | M00004314B:G07 | 16837 |
| 3755 | Feb. 24, 1998 | 481 | RTA00000413F.i.23.1 | M00004118B:F01 | 63073 |
| 3756 | Feb. 24, 1998 | 1039 | RTA00000407F.c.08.1 | M00004118D:B05 | 37549 |
| 3757 | Feb. 24, 1998 | 824 | RTA00000420F.f.07.1 | M00004119A:C09 | 66312 |
| 3758 | Feb. 24, 1998 | 813 | RTA00000346F.o.06.1 | M00004136D:B02 | 4937 |
| 3759 | Feb. 24, 1998 | 1070 | RTA00000346F.n.22.1 | M00004137A:D06 | 0 |
| 3760 | Feb. 24, 1998 | 283 | RTA00000346F.n.06.1 | M00004139C:A12 | 12439 |
| 3761 | Feb. 24, 1998 | 368 | RTA00000346F.o.08.1 | M00004149C:B02 | 0 |
| 3762 | Feb. 24, 1998 | 704 | RTA00000355R.a.12.1 | M00004159C:F09 | 36756 |
| 3762 | Jan. 28, 1998 | 685 | RTA00000200F.i.9.1 | M00004159C:F09 | 36756 |
| 3763 | Jan. 28, 1998 | 685 | RTA00000200F.i.9.1 | M00004159C:F09 | 36756 |
| 3763 | Feb. 24, 1998 | 704 | RTA00000355R.a.12.1 | M00004159C:F09 | 36756 |
| 3764 | Feb. 24, 1998 | 1254 | RTA00000341F.p.11.1 | M00004159C:G12 | 0 |
| 3765 | Feb. 24, 1998 | 1188 | RTA00000341F.o.18.1 | M00004169D:B11 | 37189 |
| 3766 | Feb. 24, 1998 | 40 | RTA00000352R.l.06.1 | M00004187D:H06 | 40343 |
| 3767 | Feb. 24, 1998 | 456 | RTA00000413F.o.06.1 | M00005100A:B02 | 0 |
| 3768 | Feb. 24, 1998 | 882 | RTA00000355R.c.03.1 | M00004244C:G07 | 3986 |
| 3769 | Feb. 24, 1998 | 503 | RTA00000420F.m.08.1 | M00005233B:D04 | 0 |
| 3770 | Feb. 24, 1998 | 571 | RTA00000355R.e.14.1 | M00004314B:G07 | 16837 |
| 3770 | Jan. 28, 1998 | 343 | RTA00000201F.a.18.1 | M00004314B:G07 | 16837 |
| 3771 | Feb. 24, 1998 | 91 | RTA00000355R.e.15.1 | M00004316A:G09 | 22639 |
| 3771 | Jan. 28, 1998 | 410 | RTA00000201F.a.20.1 | M00004316A:G09 | 22639 |
| 3772 | Feb. 24, 1998 | 91 | RTA00000355R.e.15.1 | M00004316A:G09 | 22639 |
| 3772 | Jan. 28, 1998 | 410 | RTA00000201F.a.20.1 | M00004316A:G09 | 22639 |
| 3773 | Feb. 24, 1998 | 1135 | RTA00000346F.o.16.1 | M00004358D:C02 | 176 |
| 3774 | Feb. 24, 1998 | 220 | RTA00000413F.k.02.1 | M00004690A:G08 | 0 |
| 3775 | Feb. 24, 1998 | 487 | RTA00000420F.g.05.1 | M00004891B:D01 | 0 |
| 3776 | Feb. 24, 1998 | 102 | RTA00000420F.g.06.1 | M00004891C:D04 | 0 |
| 3777 | Feb. 24, 1998 | 1238 | RTA00000420F.g.09.1 | M00004895B:E12 | 0 |
| 3778 | Feb. 24, 1998 | 18 | RTA00000420F.g.12.1 | M00004895B:G04 | 0 |
| 3779 | Feb. 24, 1998 | 1196 | RTA00000413F.l.18.1 | M00004895D:G07 | 0 |
| 3780 | Feb. 24, 1998 | 579 | RTA00000413F.m.16.1 | M00004898C:F03 | 0 |
| 3781 | Feb. 24, 1998 | 143 | RTA00000420F.h.13.1 | M00004899D:G06 | 0 |
| 3782 | Feb. 24, 1998 | 909 | RTA00000420F.i.04.1 | M00004959D:H12 | 0 |
| 3783 | Feb. 24, 1998 | 709 | RTA00000352R.p.09.1 | M00004228C:H03 | 16915 |
| 3784 | Mar. 24, 1998 | 221 | RTA00000427F.j.22.1 | M00004097D:B05 | 66367 |
| 3785 | Mar. 24, 1998 | 188 | RTA00000525F.c.15.1 | M00004040A:A07 | 7692 |
| 3786 | Mar. 24, 1998 | 401 | RTA00000525F.c.16.1 | M00004040A:B04 | 38209 |
| 3787 | Mar. 24, 1998 | 53 | RTA00000525F.c.17.1 | M00004040A:C08 | 38160 |
| 3788 | Mar. 24, 1998 | 325 | RTA00000525F.c.18.1 | M00004040B:C05 | 24208 |
| 3789 | Mar. 24, 1998 | 159 | RTA00000525F.c.19.1 | M00004040B:F07 | 38159 |
| 3790 | Mar. 24, 1998 | 209 | RTA00000427F.g.16.1 | M00004069A:E12 | 63011 |
| 3791 | Mar. 24, 1998 | 123 | RTA00000427F.g.05.1 | M00004069C:C08 | 63138 |
| 3792 | Mar. 24, 1998 | 62 | RTA00000427F.j.19.1 | M00004077A:G12 | 41395 |
| 3793 | Mar. 24, 1998 | 265 | RTA00000427F.h.02.1 | M00004085B:G01 | 63652 |
| 3794 | Mar. 24, 1998 | 235 | RTA00000427F.g.19.1 | M00004087A:B05 | 64611 |
| 3795 | Mar. 24, 1998 | 333 | RTA00000427F.k.21.1 | M00004090D:F12 | 62880 |
| 3796 | Mar. 24, 1998 | 130 | RTA00000427F.h.12.1 | M00004092C:D08 | 36894 |
| 3797 | Mar. 24, 1998 | 243 | RTA00000424F.c.15.3 | M00001476D:F12 | 73533 |
| 3798 | Mar. 24, 1998 | 227 | RTA00000427F.i.11.1 | M00004097C:H08 | 26635 |
| 3799 | Mar. 24, 1998 | 456 | RTA00000427F.a.10.1 | M00004038B:D01 | 65370 |
| 3800 | Mar. 24, 1998 | 7 | RTA00000523F.o.20.1 | M00005177B:H02 | 0 |
| 3801 | Mar. 24, 1998 | 291 | RTA00000523F.o.23.1 | M00005177C:G04 | 0 |
| 3802 | Mar. 24, 1998 | 119 | RTA00000523F.p.06.1 | M00005177D:F09 | 0 |
| 3803 | Mar. 24, 1998 | 178 | RTA00000428F.a.12.1 | M00005179B:H02 | 0 |
| 3804 | Mar. 24, 1998 | 463 | RTA00000523F.p.16.1 | M00005179D:B03 | 0 |
| 3805 | Mar. 24, 1998 | 390 | RTA00000524F.a.11.1 | M00005210D:C09 | 0 |
| 3806 | Mar. 24, 1998 | 468 | RTA00000524F.a.18.1 | M00005211A:E09 | 0 |
| 3807 | Mar. 24, 1998 | 114 | RTA00000524F.a.23.1 | M00005211C:E09 | 0 |
| 3808 | Mar. 24, 1998 | 29 | RTA00000524F.b.03.1 | M00005212A:D10 | 0 |
| 3809 | Mar. 24, 1998 | 36 | RTA00000428F.a.16.1 | M00005212D:F08 | 0 |
| 3810 | Mar. 24, 1998 | 417 | RTA00000524F.b.10.1 | M00005213C:A01 | 0 |
| 3811 | Mar. 24, 1998 | 182 | RTA00000524F.b.17.1 | M00005214B:A06 | 0 |
| 3812 | Mar. 24, 1998 | 348 | RTA00000427F.i.09.1 | M00004097C:E03 | 65916 |
| 3813 | Mar. 24, 1998 | 384 | RTA00000527F.p.03.1 | M00004029B:A06 | 5940 |
| 3814 | Mar. 24, 1998 | 84 | RTA00000527F.k.18.1 | M00003982B:C10 | 11332 |
| 3815 | Mar. 24, 1998 | 48 | RTA00000527F.k.21.1 | M00003982B:H10 | 36051 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3816 | Mar. 24, 1998 | 271 | RTA00000527F.l.05.1 | M00003983A:D02 | 13016 |
| 3817 | Mar. 24, 1998 | 246 | RTA00000426F.m.21.1 | M00003983A:F06 | 64915 |
| 3818 | Mar. 24, 1998 | 16 | RTA00000426F.m.22.1 | M00003983A:G02 | 30002 |
| 3819 | Mar. 24, 1998 | 367 | RTA00000527F.l.19.1 | M00003983D:E08 | 36856 |
| 3820 | Mar. 24, 1998 | 477 | RTA00000527F.l.21.1 | M00003983D:H02 | 36439 |
| 3821 | Mar. 24, 1998 | 126 | RTA00000527F.m.05.1 | M00003985A:C01 | 17240 |
| 3822 | Mar. 24, 1998 | 89 | RTA00000527F.n.02.1 | M00003986C:G11 | 24190 |
| 3823 | Mar. 24, 1998 | 263 | RTA00000527F.n.07.1 | M00003986D:H12 | 15939 |
| 3824 | Mar. 24, 1998 | 49 | RTA00000527F.n.22.1 | M00004027A:A08 | 24175 |
| 3825 | Mar. 24, 1998 | 449 | RTA00000426F.m.04.1 | M00004028A:B10 | 36865 |
| 3826 | Mar. 24, 1998 | 336 | RTA00000426F.n.17.1 | M00004039D:B10 | 66572 |
| 3827 | Mar. 24, 1998 | 27 | RTA00000527F.p.02.1 | M00004029B:A01 | 36844 |
| 3828 | Mar. 24, 1998 | 297 | RTA00000525F.c.11.1 | M00004039C:E02 | 37895 |
| 3829 | Mar. 24, 1998 | 17 | RTA00000527F.p.06.1 | M00004029B:G10 | 1292 |
| 3830 | Mar. 24, 1998 | 310 | RTA00000527F.p.08.1 | M00004029C:F02 | 36013 |
| 3831 | Mar. 24, 1998 | 478 | RTA00000527F.p.09.1 | M00004029C:F05 | 7694 |
| 3832 | Mar. 24, 1998 | 253 | RTA00000426F.m.08.1 | M00004030B:A12 | 63781 |
| 3833 | Mar. 24, 1998 | 414 | RTA00000426F.m.12.1 | M00004030B:D08 | 63740 |
| 3834 | Mar. 24, 1998 | 345 | RTA00000426F.n.23.1 | M00004030C:A08 | 18176 |
| 3835 | Mar. 24, 1998 | 98 | RTA00000527F.p.16.1 | M00004030C:C02 | 23798 |
| 3836 | Mar. 24, 1998 | 115 | RTA00000525F.b.05.1 | M00004034C:F05 | 21116 |
| 3837 | Mar. 24, 1998 | 444 | RTA00000525F.b.09.1 | M00004035B:F05 | 23472 |
| 3838 | Mar. 24, 1998 | 158 | RTA00000427F.a.06.1 | M00004036A:A11 | 66550 |
| 3839 | Mar. 24, 1998 | 376 | RTA00000525F.b.21.1 | M00004037C:D04 | 9486 |
| 3840 | Mar. 24, 1998 | 293 | RTA00000525F.c.02.1 | M00004038A:E05 | 14618 |
| 3841 | Mar. 24, 1998 | 138 | RTA00000527F.c.22.1 | M00003822B:G12 | 37496 |
| 3842 | Mar. 24, 1998 | 30 | RTA00000426F.m.07.1 | M00004028A:G03 | 63504 |
| 3843 | Mar. 24, 1998 | 322 | RTA00000523F.i.17.1 | M00003856B:A12 | 65779 |
| 3844 | Mar. 24, 1998 | 311 | RTA00000428F.b.02.1 | M00005214D:D10 | 0 |
| 3845 | Mar. 24, 1998 | 233 | RTA00000426F.f.13.1 | M00003851A:A06 | 65384 |
| 3846 | Mar. 24, 1998 | 274 | RTA00000523F.h.06.1 | M00003851B:D03 | 28745 |
| 3847 | Mar. 24, 1998 | 407 | RTA00000523F.h.08.1 | M00003851B:E01 | 62893 |
| 3848 | Mar. 24, 1998 | 82 | RTA00000523F.h.15.1 | M00003851C:F09 | 65137 |
| 3849 | Mar. 24, 1998 | 316 | RTA00000523F.h.16.1 | M00003851D:H11 | 66031 |
| 3850 | Mar. 24, 1998 | 232 | RTA00000527F.i.13.2 | M00003852B:G04 | 2924 |
| 3851 | Mar. 24, 1998 | 451 | RTA00000527F.i.15.2 | M00003852C:F07 | 14235 |
| 3852 | Mar. 24, 1998 | 249 | RTA00000523F.h.21.1 | M00003853B:C10 | 41440 |
| 3853 | Mar. 24, 1998 | 72 | RTA00000426F.f.19.1 | M00003854C:C09 | 66701 |
| 3854 | Mar. 24, 1998 | 60 | RTA00000523F.i.06.1 | M00003855A:A01 | 66341 |
| 3855 | Mar. 24, 1998 | 91 | RTA00000527F.i.21.2 | M00003855A:F01 | 37490 |
| 3856 | Mar. 24, 1998 | 137 | RTA00000527F.h.17.1 | M00003848D:G02 | 37799 |
| 3857 | Mar. 24, 1998 | 433 | RTA00000527F.j.04.2 | M00003856A:G04 | 11809 |
| 3858 | Mar. 24, 1998 | 157 | RTA00000523F.g.10.1 | M00003848B:E07 | 40694 |
| 3859 | Mar. 24, 1998 | 75 | RTA00000523F.i.22.1 | M00003857A:E12 | 64688 |
| 3860 | Mar. 24, 1998 | 481 | RTA00000523F.j.02.1 | M00003857A:H10 | 62853 |
| 3861 | Mar. 24, 1998 | 377 | RTA00000527F.j.12.2 | M00003857C:E05 | 37503 |
| 3862 | Mar. 24, 1998 | 286 | RTA00000426F.g.19.1 | M00003858B:G02 | 63672 |
| 3863 | Mar. 24, 1998 | 71 | RTA00000527F.j.20.2 | M00003860D:E06 | 37603 |
| 3864 | Mar. 24, 1998 | 205 | RTA00000426F.h.12.1 | M00003905C:F12 | 78093 |
| 3865 | Mar. 24, 1998 | 40 | RTA00000426F.h.23.1 | M00003911A:D12 | 75964 |
| 3866 | Mar. 24, 1998 | 369 | RTA00000524F.c.08.1 | M00005217C:C01 | 0 |
| 3867 | Mar. 24, 1998 | 234 | RTA00000524F.c.16.1 | M00005218D:G10 | 0 |
| 3868 | Mar. 24, 1998 | 8 | RTA00000428F.b.06.1 | M00005228A:A09 | 0 |
| 3869 | Mar. 24, 1998 | 193 | RTA00000428F.b.12.1 | M00005231C:B07 | 0 |
| 3870 | Mar. 24, 1998 | 419 | RTA0000042BF.b.22.1 | M00005231D:B09 | 0 |
| 3871 | Feb. 24, 1998 | 486 | RTA00000346F.l.13.1 | M00003980B:C11 | 7542 |
| 3872 | Mar. 24, 1998 | 421 | RTA00000523F.i.10.1 | M00003855B:B09 | 64876 |
| 3873 | Mar. 24, 1998 | 10 | RTA00000527F.f.12.1 | M00003829D:D12 | 5945 |
| 3874 | Mar. 24, 1998 | 145 | RTA00000426F.m.24.1 | M00003981A:A07 | 63943 |
| 3875 | Mar. 24, 1998 | 39 | RTA00000527F.c.23.1 | M00003822C:A07 | 37742 |
| 3876 | Mar. 24, 1998 | 35 | RTA00000426F.f.11.1 | M00003823C:B01 | 63102 |
| 3877 | Mar. 24, 1998 | 385 | RTA00000426F.f.12.1 | M00003823C:C04 | 19096 |
| 3878 | Mar. 24, 1998 | 2 | RTA00000523F.d.19.1 | M00003824A:A06 | 26489 |
| 3879 | Mar. 24, 1998 | 225 | RTA00000527F.d.09.1 | M00003824A:G11 | 10848 |
| 3880 | Mar. 24, 1998 | 359 | RTA00000523F.d.21.1 | M00003824B:C09 | 33424 |
| 3881 | Mar. 24, 1998 | 330 | RTA00000523F.d.23.1 | M00003824C:A10 | 63633 |
| 3882 | Mar. 24, 1998 | 254 | RTA00000523F.d.24.1 | M00003824D:D08 | 64799 |
| 3883 | Mar. 24, 1998 | 74 | RTA00000527F.d.19.1 | M00003825B:F10 | 486 |
| 3884 | Mar. 24, 1998 | 67 | RTA00000527F.e.03.1 | M00003825D:F01 | 25560 |
| 3885 | Mar. 24, 1998 | 352 | RTA00000527F.e.13.1 | M00003826C:F05 | 37588 |
| 3886 | Mar. 24, 1998 | 185 | RTA00000527F.h.21.1 | M00003850C:G09 | 37630 |
| 3887 | Mar. 24, 1998 | 338 | RTA00000523F.e.15.1 | M00003829C:E08 | 7919 |
| 3888 | Mar. 24, 1998 | 284 | RTA00000524F.b.19.1 | M00005216B:D02 | 0 |
| 3889 | Mar. 24, 1998 | 242 | RTA00000523F.e.20.1 | M00003829D:F03 | 65164 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3890 | Mar. 24, 1998 | 301 | RTA00000527F.f.18.1 | M00003830D:B11 | 37577 |
| 3891 | Mar. 24, 1998 | 259 | RTA00000528F.m.04.1 | M00003830D:H11 | 10815 |
| 3892 | Mar. 24, 1998 | 160 | RTA00000523F.f.06.1 | M00003833D:H08 | 62871 |
| 3893 | Mar. 24, 1998 | 166 | RTA00000523F.f.07.1 | M00003833D:H10 | 62799 |
| 3894 | Mar. 24, 1998 | 196 | RTA00000523F.f.12.1 | M00003840A:C10 | 63751 |
| 3895 | Mar. 24, 1998 | 447 | RTA00000523F.f.19.1 | M00003840B:F05 | 34169 |
| 3896 | Mar. 24, 1998 | 113 | RTA00000527F.g.07.1 | M00003840C:C02 | 37488 |
| 3897 | Mar. 24, 1998 | 45 | RTA00000528F.m.12.1 | M00003842D:F08 | 5768 |
| 3898 | Mar. 24, 1998 | 415 | RTA00000527F.g.12.1 | M00003845C:D04 | 37746 |
| 3899 | Mar. 24, 1998 | 1 | RTA00000527F.g.13.1 | M00003845D:A04 | 36035 |
| 3900 | Mar. 24, 1998 | 450 | RTA00000527F.g.21.1 | M00003846B:C05 | 36028 |
| 3901 | Mar. 24, 1998 | 144 | RTA00000527F.g.23.1 | M00003846C:F08 | 37538 |
| 3902 | Mar. 24, 1998 | 422 | RTA00000527F.f.03.1 | M00003829A:B08 | 17788 |
| 3903 | Mar. 24, 1998 | 176 | RTA00000522F.g.15.1 | M00001595B:G07 | 76536 |
| 3904 | Mar. 24, 1998 | 264 | RTA00000425F.e.09.1 | M00001608C:G04 | 75550 |
| 3905 | Mar. 24, 1998 | 32 | RTA00000424F.n.14.1 | M00001584D:C11 | 73008 |
| 3906 | Mar. 24, 1998 | 459 | RTA00000425F.c.03.1 | M00001585D:B12 | 74643 |
| 3907 | Mar. 24, 1998 | 124 | RTA00000424F.m.12.1 | M00001586C:H07 | 77675 |
| 3908 | Mar. 24, 1998 | 314 | RTA00000522F.e.09.1 | M00001589D:A01 | 32599 |
| 3909 | Mar. 24, 1998 | 262 | RTA00000424F.k.03.1 | M00001590D:B04 | 21289 |
| 3910 | Mar. 24, 1998 | 106 | RTA00000424F.j.14.1 | M00001592B:B02 | 74311 |
| 3911 | Mar. 24, 1998 | 424 | RTA00000424F.k.10.1 | M00001592D:H02 | 73232 |
| 3912 | Mar. 24, 1998 | 168 | RTA00000424F.j.12.1 | M00001594C:E05 | 73827 |
| 3913 | Mar. 24, 1998 | 420 | RTA00000424F.j.13.1 | M00001594C:H03 | 74485 |
| 3914 | Mar. 24, 1998 | 210 | RTA00000522F.g.06.1 | M00001594D:G11 | 78221 |
| 3915 | Mar. 24, 1998 | 439 | RTA00000522F.g.10.1 | M00001595A:C07 | 74294 |
| 3916 | Mar. 24, 1998 | 300 | RTA00000424F.m.08.1 | M00001584A:A07 | 19402 |
| 3917 | Mar. 24, 1998 | 355 | RTA00000522F.g.12.1 | M00001595A:E07 | 78783 |
| 3918 | Mar. 24, 1998 | 411 | RTA00000424F.n.12.1 | M00001582C:G02 | 41589 |
| 3919 | Mar. 24, 1998 | 238 | RTA00000522F.g.17.1 | M00001595B:G10 | 76486 |
| 3920 | Mar. 24, 1998 | 472 | RTA00000522F.g.18.1 | M00001595B:H11 | 73226 |
| 3921 | Mar. 24, 1998 | 102 | RTA00000522F.g.19.1 | M00001595C:A01 | 78119 |
| 3922 | Mar. 24, 1998 | 280 | RTA00000522F.g.20.1 | M00001595C:A05 | 77688 |
| 3923 | Mar. 24, 1998 | 191 | RTA00000522F.g.22.1 | M00001595C:B12 | 77504 |
| 3924 | Mar. 24, 1998 | 163 | RTA00000522F.h.01.1 | M00001595C:E05 | 75010 |
| 3925 | Mar. 24, 1998 | 438 | RTA00000522F.h.02.1 | M00001595C:E09 | 74947 |
| 3926 | Mar. 24, 1998 | 257 | RTA00000522F.h.07.1 | M00001595D:C11 | 75149 |
| 3927 | Mar. 24, 1998 | 389 | RTA00000424F.i.15.1 | M00001596A:A02 | 78043 |
| 3928 | Mar. 24, 1998 | 167 | RTA00000424F.i.20.1 | M00001596A:D01 | 44010 |
| 3929 | Mar. 24, 1998 | 374 | RTA00000528F.f.10.1 | M00001596C:G05 | 3600 |
| 3930 | Mar. 24, 1998 | 215 | RTA00000425F.f.02.1 | M00001607A:A01 | 76982 |
| 3931 | Mar. 24, 1998 | 22 | RTA00000527F.k.15.1 | M00003982A:G03 | 22688 |
| 3932 | Mar. 24, 1998 | 378 | RTA00000522F.g.11.1 | M00001595A:D12 | 75432 |
| 3933 | Mar. 24, 1998 | 63 | RTA00000522F.b.01.1 | M00001570C:B02 | 75691 |
| 3934 | Mar. 24, 1998 | 430 | RTA00000424F.g.08.1 | M00001482C:F09 | 74928 |
| 3935 | Mar. 24, 1998 | 340 | RTA00000424F.h.06.1 | M00001485C:D07 | 77552 |
| 3936 | Mar. 24, 1998 | 161 | RTA00000424F.h.10.1 | M00001485C:G06 | 72925 |
| 3937 | Mar. 24, 1998 | 368 | RTA00000424F.i.11.1 | M00001485D:A05 | 41569 |
| 3938 | Mar. 24, 1998 | 455 | RTA00000424F.g.24.1 | M00001487C:A11 | 79156 |
| 3939 | Mar. 24, 1998 | 211 | RTA00000424F.h.03.1 | M00001487C:G09 | 74447 |
| 3940 | Mar. 24, 1998 | 174 | RTA00000424F.b.21.4 | M00001530A:B02 | 24686 |
| 3941 | Mar. 24, 1998 | 383 | RTA00000424F.b.23.4 | M00001530A:H05 | 77322 |
| 3942 | Mar. 24, 1998 | 179 | RTA00000424F.d.10.3 | M00001530D:A11 | 73110 |
| 3943 | Mar. 24, 1998 | 393 | RTA00000424F.b.15.4 | M00001539B:B10 | 74958 |
| 3944 | Mar. 24, 1998 | 347 | RTA00000522F.a.05.1 | M00001567A:C04 | 32611 |
| 3945 | Mar. 24, 1998 | 303 | RTA00000522F.a.06.1 | M00001567A:C11 | 73662 |
| 3946 | Mar. 24, 1998 | 229 | RTA00000424F.n.13.1 | M00001584D:B06 | 74942 |
| 3947 | Mar. 24, 1998 | 392 | RTA00000522F.a.20.1 | M00001567C:E07 | 74070 |
| 3948 | Mar. 24, 1998 | 226 | RTA00000425F.e.15.1 | M00001608D:F11 | 75921 |
| 3949 | Mar. 24, 1998 | 285 | RTA00000522F.b.07.1 | M00001570D:E05 | 78634 |
| 3950 | Mar. 24, 1998 | 465 | RTA00000528F.d.04.1 | M00001570D:E07 | 2395 |
| 3951 | Mar. 24, 1998 | 404 | RTA00000522F.b.18.1 | M00001573B:A06 | 3460 |
| 3952 | Mar. 24, 1998 | 9 | RTA00000522F.b.22.1 | M00001573B:H12 | 75181 |
| 3953 | Mar. 24, 1998 | 109 | RTA00000424F.a.01.4 | M00001575A:D05 | 43214 |
| 3953 | Mar. 24, 1998 | 125 | RTA00000424F.a.01.1 | M00001575A:D05 | 43214 |
| 3954 | Mar. 24, 1998 | 125 | RTA00000424F.a.01.1 | M00001575A:D05 | 43214 |
| 3954 | Mar. 24, 1998 | 109 | RTA00000424F.a.01.4 | M00001575A:D05 | 43214 |
| 3955 | Mar. 24, 1998 | 294 | RTA00000424F.a.05.1 | M00001575B:C01 | 77976 |
| 3955 | Mar. 24, 1998 | 292 | RTA00000424F.a.05.4 | M00001575B:C01 | 77976 |
| 3956 | Mar. 24, 1998 | 292 | RTA00000424F.a.05.4 | M00001575B:C01 | 77976 |
| 3956 | Mar. 24, 1998 | 294 | RTA00000424F.a.05.1 | M00001575B:C01 | 77976 |
| 3957 | Mar. 24, 1998 | 434 | RTA00000522F.c.11.1 | M00001576C:H02 | 31064 |
| 3958 | Mar. 24, 1998 | 299 | RTA00000522F.c.14.1 | M00001577A:A03 | 75449 |
| 3959 | Mar. 24, 1998 | 110 | RTA00000522F.d.08.1 | M00001578B:A06 | 74284 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 3960 | Mar. 24, 1998 | 306 | RTA00000522F.d.23.1 | M00001579D:F02 | 73868 |
| 3961 | Mar. 24, 1998 | 350 | RTA00000424F.n.11.1 | M00001582C:C04 | 73874 |
| 3962 | Mar. 24, 1998 | 366 | RTA00000522F.a.17.1 | M00001567C:B08 | 79032 |
| 3963 | Mar. 24, 1998 | 239 | RTA00000523F.j.17.1 | M00003966B:A04 | 63610 |
| 3964 | Mar. 24, 1998 | 405 | RTA00000425F.e.07.1 | M00001608C:D02 | 75992 |
| 3965 | Mar. 24, 1998 | 231 | RTA00000426F.e.17.1 | M00003810C:B06 | 64089 |
| 3966 | Mar. 24, 1998 | 104 | RTA00000527F.b.18.1 | M00003810D:H09 | 37469 |
| 3967 | Mar. 24, 1998 | 312 | RTA00000426F.f.17.1 | M00003811C:C02 | 66334 |
| 3968 | Mar. 24, 1998 | 266 | RTA00000426F.f.16.1 | M00003813B:F02 | 65613 |
| 3969 | Mar. 24, 1998 | 183 | RTA00000527F.c.04.1 | M00003813C:H08 | 23090 |
| 3970 | Mar. 24, 1998 | 435 | RTA00000523F.c.13.1 | M00003813D:B12 | 40668 |
| 3971 | Mar. 24, 1998 | 255 | RTA00000523F.c.14.1 | M00003813D:C02 | 66015 |
| 3972 | Mar. 24, 1998 | 131 | RTA00000523F.c.15.1 | M00003813D:G06 | 36935 |
| 3973 | Mar. 24, 1998 | 270 | RTA00000426F.g.16.1 | M00003814B:C01 | 41446 |
| 3974 | Mar. 24, 1998 | 95 | RTA00000523F.c.18.1 | M00003817C:A10 | 66179 |
| 3975 | Mar. 24, 1998 | 329 | RTA00000527F.c.09.1 | M00003817C:G06 | 64859 |
| 3976 | Mar. 24, 1998 | 65 | RTA00000523F.c.01.1 | M00003810A:A02 | 65710 |
| 3977 | Mar. 24, 1998 | 398 | RTA00000527F.c.16.1 | M00003821A:H09 | 22908 |
| 3978 | Mar. 24, 1998 | 96 | RTA00000523F.b.13.1 | M00003809B:A03 | 66330 |
| 3979 | Mar. 24, 1998 | 313 | RTA00000523F.j.21.1 | M00003966C:A12 | 36925 |
| 3980 | Mar. 24, 1998 | 86 | RTA00000523F.k.01.1 | M00003966C:F03 | 41437 |
| 3981 | Mar. 24, 1998 | 26 | RTA00000427F.b.23.1 | M00003973D:F08 | 64297 |
| 3982 | Mar. 24, 1998 | 277 | RTA00000427F.e.08.1 | M00003974D:E01 | 47387 |
| 3983 | Mar. 24, 1998 | 397 | RTA00000427F.e.10.1 | M00003974D:H07 | 64599 |
| 3984 | Mar. 24, 1998 | 31 | RTA00000427F.c.10.1 | M00003976B:E06 | 65478 |
| 3985 | Mar. 24, 1998 | 151 | RTA00000427F.c.12.1 | M00003976B:H07 | 66995 |
| 3986 | Mar. 24, 1998 | 57 | RTA00000427F.c.20.1 | M00003978A:E01 | 26527 |
| 3987 | Mar. 24, 1998 | 213 | RTA00000427F.c.22.1 | M00003978A:E09 | 63990 |
| 3988 | Mar. 24, 1998 | 289 | RTA00000427F.d.10.1 | M00003978C:A12 | 40685 |
| 3989 | Mar. 24, 1998 | 28 | RTA00000427F.d.08.1 | M00003980C:E12 | 63967 |
| 3990 | Mar. 24, 1998 | 335 | RTA00000427F.d.09.1 | M00003980C:F12 | 66486 |
| 3991 | Mar. 24, 1998 | 267 | RTA00000425F.i.21.1 | M00001635B:B02 | 75305 |
| 3992 | Mar. 24, 1998 | 343 | RTA00000527F.c.11.1 | M00003817D:D12 | 37484 |
| 3993 | Mar. 24, 1998 | 251 | RTA00000425F.f.24.1 | M00001656D:C04 | 40841 |
| 3994 | Mar. 24, 1998 | 155 | RTA00000424F.l.19.1 | M00001609C:A12 | 75454 |
| 3995 | Mar. 24, 1998 | 321 | RTA00000424F.m.04.1 | M00001609C:G05 | 79017 |
| 3996 | Mar. 24, 1998 | 214 | RTA00000424F.k.12.1 | M00001610C:B07 | 77666 |
| 3997 | Mar. 24, 1998 | 446 | RTA00000425F.f.20.1 | M00001653D:H07 | 74071 |
| 3998 | Mar. 24, 1998 | 428 | RTA00000522F.l.08.1 | M00001654A:E08 | 78781 |
| 3999 | Mar. 24, 1998 | 295 | RTA00000522F.l.15.1 | M00001654B:A01 | 74691 |
| 4000 | Mar. 24, 1998 | 275 | RTA00000522F.l.22.1 | M00001654C:D10 | 75801 |
| 4001 | Mar. 24, 1998 | 223 | RTA00000522F.m.02.1 | M00001654C:G07 | 76834 |
| 4002 | Mar. 24, 1998 | 391 | RTA00000522F.m.03.1 | M00001654C:G09 | 79194 |
| 4003 | Mar. 24, 1998 | 346 | RTA00000522F.m.19.1 | M00001655C:C07 | 41544 |
| 4004 | Mar. 24, 1998 | 51 | RTA00000522F.n.02.1 | M00001655D:E08 | 74959 |
| 4005 | Mar. 24, 1998 | 94 | RTA00000522F.n.05.1 | M00001655D:H11 | 73260 |
| 4006 | Mar. 24, 1998 | 332 | RTA00000523F.c.03.1 | M00003810B:B11 | 36913 |
| 4007 | Mar. 24, 1998 | 172 | RTA00000425F.f.11.1 | M00001656C:C04 | 79275 |
| 4008 | Mar. 24, 1998 | 58 | RTA00000527F.k.06.1 | M00003981B:B12 | 12469 |
| 4009 | Mar. 24, 1998 | 240 | RTA00000522F.n.14.1 | M00001657C:C11 | 73410 |
| 4010 | Mar. 24, 1998 | 56 | RTA00000522F.n.16.1 | M00001657D:A10 | 26769 |
| 4011 | Mar. 24, 1998 | 20 | RTA00000522F.o.06.1 | M00001659D:A09 | 26860 |
| 4012 | Mar. 24, 1998 | 38 | RTA00000528F.i.22.1 | M00001661D:D05 | 2478 |
| 4013 | Mar. 24, 1998 | 413 | RTA00000425F.i.10.1 | M00001664B:E08 | 78736 |
| 4014 | Mar. 24, 1998 | 412 | RTA00000425F.i.11.1 | M00001664B:F06 | 21716 |
| 4015 | Mar. 24, 1998 | 202 | RTA00000528F.j.11.1 | M00001669B:C12 | 1070 |
| 4016 | Mar. 24, 1998 | 432 | RTA00000522F.o.20.1 | M00001669C:B09 | 74853 |
| 4017 | Mar. 24, 1998 | 245 | RTA00000522F.p.09.1 | M00001670A:F09 | 75204 |
| 4018 | Mar. 24, 1998 | 331 | RTA00000528F.k.10.1 | M00001678C:F09 | 1981 |
| 4019 | Mar. 24, 1998 | 356 | RTA00000523F.a.07.1 | M00001693A:H06 | 75804 |
| 4020 | Mar. 24, 1998 | 200 | RTA00000527F.a.13.1 | M00003805D:E06 | 37740 |
| 4021 | Mar. 24, 1998 | 14 | RTA00000523F.b.02.1 | M00003806C:A06 | 65163 |
| 4022 | Mar. 24, 1998 | 177 | RTA00000522F.n.12.1 | M00001656A:H12 | 74117 |
| 4023 | Feb. 24, 1998 | 1158 | RTA00000405F.o.03.1 | M00003829C:H05 | 37575 |
| 4024 | Feb. 24, 1998 | 1181 | RTA00000346F.f.14.1 | M00003800B:F03 | 16998 |
| 4025 | Feb. 24, 1998 | 610 | RTA00000419F.d.07.1 | M00003820B:D10 | 21421 |
| 4026 | Feb. 24, 1998 | 1227 | RTA00000411F.g.05.1 | M00003822D:B10 | 64664 |
| 4027 | Feb. 24, 1998 | 412 | RTA00000411F.g.06.1 | M00003822D:C06 | 66065 |
| 4028 | Feb. 24, 1998 | 21 | RTA00000411F.g.08.1 | M00003822D:D04 | 45815 |
| 4029 | Feb. 24, 1998 | 1208 | RTA00000347F.e.24.1 | M00003823B:F07 | 8188 |
| 4030 | Feb. 24, 1998 | 502 | RTA00000341F.d.08.1 | M00003824C:D07 | 0 |
| 4031 | Feb. 24, 1998 | 528 | RTA00000405F.n.16.1 | M00003825B:B10 | 21503 |
| 4032 | Feb. 24, 1998 | 15 | RTA00000419F.c.19.1 | M00003820A:A08 | 64346 |
| 4033 | Feb. 24, 1998 | 637 | RTA00000419F.d.14.1 | M00003828A:D05 | 64945 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4034 | Feb. 24, 1998 | 81 | RTA00000419F.c.16.1 | M00003819D:B01 | 65254 |
| 4035 | Feb. 24, 1998 | 754 | RTA00000419F.e.02.1 | M00003830C:A03 | 65010 |
| 4036 | Feb. 24, 1998 | 430 | RTA00000419F.e.04.1 | M00003831C:G05 | 62963 |
| 4037 | Feb. 24, 1998 | 541 | RTA00000411F.h.15.1 | M00003832A:A09 | 65160 |
| 4038 | Feb. 24, 1998 | 1079 | RTA00000419F.e.10.1 | M00003833B:B03 | 63225 |
| 4039 | Feb. 24, 1998 | 577 | RTA00000419F.e.11.1 | M00003833B:C12 | 36780 |
| 4040 | Feb. 24, 1998 | 1220 | RTA00000419F.e.23.1 | M00003834B:G04 | 65772 |
| 4041 | Feb. 24, 1998 | 691 | RTA00000354R.n.08.1 | M00003835A:A09 | 8802 |
| 4042 | Feb. 24, 1998 | 536 | RTA00000411F.i.02.1 | M00003835B:H11 | 66975 |
| 4043 | Feb. 24, 1998 | 421 | RTA00000419F.f.10.1 | M00003835D:G06 | 66193 |
| 4044 | Feb. 24, 1998 | 1150 | RTA00000411F.g.24.1 | M00003825B:B11 | 65233 |
| 4045 | Feb. 24, 1998 | 533 | RTA00000423F.e.11.1 | M00003809B:E10 | 2566 |
| 4046 | Feb. 24, 1998 | 520 | RTA00000406F.c.20.1 | M00003871D:G06 | 38578 |
| 4047 | Feb. 24, 1998 | 41 | RTA00000419F.b.12.1 | M00003806B:C09 | 63148 |
| 4048 | Feb. 24, 1998 | 917 | RTA00000423F.e.21.1 | M00003806B:G05 | 66961 |
| 4049 | Feb. 24, 1998 | 326 | RTA00000419F.b.15.1 | M00003806D:D11 | 43969 |
| 4050 | Feb. 24, 1998 | 297 | RTA00000419F.b.18.1 | M00003808D:D08 | 67034 |
| 4051 | Feb. 24, 1998 | 139 | RTA00000419F.b.19.1 | M00003809A:C01 | 65534 |
| 4052 | Feb. 24, 1998 | 1021 | RTA00000419F.b.21.1 | M00003809A:F01 | 65366 |
| 4053 | Feb. 24, 1998 | 1152 | RTA00000405F.m.07.1 | M00003809B:B02 | 37733 |
| 4054 | Feb. 24, 1998 | 310 | RTA00000419F.d.06.1 | M00003820B:D07 | 65496 |
| 4055 | Feb. 24, 1998 | 120 | RTA00000401F.m.02.1 | M00003907A:F01 | 1573 |
| 4056 | Feb. 24, 1998 | 69 | RTA00000405F.o.18.1 | M00003839A:D07 | 11016 |
| 4057 | Feb. 24, 1998 | 482 | RTA00000411F.e.24.1 | M00003813A:B02 | 64781 |
| 4058 | Feb. 24, 1998 | 50 | RTA00000411F.f.02.1 | M00003813A:D08 | 63386 |
| 4059 | Feb. 24, 1998 | 602 | RTA00000411F.f.06.1 | M00003813B:E09 | 64186 |
| 4060 | Feb. 24, 1998 | 761 | RTA00000411F.f.14.1 | M00003814B:C12 | 62984 |
| 4061 | Feb. 24, 1998 | 674 | RTA00000411F.f.17.1 | M00003814B:F12 | 65661 |
| 4062 | Feb. 24, 1998 | 1164 | RTA00000405F.m.21.1 | M00003815C:C06 | 24218 |
| 4063 | Feb. 24, 1998 | 951 | RTA00000419F.c.04.1 | M00003815C:D12 | 63749 |
| 4064 | Feb. 24, 1998 | 471 | RTA00000419F.c.11.1 | M00003817B:C04 | 65504 |
| 4065 | Feb. 24, 1998 | 1047 | RTA00000419F.c.14.1 | M00003819B:G01 | 65727 |
| 4066 | Feb. 24, 1998 | 1178 | RTA00000400F.f.11.1 | M00001636A:E07 | 4088 |
| 4067 | Feb. 24, 1998 | 89 | RTA00000406F.c.08.1 | M00003870C:A10 | 22387 |
| 4068 | Feb. 24, 1998 | 94 | RTA00000406F.a.23.1 | M00003867B:D10 | 38712 |
| 4069 | Feb. 24, 1998 | 1038 | RTA00000406F.b.01.1 | M00003867B:G07 | 39006 |
| 4070 | Feb. 24, 1998 | 783 | RTA00000406F.b.02.1 | M00003867B:G08 | 38744 |
| 4071 | Feb. 24, 1998 | 563 | RTA00000406F.b.08.1 | M00003867D:A06 | 18258 |
| 4072 | Feb. 24, 1998 | 1072 | RTA00000419F.j.03.1 | M00003868B:G06 | 77578 |
| 4073 | Feb. 24, 1998 | 846 | RTA00000419F.j.11.1 | M00003868C:C07 | 73183 |
| 4074 | Feb. 24, 1998 | 17 | RTA00000411F.m.15.1 | M00003868D:B09 | 78014 |
| 4075 | Feb. 24, 1998 | 589 | RTA00000411F.m.18.1 | M00003868D:D09 | 75629 |
| 4076 | Feb. 24, 1998 | 971 | RTA00000411F.i.11.1 | M00003837C:E05 | 66849 |
| 4077 | Feb. 24, 1998 | 794 | RTA00000406F.c.06.1 | M00003870C:A01 | 37924 |
| 4078 | Feb. 24, 1998 | 788 | RTA00000419F.i.04.1 | M00003860B:F11 | 65791 |
| 4079 | Feb. 24, 1998 | 883 | RTA00000406F.c.09.1 | M00003870C:E10 | 5671 |
| 4080 | Feb. 24, 1998 | 918 | RTA00000419F.j.22.1 | M00003871A:A02 | 73525 |
| 4081 | Feb. 24, 1998 | 757 | RTA00000423F.h.13.1 | M00003871A:B09 | 14398 |
| 4082 | Feb. 24, 1998 | 208 | RTA00000419F.j.23.1 | M00003871A:C11 | 74470 |
| 4083 | Feb. 24, 1998 | 1127 | RTA00000401F.g.22.1 | M00003871A:G09 | 1147 |
| 4084 | Feb. 24, 1998 | 1205 | RTA00000419F.k.05.1 | M00003871C:E04 | 11757 |
| 4085 | Feb. 24, 1998 | 522 | RTA00000406F.c.18.1 | M00003871C:F12 | 14368 |
| 4086 | Feb. 24, 1998 | 459 | RTA00000419F.k.06.1 | M00003871D:A10 | 78493 |
| 4087 | Feb. 24, 1998 | 965 | RTA00000411F.n.06.1 | M00003871D:E11 | 73886 |
| 4088 | Feb. 24, 1998 | 457 | RTA00000411F.m.19.1 | M00003868D:D11 | 74924 |
| 4089 | Feb. 24, 1998 | 145 | RTA00000419F.g.12.1 | M00003842C:G03 | 66171 |
| 4090 | Feb. 24, 1998 | 633 | RTA00000341F.d.02.1 | M00003797A:G03 | 4706 |
| 4091 | Feb. 24, 1998 | 1026 | RTA00000419F.f.18.1 | M00003839D:E11 | 64047 |
| 4092 | Feb. 24, 1998 | 524 | RTA00000419F.f.23.1 | M00003840D:H10 | 65002 |
| 4093 | Feb. 24, 1998 | 204 | RTA00000351R.k.19.1 | M00003841B:E03 | 936 |
| 4094 | Feb. 24, 1998 | 968 | RTA00000419F.f.24.1 | M00003841B:E06 | 18717 |
| 4095 | Feb. 24, 1998 | 209 | RTA00000411F.j.02.1 | M00003841C:D07 | 65310 |
| 4096 | Feb. 24, 1998 | 1118 | RTA00000411F.j.03.1 | M00003841C:F01 | 66263 |
| 4097 | Feb. 24, 1998 | 470 | RTA00000411F.j.06.1 | M00003841C:H08 | 63545 |
| 4098 | Feb. 24, 1998 | 1153 | RTA00000411F.j.07.1 | M00003841C:H11 | 66963 |
| 4099 | Jan. 28, 1998 | 412 | RTA00000195AF.c.24.1 | M00003860D:H07 | 0 |
| 4099 | Feb. 24, 1998 | 678 | RTA00000195AF.c.24.1 | M00003860D:H07 | 0 |
| 4100 | Feb. 24, 1998 | 777 | RTA00000419F.g.02.1 | M00003842A:A03 | 62839 |
| 4101 | Feb. 24, 1998 | 678 | RTA00000195AF.c.24.1 | M00003860D:H07 | 0 |
| 4101 | Jan. 28, 1998 | 412 | RTA00000195AF.c.24.1 | M00003860D:H07 | 0 |
| 4102 | Feb. 24, 1998 | 799 | RTA00000411F.j.15.1 | M00003843A:E04 | 66871 |
| 4103 | Feb. 24, 1998 | 932 | RTA00000405F.p.03.1 | M00003844A:A11 | 11346 |
| 4104 | Feb. 24, 1998 | 266 | RTA00000419F.g.15.1 | M00003844D:A07 | 32519 |
| 4105 | Feb. 24, 1998 | 547 | RTA00000419F.h.02.1 | M00003845D:G08 | 63985 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4106 | Feb. 24, 1998 | 290 | RTA00000411F.k.16.1 | M00003852C:B06 | 64759 |
| 4107 | Feb. 24, 1998 | 23 | RTA00000411F.k.20.1 | M00003854B:A07 | 64973 |
| 4108 | Feb. 24, 1998 | 1138 | RTA00000411F.k.21.1 | M00003854B:D04 | 65349 |
| 4109 | Feb. 24, 1998 | 1000 | RTA00000351R.j.21.1 | M00003859D:C05 | 31604 |
| 4110 | Feb. 24, 1998 | 980 | RTA00000411F.i.13.1 | M00003837C:F10 | 66138 |
| 4111 | Feb. 24, 1998 | 112 | RTA00000422F.c.11.1 | M00003841D:A04 | 2643 |
| 4112 | Feb. 24, 1998 | 905 | RTA00000405F.g.21.2 | M00001673B:F07 | 38966 |
| 4112 | Feb. 24, 1998 | 906 | RTA00000405F.g.21.1 | M00001673B:F07 | 38966 |
| 4113 | Feb. 24, 1998 | 294 | RTA00000405F.l.17.1 | M00003805A:F02 | 17225 |
| 4114 | Feb. 24, 1998 | 105 | RTA00000346F.d.08.1 | M00001671A:A10 | 39955 |
| 4115 | Feb. 24, 1998 | 1190 | RTA00000405F.g.02.2 | M00001671B:G05 | 10567 |
| 4116 | Feb. 24, 1998 | 280 | RTA00000418F.p.15.1 | M00001671C:C11 | 31066 |
| 4117 | Feb. 24, 1998 | 1151 | RTA00000405F.g.18.2 | M00001672D:E08 | 5255 |
| 4118 | Feb. 24, 1998 | 66 | RTA00000405F.g.19.2 | M00001673A:G08 | 37150 |
| 4119 | Feb. 24, 1998 | 1239 | RTA00000340F.o.22.1 | M00001673B:B07 | 7356 |
| 4120 | Feb. 24, 1998 | 906 | RTA00000405F.g.21.1 | M00001673B:F07 | 38966 |
| 4120 | Feb. 24, 1998 | 905 | RTA00000405F.g.21.2 | M00001673B:F07 | 38966 |
| 4121 | Feb. 24, 1998 | 893 | RTA00000418F.p.10.1 | M00001669D:F05 | 75323 |
| 4122 | Feb. 24, 1998 | 906 | RTA00000405F.g.21.1 | M00001673B:F07 | 38966 |
| 4122 | Feb. 24, 1998 | 905 | RTA00000405F.g.21.2 | M00001673B:F07 | 38966 |
| 4123 | Feb. 24, 1998 | 808 | RTA00000418F.p.08.1 | M00001669D:D06 | 73983 |
| 4124 | Feb. 24, 1998 | 469 | RTA00000405F.g.24.1 | M00001673D:D06 | 39076 |
| 4125 | Feb. 24, 1998 | 1094 | RTA00000405F.h.03.2 | M00001673D:F10 | 20633 |
| 4126 | Feb. 24, 1998 | 803 | RTA00000405F.h.05.2 | M00001674A:G07 | 75706 |
| 4127 | Feb. 24, 1998 | 667 | RTA00000405F.h.07.2 | M00001674A:G11 | 4984 |
| 4128 | Feb. 24, 1998 | 276 | RTA00000423F.a.18.1 | M00001675A:G10 | 26761 |
| 4129 | Feb. 24, 1998 | 1050 | RTA00000405F.f.05.2 | M00001669C:D09 | 14359 |
| 4129 | Feb. 24, 1998 | 1049 | RTA00000405F.f.05.1 | M00001669C:D09 | 14359 |
| 4130 | Feb. 24, 1998 | 1050 | RTA00000405F.f.05.2 | M00001669C:D09 | 14359 |
| 4130 | Feb. 24, 1998 | 1049 | RTA00000405F.f.05.1 | M00001669C:D09 | 14359 |
| 4131 | Feb. 24, 1998 | 104 | RTA00000421F.n.03.1 | M00001675C:A04 | 1638 |
| 4132 | Feb. 24, 1998 | 388 | RTA00000411F.a.07.1 | M00001675C:C03 | 74547 |
| 4133 | Feb. 24, 1998 | 906 | RTA00000405F.g.21.1 | M00001673B:F07 | 38966 |
| 4133 | Feb. 24, 1998 | 905 | RTA00000405F.g.21.2 | M00001673B:F07 | 38966 |
| 4134 | Feb. 24, 1998 | 222 | RTA00000405F.e.09.1 | M00001663C:F12 | 38978 |
| 4135 | Feb. 24, 1998 | 518 | RTA00000410F.m.18.1 | M00001660B:A09 | 76365 |
| 4136 | Feb. 24, 1998 | 218 | RTA00000346F.e.13.1 | M00001660B:D03 | 74653 |
| 4137 | Feb. 24, 1998 | 427 | RTA00000410F.m.20.1 | M00001660B:E03 | 74285 |
| 4138 | Feb. 24, 1998 | 1099 | RTA00000400F.m.16.1 | M00001660B:E04 | 3307 |
| 4139 | Feb. 24, 1998 | 775 | RTA00000405F.c.22.1 | M00001660C:B06 | 39053 |
| 4140 | Feb. 24, 1998 | 28 | RTA00000422F.p.06.2 | M00001661A:B11 | 39282 |
| 4141 | Feb. 24, 1998 | 108 | RTA00000418F.o.18.1 | M00001661B:F06 | 78676 |
| 4142 | Feb. 24, 1998 | 954 | RTA00000410F.n.05.1 | M00001662A:C07 | 77830 |
| 4143 | Feb. 24, 1998 | 1182 | RTA00000346F.d.11.1 | M00001670B:G12 | 6641 |
| 4144 | Feb. 24, 1998 | 1043 | RTA00000423F.b.17.1 | M00001662B:F06 | 8200 |
| 4145 | Feb. 24, 1998 | 447 | RTA00000423F.b.04.3 | M00001675D:E10 | 6311 |
| 4146 | Feb. 24, 1998 | 305 | RTA00000418F.p.06.1 | M00001664A:F08 | 32628 |
| 4147 | Feb. 24, 1998 | 1116 | RTA00000410F.o.04.1 | M00001664D:F04 | 79018 |
| 4148 | Feb. 24, 1998 | 320 | RTA00000422F.p.07.2 | M00001661A:E06 | 39024 |
| 4149 | Feb. 24, 1998 | 197 | RTA00000410F.o.05.1 | M00001669A:B02 | 75262 |
| 4150 | Feb. 24, 1998 | 738 | RTA00000422F.n.20.1 | M00001669B:B12 | 38676 |
| 4151 | Feb. 24, 1998 | 495 | RTA00000400F.0.21.1 | M00001669C:C08 | 16259 |
| 4152 | Feb. 24, 1998 | 1050 | RTA00000405F.f.05.2 | M00001669C:D09 | 14359 |
| 4152 | Feb. 24, 1998 | 1049 | RTA00000405F.f.05.1 | M00001669C:D09 | 14359 |
| 4153 | Feb. 24, 1998 | 1049 | RTA00000405F.f.05.1 | M00001669C:D09 | 14359 |
| 4153 | Feb. 24, 1998 | 1050 | RTA00000405F.f.05.2 | M00001669C:D09 | 14359 |
| 4154 | Feb. 24, 1998 | 492 | RTA00000340F.o.18.1 | M00001669D:C03 | 4261 |
| 4155 | Feb. 24, 1998 | 61 | RTA00000410F.n.07.1 | M00001662A:G01 | 78823 |
| 4156 | Feb. 24, 1998 | 299 | RTA00000405F.l.15.1 | M00001694A:E03 | 19575 |
| 4157 | Feb. 24, 1998 | 475 | RTA00000411F.d.05.1 | M00001681C:A08 | 75812 |
| 4158 | Feb. 24, 1998 | 692 | RTA00000411F.d.10.1 | M00001681D:C12 | 76445 |
| 4159 | Feb. 24, 1998 | 336 | RTA00000340F.n.13.1 | M00001688D:B10 | 17055 |
| 4160 | Feb. 24, 1998 | 270 | RTA00000411F.d.15.1 | M00001692A:B06 | 74890 |
| 4161 | Feb. 24, 1998 | 969 | RTA00000411F.d.18.1 | M00001692A:G06 | 76063 |
| 4162 | Feb. 24, 1998 | 927 | RTA00000411F.d.21.1 | M00001692B:E01 | 74794 |
| 4163 | Feb. 24, 1998 | 1133 | RTA00000405F.l.03.1 | M00001692D:B01 | 38580 |
| 4164 | Feb. 24, 1998 | 576 | RTA00000401F.d.15.2 | M00001693C:C12 | 5297 |
| 4165 | Feb. 24, 1998 | 1059 | RTA00000405F.h.21.2 | M00001675C:D12 | 39072 |
| 4166 | Feb. 24, 1998 | 780 | RTA00000405F.l.11.1 | M00001693D:E08 | 2055 |
| 4167 | Feb. 24, 1998 | 933 | RTA00000419F.a.18.1 | M00001680A:B02 | 78484 |
| 4168 | Feb. 24, 1998 | 631 | RTA00000411F.e.03.1 | M00001694D:C12 | 73648 |
| 4169 | Feb. 24, 1998 | 585 | RTA00000340R.o.12.1 | M00003746C:E02 | 53732 |
| 4170 | Feb. 24, 1998 | 604 | RTA00000351R.c.13.1 | M00003747D:C05 | 11476 |
| 4171 | Feb. 24, 1998 | 187 | RTA00000351R.g.11.1 | M00003779D:E08 | 3077 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4172 | Feb. 24, 1998 | 1060 | RTA00000346F.g.02.1 | M00003792A:B10 | 6901 |
| 4173 | Feb. 24, 1998 | 690 | RTA00000341F.b.05.1 | M00003793D:A11 | 0 |
| 4174 | Feb. 24, 1998 | 86 | RTA00000346F.g.22.1 | M00003794D:G03 | 6371 |
| 4175 | Feb. 24, 1998 | 1051 | RTA00000346F.h.24.1 | M00003797A:C11 | 4379 |
| 4176 | Feb. 24, 1998 | 377 | RTA00000346F.i.01.1 | M00003797A:D06 | 22260 |
| 4177 | Feb. 24, 1998 | 963 | RTA00000405F.i.07.1 | M00001693C:E09 | 38636 |
| 4178 | Feb. 24, 1998 | 121 | RTA00000418F.p.19.1 | M00001677D:B01 | 78544 |
| 4179 | Feb. 24, 1998 | 781 | RTA00000423F.f.09.1 | M00003808C:A05 | 64823 |
| 4180 | Feb. 24, 1998 | 1028 | RTA00000346F.d.12.1 | M00001676B:B09 | 11777 |
| 4181 | Feb. 24, 1998 | 82 | RTA00000411F.b.03.1 | M00001676B:E01 | 23634 |
| 4182 | Feb. 24, 1998 | 465 | RTA00000350R.p.18.1 | M00001676B:F05 | 11460 |
| 4183 | Feb. 24, 1998 | 56 | RTA00000411F.b.06.1 | M00001676C:A04 | 77884 |
| 4184 | Feb. 24, 1998 | 789 | RTA00000423F.b.13.1 | M00001676C:E07 | 20619 |
| 4185 | Feb. 24, 1998 | 267 | RTA00000423F.a.19.1 | M00001676D:A02 | 21396 |
| 4186 | Feb. 24, 1998 | 836 | RTA00000411F.b.17.1 | M00001676D:B02 | 72893 |
| 4187 | Feb. 24, 1998 | 370 | RTA00000405F.i.20.1 | M00001677A:G11 | 38532 |
| 4188 | Feb. 24, 1998 | 39 | RTA00000187AF.l.7.1 | M00001680D:F08 | 10539 |
| 4189 | Feb. 24, 1998 | 389 | RTA00000411F.c.02.1 | M00001677B:B04 | 72852 |
| 4190 | Feb. 24, 1998 | 1004 | RTA00000419F.a.24.1 | M00001680B:D02 | 79290 |
| 4191 | Feb. 24, 1998 | 958 | RTA00000195AF.c.8.1 | M00001678B:H01 | 0 |
| 4191 | Jan. 28, 1998 | 520 | RTA00000195AF.c.8.1 | M00001678B:H01 | 0 |
| 4192 | Feb. 24, 1998 | 958 | RTA00000195AF.c.8.1 | M00001678B:H01 | 0 |
| 4192 | Jan. 28, 1998 | 520 | RTA00000195AF.c.8.1 | M00001678B:H01 | 0 |
| 4193 | Feb. 24, 1998 | 500 | RTA00000411F.c.10.1 | M00001678D:B11 | 73117 |
| 4194 | Feb. 24, 1998 | 323 | RTA00000421F.n.19.1 | M00001679A:D10 | 16409 |
| 4195 | Feb. 24, 1998 | 309 | RTA00000340F.n.01.1 | M00001679A:G06 | 39081 |
| 4196 | Feb. 24, 1998 | 337 | RTA00000340F.p.04.1 | M00001679D:B02 | 78533 |
| 4197 | Jan. 28, 1998 | 238 | RTA00000187AR.k.12.1 | M00001679D:F02 | 78415 |
| 4197 | Feb. 24, 1998 | 407 | RTA00000340R.m.07.1 | M00001679D:F02 | 78415 |
| 4198 | Jan. 28, 1998 | 238 | RTA00000187AR.k.12.1 | M00001679D:F02 | 78415 |
| 4198 | Feb. 24, 1998 | 407 | RTA00000340R.m.07.1 | M00001679D:F02 | 78415 |
| 4199 | Feb. 24, 1998 | 387 | RTA00000411F.a.15.1 | M00001675D:B08 | 73812 |
| 4200 | Feb. 24, 1998 | 48 | RTA00000411F.b.24.1 | M00001677B:A12 | 30041 |
| 4201 | Feb. 24, 1998 | 234 | RTA00000195AF.d.4.1 | M00003881D:D06 | 22766 |
| 4201 | Jan. 28, 1998 | 185 | RTA00000195AF.d.4.1 | M00003881D:D06 | 22766 |
| 4202 | Feb. 24, 1998 | 130 | RTA00000406F.f.12.1 | M00003879A:C11 | 21895 |
| 4203 | Feb. 24, 1998 | 953 | RTA00000406F.f.05.1 | M00003878C:F06 | 22961 |
| 4204 | Feb. 24, 1998 | 138 | RTA00000406F.f.03.1 | M00003878C:D08 | 38687 |
| 4205 | Feb. 24, 1998 | 673 | RTA00000406F.d.09.1 | M00003875B:F12 | 38591 |
| 4206 | Feb. 24, 1998 | 136 | RTA00000419F.l.12.1 | M00003901C:B01 | 75710 |
| 4207 | Feb. 24, 1998 | 300 | RTA00000406F.g.17.1 | M00003881B:F10 | 37979 |
| 4208 | Feb. 24, 1998 | 2 | RTA00000406F.d.16.1 | M00003875C:G02 | 15040 |
| 4209 | Feb. 24, 1998 | 1207 | RTA00000401F.j.21.1 | M00003901B:F10 | 0 |
| 4210 | Feb. 24, 1998 | 494 | RTA00000419F.k.12.1 | M00003876C:F02 | 0 |
| 4211 | Feb. 24, 1998 | 515 | RTA00000419F.l.03.1 | M00003879A:D02 | 79060 |
| 4212 | Feb. 24, 1998 | 26 | RTA00000423F.h.18.1 | M00003876C:D02 | 37972 |
| 4213 | Feb. 24, 1998 | 49 | RTA00000406F.d.12.1 | M00003875C:A01 | 38575 |
| 4214 | Feb. 24, 1998 | 986 | RTA00000406F.d.24.1 | M00003876B:C05 | 37997 |
| 4215 | Feb. 24, 1998 | 150 | RTA00000419F.k.19.1 | M00003877C:G12 | 75447 |
| 4216 | Feb. 24, 1998 | 538 | RTA00000423F.g.04.1 | M00003903D:C12 | 23012 |
| 4217 | Feb. 24, 1998 | 1046 | RTA00000346F.j.06.1 | M00003879A:A02 | 5767 |
| 4218 | Feb. 24, 1998 | 868 | RTA00000406F.i.08.1 | M00003903C:E12 | 37946 |
| 4219 | Feb. 24, 1998 | 409 | RTA00000406F.f.11.1 | M00003879A:B08 | 38601 |
| 4220 | Feb. 24, 1998 | 924 | RTA00000354R.m.02.1 | M00003890B:C08 | 12766 |
| 4221 | Feb. 24, 1998 | 543 | RTA00000419F.k.24.1 | M00003878C:G08 | 75596 |
| 4222 | Jan. 28, 1998 | 185 | RTA00000195AF.d.4.1 | M00003881D:D06 | 22766 |
| 4222 | Feb. 24, 1998 | 234 | RTA00000195AF.d.4.1 | M00003881D:D06 | 22766 |
| 4223 | Feb. 24, 1998 | 382 | RTA00000341F.h.10.1 | M00003901B:G11 | 0 |
| 4224 | Feb. 24, 1998 | 550 | RTA00000411F.n.20.1 | M00003875C:A09 | 75816 |
| 4225 | Feb. 24, 1998 | 614 | RTA00000406F.i.13.1 | M00003904A:C04 | 37904 |
| 4226 | Feb. 24, 1998 | 13 | RTA00000406F.f.18.1 | M00003879B:G02 | 38587 |
| 4227 | Feb. 24, 1998 | 1256 | RTA00000401F.k.19.1 | M00003903D:D10 | 799 |
| 4228 | Feb. 24, 1998 | 185 | RTA00000423F.j.05.1 | M00003903C:C05 | 37958 |
| 4229 | Feb. 24, 1998 | 177 | RTA00000406F.i.12.1 | M00003903D:H11 | 39080 |
| 4230 | Feb. 24, 1998 | 802 | RTA00000406F.g.03.1 | M00003880B:D11 | 38690 |
| 4231 | Feb. 24, 1998 | 34 | RTA00000411F.n.11.1 | M00003875A:B01 | 77276 |
| 4232 | Feb. 24, 1998 | 498 | RTA00000406F.e.15.1 | M00003877C:A11 | 39074 |
| 4233 | Feb. 24, 1998 | 929 | RTA00000411F.n.09.1 | M00003875A:A07 | 78962 |
| 4234 | Feb. 24, 1998 | 984 | RTA00000406F.g.08.1 | M00003880C:H03 | 37963 |
| 4235 | Feb. 24, 1998 | 818 | RTA00000406F.h.05.1 | M00003901B:C03 | 38542 |
| 4236 | Feb. 24, 1998 | 592 | RTA00000421F.p.18.1 | M00003877B:H10 | 750 |
| 4237 | Feb. 24, 1998 | 313 | RTA00000406F.g.07.1 | M00003880C:E11 | 37925 |
| 4238 | Jan. 28, 1998 | 324 | RTA00000184F.j.06.1 | M00001556B:G02 | 11294 |
| 4239 | Feb. 24, 1998 | 773 | RTA00000406F.h.03.1 | M00003901B:A09 | 38585 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4240 | Mar. 24, 1998 | 244 | RTA00000426F.p.09.1 | M00004033D:B07 | 66665 |
| 4241 | Mar. 24, 1998 | 222 | RTA00000426F.p.10.1 | M00004033D:C05 | 65845 |
| 4242 | Jan. 28, 1998 | 181 | RTA00000198AF.d.2.1 | M00001585A:F07 | 0 |
| 4243 | Jan. 28, 1998 | 77 | RTA00000197AF.n.2.1 | M00001535A:D02 | 6229 |
| 4244 | Feb. 24, 1998 | 844 | RTA00000411F.a.09.1 | M00001675C:F01 | 78629 |
| 4245 | Feb. 24, 1998 | 352 | RTA00000411F.a.10.1 | M00001675C:G01 | 73073 |
| 4246 | Mar. 24, 1998 | 272 | RTA00000426F.m.02.1 | M00004034C:C06 | 66237 |
| 4247 | Mar. 24, 1998 | 429 | RTA00000525F.a.14.1 | M00004033B:C02 | 37566 |
| 4248 | Feb. 24, 1998 | 118 | RTA00000408F.h.03.1 | M00001479D:H03 | 78382 |
| 4249 | Mar. 24, 1998 | 156 | RTA00000525F.b.22.1 | M00004037C:D07 | 16679 |
| 4250 | Feb. 24, 1998 | 70 | RTA00000409F.m.13.1 | M00001618B:E05 | 0 |
| 4251 | Feb. 24, 1998 | 1198 | RTA00000412F.f.10.2 | M00003959A:A03 | 65405 |
| 4252 | Feb. 24, 1998 | 1139 | RTA00000404F.h.20.1 | M00001619B:A09 | 15564 |
| 4253 | Mar. 24, 1998 | 41 | RTA00000525F.b.17.1 | M00004037B:A04 | 24715 |
| 4254 | Mar. 24, 1998 | 452 | RTA00000525F.a.22.1 | M00004033D:G06 | 36848 |
| 4255 | Feb. 24, 1998 | 1019 | RTA00000403F.g.03.1 | M00001479D:G06 | 23537 |
| 4256 | Feb. 24, 1998 | 532 | RTA00000403F.a.24.1 | M00001455B:A09 | 24128 |
| 4257 | Mar. 24, 1998 | 5 | RTA00000426F.p.04.1 | M00004029B:H08 | 34149 |
| 4258 | Mar. 24, 1998 | 43 | RTA00000527F.p.07.1 | M00004029C:B03 | 23343 |
| 4259 | Feb. 24, 1998 | 562 | RTA00000401F.j.17.1 | M00003901B:C05 | 5483 |
| 4260 | Feb. 24, 1998 | 303 | RTA00000130A.h.22.1 | M00001617A:D06 | 80933 |
| 4261 | Feb. 24, 1998 | 1201 | RTA00000409F.m.02.1 | M00001616C:A11 | 9157 |
| 4262 | Mar. 24, 1998 | 241 | RTA00000527F.o.12.1 | M00004028B:G08 | 688 |
| 4263 | Feb. 24, 1998 | 1170 | RTA00000409F.l.24.1 | M00001616C:A02 | 73174 |
| 4264 | Feb. 24, 1998 | 176 | RTA00000403F.b.10.1 | M00001455C:G07 | 73268 |
| 4265 | Jan. 28, 1998 | 131 | RTA00000185AF.d.11.2 | M00001579D:C03 | 6539 |
| 4265 | Jan. 28, 1998 | 626 | RTA00000185AR.d.11.1 | M00001579D:C03 | 6539 |
| 4266 | Jan. 28, 1998 | 190 | RTA00000134A.c.7.1 | M00001528A:A01 | 5175 |
| 4266 | Jan. 28, 1998 | 176 | RTA00000183AF.h.19.1 | M00001528A:A01 | 5175 |
| 4267 | Mar. 24, 1998 | 90 | RTA00000525F.a.03.1 | M00004031D:F05 | 36786 |
| 4268 | Mar. 24, 1998 | 236 | RTA00000527F.o.01.1 | M00004027A:D06 | 19088 |
| 4269 | Mar. 24, 1998 | 339 | RTA00000426F.m.03.1 | M00004034C:E08 | 66480 |
| 4270 | Jan. 28, 1998 | 183 | RTA00000198AF.c.17.1 | M00001579C:E08 | 6923 |
| 4271 | Mar. 24, 1998 | 44 | RTA00000527F.p.17.1 | M00004030C:D12 | 17223 |
| 4272 | Mar. 24, 1998 | 129 | RTA00000527F.p.18.1 | M00004030D:B06 | 31635 |
| 4273 | Mar. 24, 1998 | 402 | RTA00000527F.p.24.1 | M00004031B:A06 | 36832 |
| 4274 | Mar. 24, 1998 | 118 | RTA00000525F.a.02.1 | M00004031C:H10 | 37454 |
| 4275 | Jan. 28, 1998 | 353 | RTA00000198F.a.9.1 | M00001557D:C08 | 0 |
| 4276 | Feb. 24, 1998 | 1250 | RTA00000403F.f.15.1 | M00001477D:F10 | 22768 |
| 4277 | Jan. 28, 1998 | 131 | RTA00000185AF.d.11.2 | M00001579D:C03 | 6539 |
| 4277 | Jan. 28, 1998 | 626 | RTA00000185AR.d.11.1 | M00001579D:C03 | 6539 |
| 4278 | Feb. 24, 1998 | 428 | RTA00000422F.f.14.1 | M00001478B:D07 | 2036 |
| 4279 | Jan. 28, 1998 | 209 | RTA00000182AF.c.5.1 | M00001464D:F06 | 6397 |
| 4279 | Jan. 28, 1998 | 304 | RTA00000182AR.c.5.1 | M00001464D:F06 | 6397 |
| 4280 | Feb. 24, 1998 | 205 | RTA00000138A.n.4.1 | M00001624A:G11 | 21920 |
| 4281 | Feb. 24, 1998 | 251 | RTA00000119A.i.9.1 | M00001457A:G03 | 0 |
| 4282 | Mar. 24, 1998 | 250 | RTA00000427F.h.24.1 | M00004091B:H09 | 65193 |
| 4283 | Jan. 28, 1998 | 61 | RTA00000197AF.h.11.1 | M00001476D:G03 | 22264 |
| 4284 | Mar. 24, 1998 | 216 | RTA00000427F.h.11.1 | M00004092C:B12 | 26494 |
| 4285 | Jan. 28, 1998 | 110 | RTA00000197R.h.01.1 | M00001470A:H01 | 13075 |
| 4285 | Jan. 28, 1998 | 591 | RTA00000197AF.h.1.1 | M00001470A:H01 | 13075 |
| 4286 | Jan. 28, 1998 | 110 | RTA00000197R.h.01.1 | M00001470A:H01 | 13075 |
| 4286 | Jan. 28, 1998 | 591 | RTA00000197AF.h.1.1 | M00001470A:H01 | 13075 |
| 4287 | Mar. 24, 1998 | 276 | RTA00000427F.h.19.1 | M00004092D:B11 | 63047 |
| 4288 | Jan. 28, 1998 | 335 | RTA00000182AF.e.3.2 | M00001468B:H06 | 0 |
| 4289 | Mar. 24, 1998 | 475 | RTA00000427F.i.06.1 | M00004097B:D03 | 41450 |
| 4290 | Feb. 24, 1998 | 286 | RTA00000404F.i.19.1 | M00001625B:C10 | 38698 |
| 4291 | Jan. 28, 1998 | 209 | RTA00000182AF.c.5.1 | M00001464D:F06 | 6397 |
| 4291 | Jan. 28, 1998 | 304 | RTA00000182AR.c.5.1 | M00001464D:F06 | 6397 |
| 4292 | Feb. 24, 1998 | 1165 | RTA00000408F.c.08.1 | M00001456D:G11 | 73473 |
| 4293 | Jan. 28, 1998 | 304 | RTA00000182AR.c.5.1 | M00001464D:F06 | 6397 |
| 4293 | Jan. 28, 1998 | 209 | RTA00000182AF.c.5.1 | M00001464D:F06 | 6397 |
| 4294 | Jan. 28, 1998 | 138 | RTA00000182AF.a.3.3 | M00001462B:A10 | 0 |
| 4295 | Jan. 28, 1998 | 36 | RTA00000181AF.p.4.3 | M00001460A:A03 | 40392 |
| 4296 | Feb. 24, 1998 | 523 | RTA00000418F.j.09.1 | M00001626C:D12 | 76352 |
| 4297 | Feb. 24, 1998 | 296 | RTA00000347F.d.06.1 | M00001457C:F02 | 39122 |
| 4298 | Jan. 28, 1998 | 390 | RTA00000197AR.f.07.1 | M00001457C:C11 | 19261 |
| 4298 | Jan. 28, 1998 | 184 | RTA00000197AF.f.7.1 | M00001457C:C11 | 19261 |
| 4299 | Jan. 28, 1998 | 184 | RTA00000197AF.f.7.1 | M00001457C:C11 | 19261 |
| 4299 | Jan. 28, 1998 | 390 | RTA00000197AR.f.07.1 | M00001457C:C11 | 19261 |
| 4300 | Jan. 28, 1998 | 133 | RTA00000181AR.n.20.3 | M00001457B:E03 | 0 |
| 4301 | Mar. 24, 1998 | 132 | RTA00000427F.k.17.1 | M00004101A:F07 | 64965 |
| 4302 | Mar. 24, 1998 | 218 | RTA00000427F.i.19.1 | M00004102C:D01 | 64206 |
| 4303 | Mar. 24, 1998 | 436 | RTA00000427F.i.21.1 | M00004102C:F03 | 65540 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4304 | Jan. 28, 1998 | 209 | RTA00000182AF.c.5.1 | M00001464D:F06 | 6397 |
| 4304 | Jan. 28, 1998 | 304 | RTA00000182AR.c.5.1 | M00001464D:F06 | 6397 |
| 4305 | Jan. 28, 1998 | 176 | RTA00000183AF.h.19.1 | M00001528A:A01 | 5175 |
| 4305 | Jan. 28, 1998 | 190 | RTA00000134A.c.7.1 | M00001528A:A01 | 5175 |
| 4306 | Jan. 28, 1998 | 12 | RTA00000183AF.i.15.2 | M00001529B:C04 | 2642 |
| 4306 | Feb. 24, 1998 | 379 | RTA00000349R.j.07.1 | M00001529B:C04 | 2642 |
| 4307 | Feb. 24, 1998 | 1156 | RTA00000408F.f.10.2 | M00001476D:C05 | 75309 |
| 4308 | Feb. 24, 1998 | 366 | RTA00000403F.c.10.1 | M00001456D:F05 | 75261 |
| 4309 | Feb. 24, 1998 | 353 | RTA00000409F.n.17.1 | M00001621C:C10 | 76725 |
| 4310 | Feb. 24, 1998 | 526 | RTA00000411F.a.05.1 | M00001675B:H03 | 76699 |
| 4311 | Feb. 24, 1998 | 90 | RTA00000411F.a.02.1 | M00001675B:E02 | 78537 |
| 4312 | Feb. 24, 1998 | 952 | RTA00000411F.a.01.1 | M00001675B:D02 | 74524 |
| 4313 | Feb. 24, 1998 | 392 | RTA00000410F.p.23.1 | M00001675B:C01 | 73948 |
| 4314 | Feb. 24, 1998 | 238 | RTA00000340F.j.12.1 | M00001624A:B06 | 3277 |
| 4315 | Jan. 28, 1998 | 176 | RTA00000183AF.h.19.1 | M00001528A:A01 | 5175 |
| 4315 | Jan. 28, 1998 | 190 | RTA00000134A.c.7.1 | M00001528A:A01 | 5175 |
| 4316 | Feb. 24, 1998 | 298 | RTA00000406F.h.07.1 | M00003901B:H04 | 38003 |
| 4317 | Jan. 28, 1998 | 190 | RTA00000134A.c.7.1 | M00001528A:A01 | 5175 |
| 4317 | Jan. 28, 1998 | 176 | RTA00000183AF.h.19.1 | M00001528A:A01 | 5175 |
| 4318 | Jan. 28, 1998 | 12 | RTA00000183AF.i.15.2 | M00001529B:C04 | 2642 |
| 4318 | Feb. 24, 1998 | 379 | RTA00000349R.j.07.1 | M00001529B:C04 | 2642 |
| 4319 | Jan. 28, 1998 | 122 | RTA00000197AF.l.15.1 | M00001517B:G08 | 4947 |
| 4320 | Mar. 24, 1998 | 199 | RTA00000427F.f.24.1 | M00004076D:B09 | 64572 |
| 4321 | Jan. 28, 1998 | 161 | RTA00000183AF.e.23.2 | M00001506D:A09 | 0 |
| 4322 | Jan. 28, 1998 | 17 | RTA00000183AR.e.14.2 | M00001506B:D09 | 17437 |
| 4323 | Jan. 28, 1998 | 346 | RTA00000197AR.k.22.1 | M00001505C:H01 | 11394 |
| 4324 | Jan. 28, 1998 | 125 | RTA00000197AF.k.15.1 | M00001504D:D11 | 22750 |
| 4325 | Jan. 28, 1998 | 212 | RTA00000197AF.j.9.1 | M00001494B:C01 | 13236 |
| 4326 | Jan. 28, 1998 | 314 | RTA00000182AF.o.5.1 | M00001493B:D09 | 5007 |
| 4327 | Jan. 28, 1998 | 386 | RTA00000197AR.j.04.1 | M00001492D:A11 | 17209 |
| 4327 | Jan. 28, 1998 | 259 | RTA00000197AF.j.4.1 | M00001492D:A11 | 17209 |
| 4328 | Jan. 28, 1998 | 259 | RTA00000197AF.j.4.1 | M00001492D:A11 | 17209 |
| 4328 | Jan. 28, 1998 | 386 | RTA00000197AR.j.04.1 | M00001492D:A11 | 17209 |
| 4329 | Jan. 28, 1998 | 94 | RTA00000195AF.b.4.1 | M00001490C:D07 | 0 |
| 4330 | Jan. 28, 1998 | 336 | RTA00000186AF.f.24.1 | M00001629B:E06 | 0 |
| 4330 | Jan. 28, 1998 | 83 | RTA00000186AF.f.24.2 | M00001629B:E06 | 0 |
| 4331 | Feb. 24, 1998 | 1037 | RTA00000339F.l.12.1 | M00001450A:G11 | 7711 |
| 4332 | Jan. 28, 1998 | 432 | RTA00000198AF.o.05.1 | M00003750A:D01 | 26702 |
| 4332 | Jan. 28, 1998 | 49 | RTA00000198R.o.05.1 | M00003750A:D01 | 26702 |
| 4333 | Feb. 24, 1998 | 468 | RTA00000423F.c.19.1 | M00001680B:E10 | 40472 |
| 4334 | Feb. 24, 1998 | 1009 | RTA00000399F.o.24.1 | M00001607D:A11 | 2272 |
| 4335 | Jan. 28, 1998 | 281 | RTA00000188AF.n.10.1 | M00003802D:B11 | 10283 |
| 4336 | Jan. 28, 1998 | 157 | RTA00000188AF.n.01.1 | M00003801A:B10 | 36412 |
| 4337 | Feb. 24, 1998 | 842 | RTA00000401F.n.23.1 | M00003982A:B06 | 1552 |
| 4338 | Feb. 24, 1998 | 1216 | RTA00000404F.e.07.1 | M00001608A:D03 | 9034 |
| 4339 | Feb. 24, 1998 | 1045 | RTA00000408F.j.05.2 | M00001483C:G06 | 73878 |
| 4340 | Feb. 24, 1998 | 483 | RTA00000406F.g.22.1 | M00003881D:C12 | 38590 |
| 4341 | Jan. 28, 1998 | 310 | RTA00000188AF.m.08.1 | M00063798D:H08 | 22155 |
| 4342 | Jan. 28, 1998 | 118 | RTA00000199F.b.24.2 | M00003794A:B03 | 0 |
| 4343 | Jan. 28, 1998 | 218 | RTA00000188AF.o.18.1 | M00003811D:A12 | 13678 |
| 4344 | Mar. 24, 1998 | 380 | RTA00000427F.e.13.1 | M00003959D:A04 | 66080 |
| 4345 | Jan. 28, 1998 | 315 | RTA00000199R.d.23.1 | M00003815D:H09 | 37477 |
| 4346 | Jan. 28, 1998 | 140 | RTA00000199F.a.2.1 | M00003772A:D07 | 12674 |
| 4347 | Mar. 24, 1998 | 101 | RTA00000523F.j.19.1 | M00003966B:D02 | 65910 |
| 4348 | Jan. 28, 1998 | 278 | RTA00000198AF.p.16.1 | M00003768A:E02 | 71877 |
| 4349 | Feb. 24, 1998 | 514 | RTA00000404F.e.13.1 | M00001608D:E09 | 12046 |
| 4350 | Jan. 28, 1998 | 508 | RTA00000187AF.i.14.2 | M00001679B:H07 | 19406 |
| 4350 | Feb. 24, 1998 | 928 | RTA00000340F.m.04.1 | M00001679B:H07 | 19406 |
| 4351 | Jan. 28, 1998 | 317 | RTA00000198AF.p.09.1 | M00003761D:E02 | 10473 |
| 4351 | Jan. 28, 1998 | 186 | RTA00000198R.p.09.1 | M00003761D:E02 | 10473 |
| 4352 | Jan. 28, 1998 | 317 | RTA00000198AF.p.09.1 | M00003761D:E02 | 10473 |
| 4352 | Jan. 28, 1998 | 186 | RTA00000198R.p.09.1 | M00003761D:E02 | 10473 |
| 4353 | Mar. 24, 1998 | 66 | RTA00000427F.b.15.1 | M00003971C:F09 | 66891 |
| 4354 | Mar. 24, 1998 | 508 | RTA00000187AF.i.14.2 | M00001679B:H07 | 19406 |
| 4354 | Feb. 24, 1998 | 928 | RTA00000340F.m.04.1 | M00001679B:H07 | 19406 |
| 4355 | Jan. 28, 1998 | 144 | RTA00000198AF.o.18.1 | M00003755A:A09 | 13018 |
| 4356 | Mar. 24, 1998 | 248 | RTA00000527F.l.14.1 | M00003983D:A09 | 14935 |
| 4357 | Jan. 28, 1998 | 347 | RTA00000199F.b.03.2 | M00003779B:E12 | 38340 |
| 4358 | Jan. 28, 1998 | 272 | RTA00000199F.g.08.2 | M00003853D:G08 | 0 |
| 4359 | Jan. 28, 1998 | 263 | RTA00000190AF.n.6.1 | M00003965A:B11 | 0 |
| 4360 | Feb. 24, 1998 | 1183 | RTA00000346F.j.21.1 | M00003879D:A08 | 3095 |
| 4361 | Feb. 24, 1998 | 553 | RTA00000408F.j.12.2 | M00001485B:C03 | 18226 |
| 4362 | Mar. 24, 1998 | 181 | RTA00000523F.b.06.1 | M00003808A:F09 | 28736 |
| 4363 | Jan. 28, 1998 | 246 | RTA00000199AF.l.4.1 | M00003911D:B04 | 4410 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4364 | Jan. 28, 1998 | 51 | RTA00000199R.k.07.1 | M00003901C:A03 | 12973 |
| 4365 | Jan. 28, 1998 | 62 | RTA00000190AF.a.18.2 | M00003900D:B10 | 0 |
| 4366 | Jan. 28, 1998 | 117 | RTA00000199AF.j.18.1 | M00003889D:B09 | 5140 |
| 4367 | Jan. 28, 1998 | 255 | RTA00000199AF.j.17.1 | M00003889A:D10 | 5121 |
| 4368 | Jan. 28, 1998 | 180 | RTA00000199AF.j.12.1 | M00003887A:A06 | 22461 |
| 4369 | Mar. 24, 1998 | 256 | RTA00000523F.b.20.1 | M00003809C:H07 | 66492 |
| 4370 | Feb. 24, 1998 | 603 | RTA00000399F.o.19.1 | M00001607A:F11 | 2594 |
| 4371 | Feb. 24, 1998 | 510 | RTA00000131A.g.16.2 | M00001449A:F01 | 0 |
| 4372 | Jan. 28, 1998 | 49 | RTA00000198R.o.05.1 | M00003750A:D01 | 26702 |
| 4372 | Jan. 28, 1998 | 432 | RTA00000198AF.o.05.1 | M00003750A:D01 | 26702 |
| 4373 | Feb. 24, 1998 | 424 | RTA00000138A.e.13.1 | M00001605A:E06 | 79608 |
| 4374 | Jan. 28, 1998 | 90 | RTA00000199F.f.15.2 | M00003845A:H12 | 8772 |
| 4375 | Jan. 28, 1998 | 244 | RTA00000199F.f.12.2 | M00003844C:A08 | 8131 |
| 4376 | Jan. 28, 1998 | 78 | RTA00000199R.f.09.1 | M00003842B:D09 | 22907 |
| 4376 | Jan. 28, 1998 | 406 | RTA00000199F.f.09.2 | M00003842B:D09 | 22907 |
| 4377 | Jan. 28, 1998 | 406 | RTA00000199F.f.09.2 | M00003842B:D09 | 22907 |
| 4377 | Jan. 28, 1998 | 78 | RTA00000199R.f.09.1 | M00003842B:D09 | 22907 |
| 4378 | Jan. 28, 1998 | 44 | RTA00000199F.f.08.2 | M00003841D:E03 | 12445 |
| 4379 | Jan. 28, 1998 | 39 | RTA00000189AR.b.19.1 | M00003832B:E01 | 5294 |
| 4379 | Feb. 24, 1998 | 239 | RTA00000346F.j.02.1 | M00003832B:E01 | 5294 |
| 4380 | Jan. 28, 1998 | 39 | RTA00000189AR.b.19.1 | M00003832B:E01 | 5294 |
| 4380 | Feb. 24, 1998 | 239 | RTA00000346F.j.02.1 | M00003832B:E01 | 5294 |
| 4381 | Feb. 24, 1998 | 1161 | RTA00000346F.m.05.1 | M00003983B:C08 | 5644 |
| 4382 | Feb. 24, 1998 | 887 | RTA00000339F.p.06.1 | M00001484A:A10 | 4880 |
| 4383 | Mar. 24, 1998 | 46 | RTA00000523F.c.09.1 | M00003813C:D08 | 47389 |
| 4384 | Feb. 24, 1998 | 1206 | RTA00000418F.b.20.1 | M00001484D:G05 | 73560 |
| 4385 | Jan. 28, 1998 | 336 | RTA00000186AF.f.24.1 | M00001629B:E06 | 0 |
| 4385 | Jan. 28, 1998 | 83 | RTA00000186AF.f.24.2 | M00001629B:E06 | 0 |
| 4386 | Jan. 28, 1998 | 111 | RTA00000198AF.o.12.1 | M00003751D:B02 | 22038 |
| 4387 | Mar. 24, 1998 | 365 | RTA00006527F.k.16.1 | M00003982B:B06 | 1015 |
| 4388 | Feb. 24, 1998 | 1113 | RTA00000418F.p.21.1 | M00001677D:F03 | 78068 |
| 4389 | Mar. 24, 1998 | 281 | RTA00000527F.k.20.1 | M00003982B:H07 | 17148 |
| 4390 | Jan. 28, 1998 | 360 | RTA00000198F.i.5.1 | M00001638A:D10 | 39989 |
| 4391 | Jan. 28, 1998 | 55 | RTA00000186AF.i.21.1 | M00001636C:H09 | 6033 |
| 4392 | Jan. 28, 1998 | 316 | RTA00000198AF.h.24.1 | M00001636C:C01 | 8390 |
| 4393 | Jan. 28, 1998 | 208 | RTA00000198AF.h.22.1 | M00001635C:A03 | 22366 |
| 4394 | Feb. 24, 1998 | 1031 | RTA00000404F.g.08.1 | M00001613D:H10 | 38980 |
| 4395 | Mar. 24, 1998 | 382 | RTA00000427F.a.12.1 | M00003982C:H10 | 63377 |
| 4396 | Feb. 24, 1998 | 916 | RTA00000418F.p.20.1 | M00001677D:B07 | 78023 |
| 4397 | Jan. 28, 1998 | 91 | RTA00000198AF.j.19.1 | M00001653C:F12 | 38914 |
| 4398 | Feb. 24, 1998 | 858 | RTA00000341F.e.20.1 | M00003891D:B10 | 67422 |
| 4399 | Jan. 28, 1998 | 354 | RTA00000198R.k.03.1 | M00001655A:F06 | 22765 |
| 4399 | Jan. 28, 1998 | 158 | RTA00000198AF.k.03.1 | M00001655A:F06 | 22765 |
| 4400 | Mar. 24, 1998 | 219 | RTA00000427F.f.17.1 | M00004115A:B12 | 63803 |
| 4401 | Mar. 24, 1998 | 153 | RTA00000527F.l.13.1 | M00003983C:F10 | 36904 |
| 4402 | Mar. 24, 1998 | 320 | RTA00000427F.j.06.1 | M00004102D:B05 | 63676 |
| 4403 | Feb. 24, 1998 | 762 | RTA00000411F.c.04.1 | M00001677B:E06 | 76858 |
| 4404 | Feb. 24, 1998 | 957 | RTA00000411F.c.03.1 | M00001677B:B06 | 79280 |
| 4405 | Mar. 24, 1998 | 479 | RTA00000527F.l.23.1 | M00003984A:B06 | 36018 |
| 4406 | Jan. 28, 1998 | 329 | RTA00000186AF.b.9.1 | M00001616C:F07 | 0 |
| 4407 | Feb. 24, 1998 | 1115 | RTA00000340F.i.08.1 | M00001615B:F07 | 12005 |
| 4408 | Feb. 24, 1998 | 1022 | RTA00000401F.j.15.1 | M00003901A:C09 | 3061 |
| 4409 | Jan. 28, 1998 | 4 | RTA00000198R.f.04.1 | M00001607D:F07 | 5023 |
| 4410 | Mar. 24, 1998 | 173 | RTA00000426F.m.18.1 | M00003986D:G07 | 62974 |
| 4411 | Feb. 24, 1998 | 616 | RTA00000423F.c.11.1 | M00001677D:B02 | 0 |
| 4412 | Jan. 28, 1998 | 345 | RTA00000187AF.h.21.1 | M00001679A:F01 | 39171 |
| 4413 | Feb. 24, 1998 | 621 | RTA00004118F.i.18.2 | M00001482C:D02 | 74410 |
| 4414 | Jan. 28, 1998 | 344 | RTA00000198AF.o.02.1 | M00003748A:B07 | 68756 |
| 4415 | Feb. 24, 1998 | 257 | RTA00000411F.c.17.1 | M00001678D:G03 | 77664 |
| 4416 | Feb. 24, 1998 | 944 | RTA00000422F.k.24.1 | M00001610C:E06 | 39118 |
| 4417 | Feb. 24, 1998 | 876 | RTA00000423F.d.16.1 | M00001678D:C11 | 39173 |
| 4418 | Feb. 24, 1998 | 1144 | RTA00000345F.j.09.1 | M00001451B:F01 | 13 |
| 4419 | Jan. 28, 1998 | 242 | RTA00000198AF.m.17.1 | M00001679D:F06 | 77992 |
| 4419 | Jan. 28, 1998 | 260 | RTA00000198R.m.17.1 | M00001679D:F06 | 77992 |
| 4420 | Jan. 28, 1998 | 260 | RTA00000198R.m.17.1 | M00001679D:F06 | 77992 |
| 4420 | Jan. 28, 1998 | 242 | RTA00000198AF.m.17.1 | M00001679D:F06 | 77992 |
| 4421 | Jan. 28, 1998 | 242 | RTA00000198AF.m.17.1 | M00001679D:F06 | 77992 |
| 4421 | Jan. 28, 1998 | 260 | RTA00000198R.m.17.1 | M00001679D:F06 | 77992 |
| 4422 | Jan. 28, 1998 | 260 | RTA00000198R.m.17.1 | M00001679D:F06 | 77992 |
| 4422 | Jan. 28, 1998 | 242 | RTA00000198AF.m.17.1 | M00001679D:F06 | 77992 |
| 4423 | Jan. 28, 1998 | 238 | RTA00000187AR.k.12.1 | M00001679D:F02 | 78415 |
| 4423 | Feb. 24, 1998 | 407 | RTA00000340R.m.07.1 | M00001679D:F02 | 78415 |
| 4424 | Jan. 28, 1998 | 276 | RTA00000198AF.j.15.1 | M00001653B:E09 | 4369 |
| 4425 | Jan. 28, 1998 | 65 | RTA00000198AF.m.16.1 | M00001679D:D05 | 51 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4426 | Jan. 28, 1998 | 257 | RTA00000198AF.e.20.1 | M00001604C:E09 | 9810 |
| 4427 | Feb. 24, 1998 | 820 | RTA00000423F.d.11.1 | M00001678C:C06 | 38950 |
| 4428 | Mar. 24, 1998 | 466 | RTA00000427F.d.06.1 | M00003980B:C06 | 33446 |
| 4429 | Feb. 24, 1998 | 455 | RTA00000399F.d.23.1 | M00001481B:A07 | 3310 |
| 4430 | Feb. 24, 1998 | 851 | RTA00000423F.d.07.1 | M00001678B:B12 | 0 |
| 4431 | Jan. 28, 1998 | 142 | RTA00000198AF.k.19.1 | M00001660B:C04 | 75879 |
| 4432 | Feb. 24, 1998 | 485 | RTA00000419F.a.02.1 | M00001678A:F05 | 77993 |
| 4433 | Mar. 24, 1998 | 224 | RTA00000527F.k.09.1 | M00003981C:F05 | 213 |
| 4434 | Feb. 24, 1998 | 1032 | RTA00000423F.c.13.1 | M00001678A:A11 | 39059 |
| 4435 | Jan. 28, 1998 | 354 | RTA00000198R.k.03.1 | M00001655A:F06 | 22765 |
| 4435 | Jan. 28, 1998 | 158 | RTA00000198AF.k.03.1 | M00001655A:F06 | 22765 |
| 4436 | Jan. 28, 1998 | 354 | RTA00000198R.k.03.1 | M00001655A:F06 | 22765 |
| 4436 | Jan. 28, 1998 | 158 | RTA00000198AF.k.03.1 | M00001655A:F06 | 22765 |
| 4437 | Jan. 28, 1998 | 158 | RTA00000198AF.k.03.1 | M00001655A:F06 | 22765 |
| 4437 | Jan. 28, 1998 | 354 | RTA00000198R.k.03.1 | M00001655A:F06 | 22765 |
| 4438 | Jan. 28, 1998 | 238 | RTA00000187AR.k.12.1 | M00001679D:F02 | 78415 |
| 4438 | Feb. 24, 1998 | 407 | RTA00000340R.m.07.1 | M00001679D:F02 | 78415 |
| 4439 | Jan. 28, 1998 | 669 | RTA00000192AF.c.2.1 | M00004121B:G01 | 0 |
| 4440 | Mar. 24, 1998 | 394 | RTA00000527F.g.14.1 | M00003845D:B02 | 37532 |
| 4441 | Jan. 28, 1998 | 608 | RTA0000092AF.p.8.1 | M00004212B:C07 | 2379 |
| 4441 | Feb. 24, 1998 | 653 | RTA00000352R.m.12.1 | M00004212B:C07 | 2379 |
| 4442 | Jan. 28, 1998 | 608 | RTA00000192AF.p.8.1 | M00004212B:C07 | 2379 |
| 4442 | Feb. 24, 1998 | 653 | RTA00000352R.m.12.1 | M00004212B:C07 | 2379 |
| 4443 | Jan. 28, 1998 | 730 | RTA00000192AF.o.11.1 | M00004205D:F06 | 0 |
| 4444 | Feb. 24, 1998 | 1157 | RTA00000422F.m.18.1 | M00001647B:E04 | 23829 |
| 4445 | Feb. 24, 1998 | 1187 | RTA00000120A.c.19.1 | M00001464A:B03 | 81016 |
| 4446 | Feb. 24, 1998 | 913 | RTA00000120A.c.20.1 | M00001464A:B07 | 43235 |
| 4447 | Jan. 28, 1998 | 589 | RTA00000192AF.l.1.1 | M00004183C:D07 | 16392 |
| 4448 | Feb. 24, 1998 | 640 | RTA00000405F.f.02.1 | M00001669B:G02 | 38665 |
| 4449 | Jan. 28, 1998 | 27 | RTA00000192AF.i.12.1 | M00004169C:C12 | 5319 |
| 4450 | Feb. 24, 1998 | 681 | RTA00000120A.c.24.1 | M00001464A:D03 | 34278 |
| 4451 | Feb. 24, 1998 | 265 | RTA00000340F.k.16.1 | M00001647B:C09 | 13157 |
| 4452 | Jan. 28, 1998 | 70 | RTA00000192AF.e.3.1 | M00004138B:H02 | 13272 |
| 4453 | Mar. 24, 1998 | 171 | RTA00000523F.e.10.1 | M00003829A:F03 | 62878 |
| 4454 | Feb. 24, 1998 | 1134 | RTA00000418F.m.02.1 | M00001650A:A12 | 74550 |
| 4455 | Jan. 28, 1998 | 618 | RTA00000192AF.a.14.1 | M00004111D:A08 | 6874 |
| 4456 | Jan. 28, 1998 | 457 | RTA00000191AR.l.7.2 | M00004081C:D12 | 14391 |
| 4457 | Feb. 24, 1998 | 596 | RTA00000351R.i.03.1 | M00003846B:D06 | 6874 |
| 4458 | Mar. 24, 1998 | 460 | RTA00000523F.f.16.1 | M00003840B:E07 | 26522 |
| 4459 | Mar. 24, 1998 | 400 | RTA00000523F.f.17.1 | M00003840B:E08 | 63984 |
| 4460 | Feb. 24, 1998 | 1129 | RTA00000401F.m.07.1 | M00003907D:F11 | 2893 |
| 4461 | Feb. 24, 1998 | 132 | RTA00000418F.m.05.1 | M00001650B:C10 | 73600 |
| 4462 | Jan. 28, 1998 | 482 | RTA00000187AF.j.7.1 | M00001679C:F01 | 78091 |
| 4463 | Feb. 24, 1998 | 1107 | RTA00000419F.l.22.1 | M00003903D:C06 | 78444 |
| 4464 | Feb. 24, 1998 | 609 | RTA00000404F.o.10.2 | M00001651B:B12 | 16785 |
| 4465 | Jan. 28, 1998 | 376 | RTA00000177AF.m.18.3 | M00001355B:G11 | 0 |
| 4465 | Jan. 28, 1998 | 375 | RTA00000177AF.m.18.1 | M00001355B:G11 | 0 |
| 4466 | Feb. 24, 1998 | 186 | RTA00000132A.k.6.1 | M00001464A:E07 | 81284 |
| 4467 | Jan. 28, 1998 | 18 | RTA00000196AF.c.17.1 | M00001352C:F06 | 39602 |
| 4468 | Mar. 24, 1998 | 282 | RTA00000427F.h.22.1 | M00004108C:E01 | 64547 |
| 4469 | Feb. 24, 1998 | 859 | RTA00000419F.m.22.1 | M00003914A:G09 | 75600 |
| 4470 | Mar. 24, 1998 | 33 | RTA00000524F.b.21.1 | M00005216C:B09 | 0 |
| 4471 | Mar. 24, 1998 | 170 | RTA00000523F.d.12.1 | M00003822B:D08 | 64888 |
| 4472 | Mar. 24, 1998 | 117 | RTA00000523F.d.18.1 | M00003822B:G01 | 64072 |
| 4473 | Feb. 24, 1998 | 739 | RTA00000423F.h.20.1 | M00003914A:G06 | 38639 |
| 4474 | Feb. 24, 1998 | 527 | RTA00000419F.m.21.1 | M00003914A:E04 | 77947 |
| 4475 | Feb. 24, 1998 | 237 | RTA00000119A.j.22.1 | M00001460A:F07 | 80336 |
| 4476 | Feb. 24, 1998 | 349 | RTA00000404F.m.10.2 | M00001641D:E02 | 779 |
| 4477 | Feb. 24, 1998 | 462 | RTA00000119A.j.23.1 | M00001460A:G07 | 79835 |
| 4478 | Feb. 24, 1998 | 1263 | RTA00000341F.i.22.1 | M00003911A:F10 | 7825 |
| 4479 | Mar. 24, 1998 | 47 | RTA00000523F.e.18.1 | M00003829D:A11 | 62898 |
| 4480 | Jan. 28, 1998 | 152 | RTA00000196AF.c.20.1 | M00001352C:H02 | 8934 |
| 4481 | Mar. 24, 1998 | 13 | RTA00000528F.m.16.1 | M00003845D:C03 | 4468 |
| 4482 | Jan. 28, 1998 | 14 | RTA00000196R.c.11.2 | M00001352A:E12 | 13658 |
| 4483 | Feb. 24, 1998 | 641 | RTA00000410F.j.20.1 | M00001642D:G10 | 73601 |
| 4484 | Jan. 28, 1998 | 141 | RTA00000196AF.c.6.1 | M00001350A:D06 | 23148 |
| 4485 | Jan. 28, 1998 | 25 | RTA00000196AF.c.1.1 | M00001349C:C05 | 8171 |
| 4486 | Feb. 24, 1998 | 436 | RTA00000119A.m.15.1 | M00001461A:E05 | 80989 |
| 4487 | Jan. 28, 1998 | 9 | RTA00000177AF.g.22.1 | M00001347C:G08 | 7031 |
| 4488 | Feb. 24, 1998 | 162 | RTA00000406F.l.08.1 | M00003908D:D12 | 39016 |
| 4489 | Feb. 24, 1998 | 1056 | RTA00000419F.m.18.1 | M00003908C:G09 | 76014 |
| 4490 | Jan. 28, 1998 | 73 | RTA00000177AF.e.21.3 | M00001344A:H07 | 4306 |
| 4491 | Mar. 24, 1998 | 326 | RTA00000527F.e.09.1 | M00003826B:E11 | 37521 |
| 4492 | Feb. 24, 1998 | 900 | RTA00000419F.m.13.1 | M00003908A:F12 | 79052 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4493 | Feb. 24, 1998 | 441 | RTA00000404F.m.20.2 | M00001647A:H08 | 39144 |
| 4494 | Feb. 24, 1998 | 1217 | RTA00000410F.j.17.1 | M00001642D:F02 | 72912 |
| 4495 | Mar. 24, 1998 | 309 | RTA00000523F.j.10.1 | M00003860B:G09 | 63384 |
| 4496 | Feb. 24, 1998 | 385 | RTA00000418F.m.14.1 | M00001651B:E06 | 75711 |
| 4497 | Feb. 24, 1998 | 1121 | RTA00000120A.m.10.3 | M00001467A:B03 | 81376 |
| 4498 | Jan. 28, 1998 | 617 | RTA00000179AF.d.13.3 | M00001394A:F01 | 6583 |
| 4499 | Feb. 24, 1998 | 1242 | RTA00000405F.d.10.1 | M00001661C:F11 | 39000 |
| 4500 | Mar. 24, 1998 | 19 | RTA00000527F.j.02.2 | M00003856A:B07 | 4896 |
| 4501 | Feb. 24, 1998 | 645 | RTA00000422F.p.12.2 | M00001661C:F10 | 9840 |
| 4502 | Mar. 24, 1998 | 142 | RTA00000523F.i.18.1 | M00003856B:C04 | 64463 |
| 4503 | Feb. 24, 1998 | 376 | RTA00000400F.k.22.1 | M00001656A:B07 | 2512 |
| 4504 | Jan. 28, 1998 | 532 | RTA00000177AF.o.4.1 | M00001358C:C06 | 0 |
| 4505 | Feb. 24, 1998 | 1128 | RTA00000423F.a.02.3 | M00001656B:A08 | 39210 |
| 4506 | Feb. 24, 1998 | 1143 | RTA00000423F.a.03.1 | M00001656B:D05 | 26796 |
| 4507 | Feb. 24, 1998 | 408 | RTA00000405F.d.14.1 | M00001662A:C12 | 35209 |
| 4508 | Mar. 24, 1998 | 360 | RTA00000523F.j.03.1 | M00003860A:A08 | 64535 |
| 4509 | Jan. 28, 1998 | 409 | RTA00000180AF.d.1.3 | M00001418D:B06 | 8526 |
| 4510 | Feb. 24, 1998 | 784 | RTA00000418F.o.14.1 | M00001661B:B05 | 33524 |
| 4511 | Mar. 24, 1998 | 120 | RTA00000426F.h.09.1 | M00003905B:G03 | 78797 |
| 4512 | Jan. 28, 1998 | 706 | RTA00000177AF.i.6.4 | M00001350A:B08 | 0 |
| 4513 | Mar. 24, 1998 | 4 | RTA00000426F.h.11.1 | M00003905B:H05 | 75479 |
| 4514 | Feb. 24, 1998 | 697 | RTA00000412F.d.14.1 | M00003905D:C08 | 76757 |
| 4515 | Feb. 24, 1998 | 908 | RTA00000423F.g.03.1 | M00003905C:G11 | 38007 |
| 4516 | Mar. 24, 1998 | 342 | RTA00000427F.e.12.1 | M00003959C:G06 | 62813 |
| 4517 | Feb. 24, 1998 | 97 | RTA00000403F.e.01.1 | M00001473A:C11 | 38965 |
| 4518 | Feb. 24, 1998 | 555 | RTA00000133A.d.22.1 | M00001469A:G11 | 11797 |
| 4519 | Feb. 24, 1998 | 454 | RTA00000418F.n.19.1 | M00001659C:F02 | 28761 |
| 4520 | Feb. 24, 1998 | 562 | RTA00000401F.j.17.1 | M00003901B:C05 | 5483 |
| 4521 | Feb. 24, 1998 | 1215 | RTA00000422F.o.08.2 | M00001659D:D03 | 26832 |
| 4522 | Feb. 24, 1998 | 635 | RTA00000418F.o.17.1 | M00001661B:F03 | 79069 |
| 4523 | Mar. 24, 1998 | 190 | RTA00000523F.h.12.1 | M00003851C:D07 | 65745 |
| 4524 | Jan. 28, 1998 | 267 | RTA00000186AF.g.11.2 | M00001630B:H09 | 5214 |
| 4525 | Feb. 24, 1998 | 238 | RTA00000340F.j.12.1 | M00001624A:B06 | 3277 |
| 4526 | Feb. 24, 1998 | 331 | RTA00000404F.o.18.2 | M00001651C:C05 | 39110 |
| 4527 | Jan. 28, 1998 | 626 | RTA00000185AR.d.11.1 | M00001579D:C03 | 6539 |
| 4527 | Jan. 28, 1998 | 131 | RTA00000185AF.d.11.2 | M00001579D:C03 | 6539 |
| 4528 | Jan. 28, 1998 | 626 | RTA00000185AR.d.11.1 | M00001579D:C03 | 6539 |
| 4528 | Jan. 28, 1998 | 131 | RTA00000185AF.d.11.2 | M00001579D:C03 | 6539 |
| 4529 | Jan. 28, 1998 | 147 | RTA00000185AF.c.24.2 | M00001578B:E04 | 23001 |
| 4530 | Feb. 24, 1998 | 164 | RTA00000345F.k.06.1 | M00001475A:A12 | 0 |
| 4531 | Feb. 24, 1998 | 611 | RTA00000404F.p.02.2 | M00001652D:A06 | 39097 |
| 4532 | Feb. 24, 1998 | 274 | RTA00000405F.e.08.1 | M00001663C:F10 | 37916 |
| 4533 | Feb. 24, 1998 | 755 | RTA00000423F.d.17.1 | M00001663A:C11 | 20630 |
| 4534 | Feb. 24, 1998 | 126 | RTA00000422F.j.20.1 | M00001653A:G07 | 22388 |
| 4535 | Mar. 24, 1998 | 195 | RTA00000523F.i.08.1 | M00001855A:C12 | 65099 |
| 4536 | Mar. 24, 1998 | 83 | RTA00000527F.i.05.2 | M00003851C:B06 | 37481 |
| 4537 | Jan. 28, 1998 | 375 | RTA00000177AF.m.18.1 | M00001355B:G11 | 0 |
| 4537 | Jan. 28, 1998 | 376 | RTA00000177AF.m.18.3 | M00001355B:G11 | 0 |
| 4538 | Feb. 24, 1998 | 763 | RTA00000135A.m.18.1 | M00001545A:C03 | 19255 |
| 4539 | Feb. 24, 1998 | 362 | RTA00000418F.m.16.1 | M00001653B:E06 | 74986 |
| 4540 | Feb. 24, 1998 | 287 | RTA00000410F.n.09.1 | M00001662C:A04 | 11736 |
| 4541 | Mar. 24, 1998 | 416 | RTA00000527F.i.12.2 | M00003852B:D11 | 0 |
| 4542 | Feb. 24, 1998 | 662 | RTA00000339F.o.07.1 | M00001473C:G01 | 2566 |
| 4543 | Feb. 24, 1998 | 949 | RTA00000340R.j.07.1 | M00001654C:D05 | 38954 |
| 4544 | Mar. 24, 1998 | 146 | RTA00000527F.i.17.2 | M00003853B:C08 | 37539 |
| 4545 | Feb. 24, 1998 | 939 | RTA00000405F.a.03.1 | M00001654C:E04 | 39065 |
| 4546 | Mar. 24, 1998 | 42 | RTA00000527F.i.19.2 | M00003853C:C06 | 38089 |
| 4547 | Mar. 24, 1998 | 381 | RTA00000426F.f.18.1 | M00003854C:C02 | 63271 |
| 4548 | Feb. 24, 1998 | 656 | RTA00000403F.e.08.1 | M00001473D:B11 | 19126 |
| 4549 | Mar. 24, 1998 | 37 | RTA00000426F.f.20.1 | M00003854C:F01 | 65134 |
| 4550 | Feb. 24, 1998 | 733 | RTA00000405F.d.18.1 | M00001662C:B02 | 10494 |
| 4551 | Jan. 28, 1998 | 334 | RTA00000181AR.b.21.3 | M00001444C:D05 | 3266 |
| 4551 | Jan. 28, 1998 | 321 | RTA00000181AR.b.21.1 | M00001444C:D05 | 3266 |
| 4552 | Mar. 24, 1998 | 198 | RTA00000523F.o.05.1 | M00005175B:H04 | 0 |
| 4553 | Mar. 24, 1998 | 302 | RTA00000427F.p.04.2 | M00005100B:H07 | 0 |
| 4554 | Mar. 24, 1998 | 203 | RTA000004Z7F.p.10.2 | M00005102C:F09 | 0 |
| 4555 | Jan. 28, 1998 | 331 | RTA00000197AR.c.20.1 | M00001449D:A06 | 16282 |
| 4556 | Mar. 24, 1998 | 6 | RTA00000523F.l.10.1 | M00005134B:E01 | 0 |
| 4557 | Jan. 28, 1998 | 174 | RTA00000181AF.e.22.3 | M00001448D:F09 | 3442 |
| 4558 | Mar. 24, 1998 | 79 | RTA00000523F.l.15.1 | M00005134C:E11 | 0 |
| 4559 | Mar. 24, 1998 | 386 | RTA00000523F.l.16.1 | M00005134C:G04 | 0 |
| 4560 | Mar. 24, 1998 | 76 | RTA00000523F.l.18.1 | M00005134D:A06 | 0 |
| 4561 | Mar. 24, 1998 | 192 | RTA00000523F.m.02.1 | M00005134D:H03 | 0 |
| 4562 | Mar. 24, 1998 | 290 | RTA00000427F.l.03.1 | M00005136D:B07 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4563 | Mar. 24, 1998 | 269 | RTA00000427F.p.02.2 | M00005100B:D02 | 0 |
| 4564 | Jan. 28, 1998 | 321 | RTA00000181AR.b.21.1 | M00001444C:D05 | 3266 |
| 4564 | Jan. 28, 1998 | 334 | RTA00000181AR.b.21.3 | M00001444C:D05 | 3266 |
| 4565 | Mar. 24, 1998 | 334 | RTA00000427F.n.11.1 | M00004960B:A09 | 0 |
| 4566 | Jan. 28, 1998 | 334 | RTA00000181AR.b.21.3 | M00001444C:D05 | 3266 |
| 4566 | Jan. 28, 1998 | 321 | RTA00000181AR.b.21.1 | M00001444C:D05 | 3266 |
| 4567 | Jan. 28, 1998 | 334 | RTA00000181AR.b.21.3 | M00001444C:D05 | 3266 |
| 4567 | Jan. 28, 1998 | 321 | RTA00000181AR.b.21.1 | M00001444C:D05 | 3266 |
| 4568 | Mar. 24, 1998 | 328 | RTA00000523F.n.01.1 | M00005137A:E01 | 0 |
| 4569 | Jan. 28, 1998 | 356 | RTA00000180AF.l.12.2 | M00001433B:H11 | 0 |
| 4570 | Mar. 24, 1998 | 68 | RTA00000523F.n.04.1 | M00005138B:D12 | 0 |
| 4571 | Mar. 24, 1998 | 127 | RTA00000523F.n.10.1 | M00005140D:G09 | 0 |
| 4572 | Jan. 28, 1998 | 187 | RTA00000180AR.j.04.4 | M00001429C:G12 | 22300 |
| 4573 | Mar. 24, 1998 | 112 | RTA00000523F.n.12.1 | M00005173C:A02 | 0 |
| 4574 | Mar. 24, 1998 | 305 | RTA00000523F.n.16.1 | M00005173D:H02 | 0 |
| 4575 | Mar. 24, 1998 | 164 | RTA00000523F.n.17.1 | M00005174D:B02 | 0 |
| 4576 | Mar. 24, 1998 | 107 | RTA00000523F.n.20.1 | M00005174D:H02 | 0 |
| 4577 | Feb. 24, 1998 | 898 | RTA00000418F.l.03.1 | M00001641C:C06 | 79058 |
| 4578 | Mar. 24, 1998 | 288 | RTA00000427F.l.04.1 | M00005136D:C01 | 0 |
| 4579 | Mar. 24, 1998 | 462 | RTA00000427F.p.13.2 | M00004695B:E04 | 0 |
| 4580 | Jan. 28, 1998 | 137 | RTA00000181AF.m.4.3 | M00001455A:E09 | 13238 |
| 4581 | Jan. 28, 1998 | 20 | RTA00000181AF.l.14.2 | M00001454D:D06 | 2364 |
| 4582 | Mar. 24, 1998 | 105 | RTA00000526F.d.01.1 | M00004104B:A02 | 4468 |
| 4583 | Mar. 24, 1998 | 261 | RTA00000427F.i.22.1 | M00004104D:B05 | 63199 |
| 4584 | Mar. 24, 1998 | 81 | RTA00000427F.j.07.1 | M00004105A:B10 | 64819 |
| 4585 | Mar. 24, 1998 | 287 | RTA00000525F.d.19.1 | M00004114B:D09 | 36860 |
| 4586 | Jan. 28, 1998 | 311 | RTA00000191AR.j.4.2 | M00004071D:A10 | 5198 |
| 4587 | Mar. 24, 1998 | 337 | RTA00000525F.e.08.1 | M00004115C:H04 | 24193 |
| 4588 | Mar. 24, 1998 | 206 | RTA00000525F.f.07.1 | M00004119A:A06 | 37500 |
| 4589 | Mar. 24, 1998 | 461 | RTA00000427F.f.15.1 | M00004119D:A07 | 66734 |
| 4590 | Mar. 24, 1998 | 410 | RTA00000427F.f.16.1 | M00004119D:H06 | 64122 |
| 4591 | Mar. 24, 1998 | 307 | RTA00000427F.p.03.2 | M00005100B:G11 | 0 |
| 4592 | Mar. 24, 1998 | 180 | RTA00000523F.k.02.1 | M00004687A:C03 | 0 |
| 4593 | Jan. 28, 1998 | 115 | RTA00000179AR.o.20.3 | M00001409D:F11 | 2409 |
| 4594 | Mar. 24, 1998 | 315 | RTA00000427F.n.19.1 | M00004891D:E07 | 0 |
| 4595 | Mar. 24, 1998 | 375 | RTA00000427F.p.19.2 | M00004895C:G05 | 0 |
| 4596 | Mar. 24, 1998 | 470 | RTA00000427F.p.24.2 | M00004897D:F03 | 0 |
| 4597 | Jan. 28, 1998 | 155 | RTA00000197F.e.8.1 | M00001454A:C11 | 3135 |
| 4598 | Jan. 28, 1998 | 286 | RTA00000181AR.k.2.3 | M00001453C:A11 | 0 |
| 4598 | Jan. 28, 1998 | 389 | RTA00000181AR.k.2.2 | M00001453C:A11 | 0 |
| 4599 | Jan. 28, 1998 | 286 | RTA00000181AR.k.2.3 | M00001453C:A11 | 0 |
| 4599 | Jan. 28, 1998 | 389 | RTA00000181AR.k.2.2 | M00001453C:A11 | 0 |
| 4600 | Jan. 28, 1998 | 285 | RTA00000181AR.j.14.3 | M00001453B:E10 | 5399 |
| 4601 | Mar. 24, 1998 | 317 | RTA00000428F.a.01.1 | M00004897D:G05 | 0 |
| 4602 | Mar. 24, 1998 | 85 | RTA00000427F.m.21.1 | M00004900C:E11 | 0 |
| 4603 | Mar. 24, 1998 | 121 | RTA00000427F.n.02.1 | M00004900D:B10 | 0 |
| 4604 | Mar. 24, 1998 | 78 | RTA00000427F.o.05.1 | M00004958B:D01 | 0 |
| 4605 | Mar. 24, 1998 | 437 | RTA00000427F.n.10.1 | M00004960B:A08 | 0 |
| 4606 | Mar. 24, 1998 | 388 | RTA00000526F.d.17.1 | M00004235A:A12 | 2757 |
| 4607 | Jan. 28, 1998 | 299 | RTA00000196AF.f.5.1 | M00001366D:G02 | 11937 |
| 4608 | Jan. 28, 1998 | 369 | RTA00000196F.m.3.1 | M00001413A:F02 | 10453 |
| 4609 | Mar. 24, 1998 | 319 | RTA00000523F.p.15.1 | M00005178B:H01 | 0 |
| 4610 | Jan. 28, 1998 | 374 | RTA00000178AF.l.11.1 | M00001383A:G04 | 23286 |
| 4611 | Feb. 24, 1998 | 1090 | RTA00000405F.g.22.1 | M00001673C:A02 | 527 |
| 4612 | Jan. 28, 1998 | 127 | RTA00000178AF.k.18.1 | M00001382A:F04 | 9755 |
| 4613 | Jan. 28, 1998 | 104 | RTA00000196R.h.03.1 | M00001381A:D02 | 6636 |
| 4614 | Feb. 24, 1998 | 642 | RTA00000341F.h.19.1 | M00003916C:C05 | 0 |
| 4615 | Feb. 24, 1998 | 655 | RTA00000351R.p.14.1 | M00003915C:H04 | 13166 |
| 4616 | Jan. 28, 1998 | 145 | RTA00000178AF.h.24.1 | M00001376B:C06 | 6745 |
| 4617 | Feb. 24, 1998 | 224 | RTA00000341F.g.21.1 | M00003914C:F09 | 8823 |
| 4618 | Feb. 24, 1998 | 301 | RTA00000401F.m.23.1 | M00003914C:C02 | 2801 |
| 4619 | Feb. 24, 1998 | 133 | RTA00000404F.l.20.1 | M00001639B:H05 | 38638 |
| 4619 | Feb. 24, 1998 | 63 | RTA00000404F.l.20.2 | M00001639B:H05 | 38638 |
| 4620 | Feb. 24, 1998 | 542 | RTA00000410F.i.19.1 | M00001641B:C10 | 78988 |
| 4621 | Feb. 24, 1998 | 63 | RTA00000404F.l.20.2 | M00001639B:H05 | 38638 |
| 4621 | Feb. 24, 1998 | 133 | RTA00000404F.l.20.1 | M00001639B:H05 | 38638 |
| 4622 | Feb. 24, 1998 | 600 | RTA00000406F.m.04.1 | M00003914B:A11 | 14959 |
| 4623 | Jan. 28, 1998 | 33 | RTA00000178AR.a.20.1 | M00001362C:H11 | 945 |
| 4623 | Feb. 24, 1998 | 979 | RTA00000345F.b.17.1 | M00001362C:H11 | 945 |
| 4624 | Jan. 28, 1998 | 33 | RTA00000178AR.a.20.1 | M00001362C:H11 | 945 |
| 4624 | Feb. 24, 1998 | 979 | RTA00000345F.b.17.1 | M00001362C:H11 | 945 |
| 4625 | Mar. 24, 1998 | 73 | RTA00000524F.b.12.1 | M00005213C:G01 | 0 |
| 4626 | Jan. 28, 1998 | 373 | RTA00000196F.e.12.1 | M00001361C:H11 | 10147 |
| 4627 | Feb. 24, 1998 | 1233 | RTA00000418F.l.02.1 | M00001641C:C05 | 39316 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4628 | Mar. 24, 1998 | 184 | RTA00000524F.b.18.1 | M00005214B:D11 | 0 |
| 4629 | Mar. 24, 1998 | 353 | RTA00000428F.a.18.1 | M00005214C:A09 | 0 |
| 4630 | Jan. 28, 1998 | 89 | RTA00000177AF.n.8.3 | M00001356D:F06 | 4188 |
| 4630 | Jan. 28, 1998 | 15 | RTA00000177AR.n.8.1 | M00001356D:F06 | 4188 |
| 4631 | Jan. 28, 1998 | 89 | RTA00000177AF.n.8.3 | M00001356D:F06 | 4188 |
| 4631 | Jan. 28, 1998 | 15 | RTA00000177AR.n.8.1 | M00001356D:F06 | 4188 |
| 4632 | Jan. 28, 1998 | 375 | RTA00000177AF.m.18.1 | M00001355B:G11 | 0 |
| 4632 | Jan. 28, 1998 | 376 | RTA00000177AF.m.18.3 | M00001355B:G11 | 0 |
| 4633 | Jan. 28, 1998 | 375 | RTA00000177AF.m.18.1 | M00001355B:G11 | 0 |
| 4633 | Jan. 28, 1998 | 376 | RTA00000177AF.m.18.3 | M00001355B:G11 | 0 |
| 4634 | Feb. 24, 1998 | 682 | RTA00000410F.i.17.1 | M00001641B:B01 | 78147 |
| 4635 | Jan. 28, 1998 | 367 | RTA00000196F.i.24.1 | M00001392C:D10 | 4233 |
| 4636 | Jan. 28, 1998 | 264 | RTA00000179AF.k.3.3 | M00001401A:H07 | 0 |
| 4637 | Jan. 28, 1998 | 333 | RTA00000196F.k.15.1 | M00001400A:F06 | 8320 |
| 4638 | Jan. 28, 1998 | 38 | RTA00000196R.k.07.1 | M00001399C:D09 | 22443 |
| 4638 | Jan. 28, 1998 | 289 | RTA00000196F.k.07.1 | M00001399C:D09 | 22443 |
| 4639 | Jan. 28, 1998 | 38 | RTA00000196R.k.07.1 | M00001399C:D09 | 22443 |
| 4639 | Jan. 28, 1998 | 289 | RTA00000196F.k.07.1 | M00001399C:D09 | 22443 |
| 4640 | Jan. 28, 1998 | 289 | RTA00000196F.k.07.1 | M00001399C:D09 | 22443 |
| 4640 | Jan. 28, 1998 | 38 | RTA00000196R.k.07.1 | M00001399C:D09 | 22443 |
| 4641 | Jan. 28, 1998 | 38 | RTA00000196R.k.07.1 | M00001399C:D09 | 22443 |
| 4641 | Jan. 28, 1998 | 289 | RTA00000196F.k.07.1 | M00001399C:D09 | 22443 |
| 4642 | Mar. 24, 1998 | 324 | RTA00000523F.o.09.1 | M00005176A:C12 | 0 |
| 4643 | Mar. 24, 1998 | 122 | RTA00000523F.o.12.1 | M00005177A:B06 | 0 |
| 4644 | Jan. 28, 1998 | 167 | RTA00000179AF.d.22.3 | M00001394C:C11 | 7955 |
| 4645 | Jan. 28, 1998 | 351 | RTA00000179AF.c.22.1 | M00001393B:B09 | 22515 |
| 4645 | Jan. 28, 1998 | 459 | RTA00000179AF.c.22.3 | M00001393B:B09 | 22515 |
| 4646 | Jan. 28, 1998 | 351 | RTA00000179AF.c.22.1 | M00001393B:B09 | 22515 |
| 4646 | Jan. 28, 1998 | 459 | RTA00000179AF.c.22.3 | M00001393B:B09 | 22515 |
| 4647 | Mar. 24, 1998 | 361 | RTA00000523F.p.08.1 | M00005178A:A07 | 0 |
| 4648 | Jan. 28, 1998 | 43 | RTA00000179AF.c.14.3 | M00001392D:H04 | 0 |
| 4649 | Mar. 24, 1998 | 268 | RTA00000427F.k.19.1 | M00004103B:B07 | 62851 |
| 4650 | Mar. 24, 1998 | 473 | RTA00000523F.o.21.1 | M00005177C:A01 | 0 |
| 4651 | Jan. 28, 1998 | 60 | RTA00000196AR.i.12.3 | M00001389D:G11 | 38800 |
| 4651 | Jan. 28, 1998 | 128 | RTA00000196F.i.12.1 | M00001389D:G11 | 38800 |
| 4652 | Jan. 28, 1998 | 128 | RTA00000196F.i.12.1 | M00001389D:G11 | 38800 |
| 4652 | Jan. 28, 1998 | 60 | RTA00000196AR.i.12.3 | M00001389D:G11 | 38800 |
| 4653 | Jan. 28, 1998 | 60 | RTA00000196AR.i.12.3 | M00001389D:G11 | 38800 |
| 4653 | Jan. 28, 1998 | 128 | RTA00000196F.i.12.1 | M00001389D:G11 | 38800 |
| 4654 | Jan. 28, 1998 | 60 | RTA00000196AR.i.12.3 | M00001389D:G11 | 38800 |
| 4654 | Jan. 28, 1998 | 128 | RTA00000196F.i.12.1 | M00001389D:G11 | 38800 |
| 4655 | Jan. 28, 1998 | 28 | RTA00000178AR.o.01.5 | M00001387B:H07 | 0 |
| 4656 | Jan. 28, 1998 | 279 | RTA00000196AF.h.24.1 | M00001386A:D11 | 7308 |
| 4657 | Jan. 28, 1998 | 130 | RTA00000196AF.h.23.1 | M00001386A:C02 | 13357 |
| 4658 | Jan. 28, 1998 | 254 | RTA00000178AF.n.2.1 | M00001385C:H11 | 17083 |
| 4659 | Jan. 28, 1998 | 74 | RTA00000196AF.h.20.1 | M00001385B:F10 | 0 |
| 4660 | Jan. 28, 1998 | 377 | RTA00000178AF.m.19.1 | M00001384D:H07 | 0 |
| 4660 | Jan. 28, 1998 | 120 | RTA00000178AR.m.19.5 | M00001384D:H07 | 0 |
| 4661 | Jan. 28, 1998 | 377 | RTA00000178AF.m.19.1 | M00001384D:H07 | 0 |
| 4661 | Jan. 28, 1998 | 120 | RTA00000178AR.m.19.5 | M00001384D:H07 | 0 |
| 4662 | Mar. 24, 1998 | 228 | RTA00000523F.o.14.1 | M00005177A:H09 | 0 |
| 4663 | Jan. 28, 1998 | 567 | RTA00000177AR.m.13.1 | M00001355A:C12 | 4175 |
| 4663 | Jan. 28, 1998 | 538 | RTA00000177AR.m.13.3 | M00001355A:C12 | 4175 |
| 4663 | Jan. 28, 1998 | 533 | RTA00000177AR.m.13.4 | M00001355A:C12 | 4175 |
| 4664 | Jan. 28, 1998 | 511 | RTA00000196AF.g.10.1 | M00001376B:A02 | 12498 |
| 4665 | Jan. 28, 1998 | 620 | RTA00000201R.g.08.1 | M00004692A:E07 | 0 |
| 4665 | Jan. 28, 1998 | 619 | RTA00000201F.g.08.1 | M00004692A:E07 | 0 |
| 4665 | Jan. 28, 1998 | 621 | RTA00000201R.g.08.2 | M00004692A:E07 | 0 |
| 4666 | Mar. 24, 1998 | 194 | RTA00000522F.j.12.2 | M00001651C:A04 | 74341 |
| 4667 | Feb. 24, 1998 | 79 | RTA00000419F.g.08.1 | M00003842C:D11 | 66700 |
| 4668 | Jan. 28, 1998 | 619 | RTA00000201F.g.08.1 | M00004692A:E07 | 0 |
| 4668 | Jan. 28, 1998 | 620 | RTA00000201R.g.08.1 | M00004692A:E07 | 0 |
| 4668 | Jan. 28, 1998 | 621 | RTA00000201R.g.08.2 | M00004692A:E07 | 0 |
| 4669 | Jan. 28, 1998 | 529 | RTA00000178AF.b.13.1 | M00001364A:E11 | 3114 |
| 4670 | Feb. 24, 1998 | 111 | RTA00000128A.i.20.1 | M00001560A:F03 | 9900 |
| 4671 | Mar. 24, 1998 | 379 | RTA00000522F.k.02.2 | M00001652C:B09 | 77622 |
| 4672 | Mar. 24, 1998 | 135 | RTA00000522F.k.10.2 | M00001652D:B09 | 77619 |
| 4673 | Feb. 24, 1998 | 1197 | RTA00000128A.j.10.1 | M00001560A:H06 | 80085 |
| 4674 | Feb. 24, 1998 | 140 | RTA00000128A.j.6.2 | M00001560A:H10 | 5316 |
| 4675 | Mar. 24, 1998 | 247 | RTA00000425F.j.21.1 | M00001633B:B11 | 77373 |
| 4676 | Jan. 28, 1998 | 538 | RTA00000177AR.m.13.3 | M00001355A:C12 | 4175 |
| 4676 | Jan. 28, 1998 | 567 | RTA00000177AR.m.13.1 | M00001355A:C12 | 4175 |
| 4676 | Jan. 28, 1998 | 533 | RTA00000177AR.m.13.4 | M00001355A:C12 | 4175 |
| 4677 | Feb. 24, 1998 | 729 | RTA00000403F.m.20.1 | M00001576A:F11 | 707 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4677 | Feb. 24, 1998 | 437 | RTA00000403F.m.20.2 | M00001576A:F11 | 707 |
| 4678 | Jan. 28, 1998 | 533 | RTA00000177AR.m.13.4 | M00001355A:C12 | 4175 |
| 4678 | Jan. 28, 1998 | 538 | RTA00000177AR.m.13.3 | M00001355A:C12 | 4175 |
| 4678 | Jan. 28, 1998 | 567 | RTA00000177AR.m.13.1 | M00001355A:C12 | 4175 |
| 4679 | Jan. 28, 1998 | 533 | RTA00000177AR.m.13.4 | M00001355A:C12 | 4175 |
| 4679 | Jan. 28, 1998 | 538 | RTA00000177AR.m.13.3 | M00001355A:C12 | 4175 |
| 4679 | Jan. 28, 1998 | 567 | RTA00000177AR.m.13.1 | M00001355A:C12 | 4175 |
| 4680 | Jan. 28, 1998 | 538 | RTA00000177AR.m.13.3 | M00001355A:C12 | 4175 |
| 4680 | Jan. 28, 1998 | 567 | RTA00000177AR.m.13.1 | M00001355A:C12 | 4175 |
| 4680 | Jan. 28, 1998 | 533 | RTA00000177AR.m.13.4 | M00001355A:C12 | 4175 |
| 4681 | Jan. 28, 1998 | 533 | RTA00000177AR.m.13.4 | M00001355A:C12 | 4175 |
| 4681 | Jan. 28, 1998 | 538 | RTA00000177AR.m.13.3 | M00001355A:C12 | 4175 |
| 4681 | Jan. 28, 1998 | 567 | RTA00000177AR.m.13.1 | M00001355A:C12 | 4175 |
| 4682 | Jan. 28, 1998 | 620 | RTA00000201R.g.08.1 | M00004692A:E07 | 0 |
| 4682 | Jan. 28, 1998 | 621 | RTA00000201R.g.08.2 | M00004692A:E07 | 0 |
| 4682 | Jan. 28, 1998 | 619 | RTA00000201F.g.08.1 | M00004692A:E07 | 0 |
| 4683 | Feb. 24, 1998 | 845 | RTA00000348R.b.04.1 | M00001342B:E01 | 1890 |
| 4684 | Feb. 24, 1998 | 1088 | RTA00000339R.b.02.1 | M00001344B:F12 | 0 |
| 4684 | Feb. 24, 1998 | 1149 | RTA00000339F.b.02.1 | M00001344B:F12 | 0 |
| 4685 | Feb. 24, 1998 | 618 | RTA00000423F.l.04.1 | M00004039B:G08 | 14320 |
| 4686 | Feb. 24, 1998 | 1235 | RTA00000411F.j.04.1 | M00003841C:F03 | 66219 |
| 4687 | Feb. 24, 1998 | 415 | RTA00000340R.f.05.1 | M00001569B:G11 | 3202 |
| 4688 | Feb. 24, 1998 | 1088 | RTA00000339R.b.02.1 | M00001344B:F12 | 0 |
| 4688 | Feb. 24, 1998 | 1149 | RTA00000339F.b.02.1 | M00001344B:F12 | 0 |
| 4689 | Feb. 24, 1998 | 1067 | RTA00000411F.j.11.1 | M00003841D:F06 | 66154 |
| 4690 | Jan. 28, 1998 | 429 | RTA00000196F.i.19.1 | M00001390C:C11 | 39498 |
| 4690 | Feb. 24, 1998 | 925 | RTA00000353R.h.10.2 | M00001390C:C11 | 39498 |
| 4691 | Jan. 28, 1998 | 508 | RTA00000187AF.i.14.2 | M00001679B:H07 | 19406 |
| 4691 | Feb. 24, 1998 | 928 | RTA00000340F.m.04.1 | M00001679B:H07 | 19406 |
| 4692 | Feb. 24, 1998 | 10 | RTA00000350R.c.12.1 | M00001550D:A04 | 9728 |
| 4693 | Jan. 28, 1998 | 553 | RTA00000201F.b.22.1 | M00004344B:H04 | 35728 |
| 4694 | Jan. 28, 1998 | 459 | RTA00000179AF.c.22.3 | M00001393B:B09 | 22515 |
| 4694 | Jan. 28, 1998 | 351 | RTA00000179AF.c.22.1 | M00001393B:B09 | 22515 |
| 4695 | Jan. 28, 1998 | 351 | RTA00000179AF.c.22.1 | M00001393B:B09 | 22515 |
| 4695 | Jan. 28, 1998 | 459 | RTA00000179AF.c.22.3 | M00001393B:B09 | 22515 |
| 4696 | Feb. 24, 1998 | 235 | RTA00000126A.o.23.1 | M00001551A:B10 | 6268 |
| 4697 | Feb. 24, 1998 | 942 | RTA00000126A.n.6.2 | M00001551A:D04 | 79917 |
| 4698 | Feb. 24, 1998 | 228 | RTA00000411F.k.19.1 | M00003852D:E08 | 64200 |
| 4699 | Jan. 28, 1998 | 638 | RTA00000193AF.l.05.2 | M00004348A:A02 | 2815 |
| 4700 | Mar. 24, 1998 | 143 | RTA00000425F.l.09.1 | M00001638A:B04 | 75251 |
| 4701 | Jan. 28, 1998 | 540 | RTA00000179AF.b.10.3 | M00001391D:D10 | 0 |
| 4702 | Feb. 24, 1998 | 390 | RTA00000355R.a.14.1 | M00004187D:G09 | 10207 |
| 4703 | Jan. 28, 1998 | 429 | RTA00000196F.i.19.1 | M00001390C:C11 | 39498 |
| 4703 | Feb. 24, 1998 | 925 | RTA00000353R.h.10.1 | M00001390C:C11 | 39498 |
| 4704 | Feb. 24, 1998 | 930 | RTA00000127A.h.22.2 | M00001554A:E04 | 13155 |
| 4705 | Feb. 24, 1998 | 1193 | RTA00000411F.k.14.1 | M00003851A:C10 | 63987 |
| 4706 | Jan. 28, 1998 | 694 | RTA00000201R.c.19.1 | M00004370A:G05 | 22357 |
| 4707 | Mar. 24, 1998 | 80 | RTA00000425F.p.12.1 | M00001638C:G01 | 73219 |
| 4708 | Mar. 24, 1998 | 344 | RTA00000425F.p.15.1 | M00001638C:H07 | 31680 |
| 4709 | Jan. 28, 1998 | 743 | RTA00000178AF.k.9.1 | M00001381B:F06 | 16342 |
| 4710 | Feb. 24, 1998 | 202 | RTA00000419F.g.22.1 | M00003845D:A09 | 64515 |
| 4711 | Jan. 28, 1998 | 749 | RTA00000178AR.i.13.4 | M00001377B:H01 | 0 |
| 4712 | Mar. 24, 1998 | 217 | RTA00000425F.j.16.1 | M00001639D:F02 | 75631 |
| 4713 | Mar. 24, 1998 | 448 | RTA00000425F.j.18.1 | M00001639D:G12 | 75561 |
| 4714 | Jan. 28, 1998 | 385 | RTA00000201F.c.24.1 | M00004374D:E10 | 35731 |
| 4715 | Feb. 24, 1998 | 904 | RTA00000127A.e.6.1 | M00001553A:E07 | 5885 |
| 4716 | Feb. 24, 1998 | 620 | RTA00000420F.a.07.1 | M00004072C:F08 | 63405 |
| 4717 | Jan. 28, 1998 | 396 | RTA00000179AR.b.02.3 | M00001391B:G12 | 0 |
| 4718 | Feb. 24, 1998 | 463 | RTA00000403F.o.22.1 | M00001583A:D01 | 25076 |
| 4718 | Feb. 24, 1998 | 1084 | RTA00000403F.o.22.2 | M00001583A:D01 | 25076 |
| 4719 | Feb. 24, 1998 | 1225 | RTA00000346F.j.13.1 | M00003841C:E04 | 5337 |
| 4720 | Feb. 24, 1998 | 1221 | RTA00000403F.o.17.1 | M00001582D:A02 | 23085 |
| 4721 | Feb. 24, 1998 | 878 | RTA00000413F.c.12.1 | M00004083B:G03 | 65334 |
| 4722 | Feb. 24, 1998 | 764 | RTA00000413F.c.17.1 | M00004085B:B05 | 36831 |
| 4723 | Feb. 24, 1998 | 398 | RTA00000407F.b.04.1 | M00004086D:B09 | 63221 |
| 4724 | Feb. 24, 1998 | 1179 | RTA00000341F.o.12.1 | M00004144A:F04 | 2883 |
| 4725 | Feb. 24, 1998 | 7 | RTA00000413F.d.12.1 | M00004088C:A12 | 66467 |
| 4726 | Feb. 24, 1998 | 881 | RTA00000413F.d.15.1 | M00004088C:E04 | 64943 |
| 4727 | Feb. 24, 1998 | 463 | RTA00000403F.o.22.1 | M00001583A:D01 | 25076 |
| 4727 | Feb. 24, 1998 | 1084 | RTA00000403F.o.22.2 | M00001583A:D01 | 25076 |
| 4728 | Feb. 24, 1998 | 1084 | RTA00000403F.o.22.2 | M00001583A:D01 | 25076 |
| 4728 | Feb. 24, 1998 | 463 | RTA00000403F.o.22.1 | M00001583A:D01 | 25076 |
| 4729 | Jan. 28, 1998 | 506 | RTA00000198R.o.09.1 | M00003751B:A05 | 4310 |
| 4729 | Jan. 28, 1998 | 497 | RTA00000198AF.o.09.1 | M00003751B:A05 | 4310 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4730 | Feb. 24, 1998 | 1015 | RTA00000129A.b.6.2 | M00001582A:H01 | 39111 |
| 4731 | Feb. 24, 1998 | 866 | RTA00000407F.b.08.1 | M00004088D:B03 | 37513 |
| 4732 | Feb. 24, 1998 | 943 | RTA00000413F.c.03.1 | M00004081D:H09 | 64527 |
| 4733 | Feb. 24, 1998 | 463 | RTA00000403F.o.22.1 | M00001583A:D01 | 25076 |
| 4733 | Feb. 24, 1998 | 1084 | RTA00000403F.o.22.2 | M00001583A:D01 | 25076 |
| 4734 | Jan. 28, 1998 | 490 | RTA00000198AF.n.05.1 | M00001687A:G01 | 24157 |
| 4735 | Feb. 24, 1998 | 798 | RTA00000420F.c.04.1 | M00004089A:B08 | 65007 |
| 4736 | Feb. 24, 1998 | 850 | RTA00000420F.c.07.1 | M00004089A:E02 | 65555 |
| 4737 | Feb. 24, 1998 | 199 | RTA00000403F.m.13.2 | M00001575D:A10 | 39077 |
| 4738 | Jan. 28, 1998 | 424 | RTA00000187AR.j.24.1 | M00001679D:B05 | 78356 |
| 4738 | Jan. 28, 1998 | 418 | RTA00000187AR.k.01.1 | M00001679D:B05 | 78356 |
| 4739 | Jan. 28, 1998 | 424 | RTA00000187AR.j.24.1 | M00001679D:B05 | 78356 |
| 4739 | Jan. 28, 1998 | 418 | RTA00000187AR.k.01.1 | M00001679D:B05 | 78356 |
| 4740 | Jan. 28, 1998 | 418 | RTA00000187AR.k.01.1 | M00001679D:B05 | 78356 |
| 4740 | Jan. 28, 1998 | 424 | RTA00000187AR.j.24.1 | M00001679D:B05 | 78356 |
| 4741 | Jan. 28, 1998 | 424 | RTA00000187AR.j.24.1 | M00001679D:B05 | 78356 |
| 4741 | Jan. 28, 1998 | 418 | RTA00000187AR.k.01.1 | M00001679D:B05 | 78356 |
| 4742 | Jan. 28, 1998 | 482 | RTA00000187AF.j.7.1 | M00001679C:F01 | 78091 |
| 4743 | Jan. 28, 1998 | 693 | RTA00000198F.m.12.1 | M00001679C:D05 | 4 |
| 4744 | Mar. 24, 1998 | 23 | RTA00000522F.p.07.1 | M00001670A:C11 | 76888 |
| 4745 | Jan. 28, 1998 | 497 | RTA00000198AF.o.09.1 | M00003751B:A05 | 4310 |
| 4745 | Jan. 28, 1998 | 506 | RTA00000198R.o.09.1 | M00003751B:A05 | 4310 |
| 4746 | Jan. 28, 1998 | 642 | RTA00000189AF.i.14.1 | M00003868B:G11 | 0 |
| 4747 | Feb. 24, 1998 | 1119 | RTA00000126A.k.24.1 | M00001550A:F07 | 39428 |
| 4748 | Feb. 24, 1998 | 654 | RTA00000421F.a.05.1 | M00001570C:G06 | 5278 |
| 4749 | Feb. 24, 1998 | 1146 | RTA00000347F.h.02.1 | M00004072D:H12 | 562 |
| 4750 | Feb. 24, 1998 | 137 | RTA00000339R.a.06.1 | M00001346A:E04 | 58694 |
| 4751 | Feb. 24, 1998 | 729 | RTA00000403F.m.20.1 | M00001576A:F11 | 707 |
| 4751 | Feb. 24, 1998 | 437 | RTA00000403F.m.20.2 | M00001576A:F11 | 707 |
| 4752 | Feb. 24, 1998 | 627 | RTA00000408F.p.21.1 | M00001579A:C03 | 77930 |
| 4753 | Feb. 24, 1998 | 735 | RTA00000420F.a.11.1 | M00004073C:D04 | 66460 |
| 4754 | Feb. 24, 1998 | 525 | RTA00000348R.d.24.1 | M00001349B:G05 | 5774 |
| 4755 | Feb. 24, 1998 | 624 | RTA00000420F.a.16.1 | M00004075D:C10 | 63345 |
| 4756 | Feb. 24, 1998 | 437 | RTA00000403F.m.20.2 | M00001576A:F11 | 707 |
| 4756 | Feb. 24, 1998 | 729 | RTA00000403F.m.20.1 | M00001576A:F11 | 707 |
| 4757 | Feb. 24, 1998 | 437 | RTA00000403F.m.20.2 | M00001576A:F11 | 707 |
| 4757 | Feb. 24, 1998 | 729 | RTA00000403F.m.20.1 | M00001576A:F11 | 707 |
| 4758 | Jan. 28, 1998 | 499 | RTA00000199F.b.22.2 | M00003791C:E09 | 17018 |
| 4759 | Feb. 24, 1998 | 843 | RTA00000418F.g.03.1 | M00001579C:E06 | 78737 |
| 4760 | Feb. 24, 1998 | 956 | RTA00000423F.l.06.1 | M00004062A:H06 | 38136 |
| 4761 | Feb. 24, 1998 | 826 | RTA00000422F.e.07.1 | M00001579C:G05 | 38964 |
| 4761 | Feb. 24, 1998 | 832 | RTA00000403F.o.10.2 | M00001579C:G05 | 38964 |
| 4762 | Feb. 24, 1998 | 826 | RTA00000422F.e.07.1 | M00001579C:G05 | 38964 |
| 4762 | Feb. 24, 1998 | 832 | RTA00000403F.o.10.2 | M00001579C:G05 | 38964 |
| 4763 | Feb. 24, 1998 | 826 | RTA00000422F.e.07.1 | M00001579C:G05 | 38964 |
| 4763 | Feb. 24, 1998 | 832 | RTA00000403F.o.10.2 | M00001579C:G05 | 38964 |
| 4764 | Feb. 24, 1998 | 826 | RTA00000422F.e.07.1 | M00001579C:G05 | 38964 |
| 4764 | Feb. 24, 1998 | 832 | RTA00000403F.o.10.2 | M00001579C:G05 | 38964 |
| 4765 | Feb. 24, 1998 | 1159 | RTA00000413F.b.18.1 | M00004078C:F04 | 39873 |
| 4766 | Feb. 24, 1998 | 1122 | RTA00000419F.f.16.1 | M00003839D:E02 | 64679 |
| 4767 | Feb. 24, 1998 | 1053 | RTA00000413F.b.24.1 | M00004080A:F01 | 65117 |
| 4768 | Feb. 24, 1998 | 1052 | RTA00000420F.b.02.1 | M00004081A:A08 | 64013 |
| 4769 | Feb. 24, 1998 | 157 | RTA00000339F.a.23.1 | M00001361B:C07 | 4022 |
| 4770 | Jan. 28, 1998 | 452 | RTA00000199F.d.19.2 | M00003813D:H12 | 6707 |
| 4771 | Feb. 24, 1998 | 480 | RTA00000411F.i.15.1 | M00003837D:G08 | 31612 |
| 4772 | Feb. 24, 1998 | 125 | RTA00000403F.m.18.1 | M00001576A:B09 | 39185 |
| 4773 | Feb. 24, 1998 | 548 | RTA00000413F.b.12.1 | M00004077B:H11 | 64932 |
| 4774 | Feb. 24, 1998 | 814 | RTA00000408F.l.24.1 | M00001530B:G09 | 34263 |
| 4775 | Jan. 28, 1998 | 688 | RTA00000193AF.g.3.1 | M00004050D:A06 | 5567 |
| 4776 | Jan. 28, 1998 | 451 | RTA00000200AF.b.20.1 | M00004043A:D02 | 40403 |
| 4777 | Jan. 28, 1998 | 456 | RTA00000200AF.b.12.1 | M00004040B:F10 | 22053 |
| 4778 | Feb. 24, 1998 | 849 | RTA00000122A.n.16.1 | M00001517A:G08 | 80553 |
| 4779 | Jan. 28, 1998 | 12 | RTA00000183AF.i.15.2 | M00001529B:C04 | 2642 |
| 4779 | Feb. 24, 1998 | 379 | RTA00000349R.j.07.1 | M00001529B:C04 | 2642 |
| 4780 | Jan. 28, 1998 | 12 | RTA00000183AF.i.15.2 | M00001529B:C04 | 2642 |
| 4780 | Feb. 24, 1998 | 379 | RTA00000349R.j.07.1 | M00001529B:C04 | 2642 |
| 4781 | Jan. 28, 1998 | 512 | RTA00000191AF.c.3.1 | M00003987D:D06 | 3549 |
| 4782 | Feb. 24, 1998 | 431 | RTA00000399F.j.15.1 | M00001578C:G06 | 1261 |
| 4783 | Jan. 28, 1998 | 586 | RTA00000199R.o.11.1 | M00003976C:A10 | 23172 |
| 4784 | Jan. 28, 1998 | 496 | RTA00000190AF.p.3.1 | M00003975B:F03 | 2378 |
| 4785 | Feb. 24, 1998 | 340 | RTA00000408F.l.13.1 | M00001530A:B12 | 4423 |
| 4786 | Jan. 28, 1998 | 617 | RTA00000179AF.d.13.3 | M00001394A:F01 | 6583 |
| 4787 | Feb. 24, 1998 | 779 | RTA00000408F.l.16.1 | M00001530A:F12 | 73468 |
| 4788 | Jan. 28, 1998 | 387 | RTA00000191AF.j.14.1 | M00004073A:H12 | 1002 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4788 | Feb. 24, 1998 | 632 | RTAQ0000191AF.j.14.1 | M00004073A:H12 | 1002 |
| 4789 | Jan. 28, 1998 | 464 | RTA00000199AF.l.14.1 | M00003917A:D02 | 22865 |
| 4790 | Feb. 24, 1998 | 668 | RTA00000408F.m.05.2 | M00001530C:G10 | 23384 |
| 4791 | Feb. 24, 1998 | 1066 | RTA00000123A.f.2.1 | M00001531A:H03 | 80379 |
| 4792 | Feb. 24, 1998 | 213 | RTA00000123A.f.3.1 | M00001531A:H07 | 44017 |
| 4793 | Feb. 24, 1998 | 43 | RTA00000420F.g.04.1 | M00004891B:B12 | 0 |
| 4794 | Feb. 24, 1998 | 302 | RTA00000356R.f.18.1 | M00004692A:H10 | 0 |
| 4795 | Feb. 24, 1998 | 308 | RTA00000353R.d.11.1 | M00004692A:H08 | 0 |
| 4796 | Feb. 24, 1998 | 975 | RTA00000411F.n.02.1 | M00003870B:F04 | 78049 |
| 4797 | Jan. 28, 1998 | 722 | RTA00000199R.j.24.1 | M00003895C:A10 | 0 |
| 4798 | Feb. 24, 1998 | 643 | RTA00000420F.l.14.2 | M00005230D:F06 | 0 |
| 4799 | Jan. 28, 1998 | 480 | RTA00000181AF.o.08.2 | M00001457C:H12 | 849 |
| 4800 | Jan. 28, 1998 | 518 | RTA00000199AF.n.22.1 | M00003971A:A06 | 23064 |
| 4801 | Jan. 28, 1998 | 618 | RTA00000192AF.a.14.1 | M00004111D:A08 | 6874 |
| 4802 | Feb. 24, 1998 | 937 | RTA00000121A.n.15.1 | M00001511A:G08 | 40849 |
| 4803 | Feb. 24, 1998 | 821 | RTA00000420F.h.16.1 | M00004927A:E06 | 0 |
| 4804 | Feb. 24, 1998 | 658 | RTA00000121A.n.2.1 | M00001511A:A05 | 33585 |
| 4805 | Feb. 24, 1998 | 551 | RTA00000340F.b.05.1 | M00001513A:G07 | 0 |
| 4806 | Feb. 24, 1998 | 172 | RTA00000420F.i.17.1 | M00005101C:B09 | 0 |
| 4807 | Feb. 24, 1998 | 1224 | RTA00000122A.h.24.1 | M00001514A:A12 | 48 |
| 4808 | Jan. 28, 1998 | 631 | RTA00000200AF.h.19.2 | M00004151D:E03 | 0 |
| 4809 | Feb. 24, 1998 | 80 | RTA00000122A.g.16.1 | M00001514A:B04 | 81366 |
| 4810 | Feb. 24, 1998 | 809 | RTA00000420F.i.23.1 | M00005134A:D11 | 0 |
| 4811 | Feb. 24, 1998 | 650 | RTA00000122A.g.17.1 | M00001514A:B08 | 32655 |
| 4812 | Feb. 24, 1998 | 73 | RTA00000413F.p.15.2 | M00005136D:D06 | 0 |
| 4813 | Jan. 28, 1998 | 425 | RTA00000200AF.c.16.1 | M00004064D:A11 | 23433 |
| 4814 | Feb. 24, 1998 | 60 | RTA00000413F.p.17.2 | M00005136D:G06 | 0 |
| 4815 | Jan. 28, 1998 | 387 | RTA00000191AF.j.14.1 | M00004073A:H12 | 1002 |
| 4815 | Feb. 24, 1998 | 632 | RTA00000191AF.j.14.1 | M00004073A:H12 | 1002 |
| 4816 | Feb. 24, 1998 | 837 | RTA00000420F.h.01.1 | M00004897C:D06 | 0 |
| 4817 | Feb. 24, 1998 | 123 | RTA00000122A.j.18.1 | M00001516A:D05 | 81317 |
| 4818 | Feb. 24, 1998 | 77 | RTA00000420F.j.22.1 | M00005173B:F01 | 0 |
| 4819 | Jan. 28, 1998 | 734 | RTA00000200AF.d.21.1 | M00004087C:D03 | 0 |
| 4820 | Jan. 28, 1998 | 733 | RTA00000200AF.d.20.1 | M00004087A:G08 | 26600 |
| 4821 | Feb. 24, 1998 | 1003 | RTA00000420F.k.08.2 | M00005176C:C09 | 0 |
| 4822 | Jan. 28, 1998 | 442 | RTA00000191AF.l.9.1 | M00004081C:H06 | 0 |
| 4823 | Jan. 28, 1998 | 457 | RTA00000191AR.l.7.2 | M00004081C:D12 | 14391 |
| 4824 | Feb. 24, 1998 | 552 | RTA00000411F.n.12.1 | M00003875A:C04 | 73308 |
| 4825 | Feb. 24, 1998 | 782 | RTA00000419F.k.03.1 | M00003871C:B05 | 40822 |
| 4826 | Feb. 24, 1998 | 839 | RTA00000414F.b.01.1 | M00005212B:A02 | 0 |
| 4827 | Jan. 28, 1998 | 674 | RTA00000197AR.e.24.1 | M00001456B:F10 | 39250 |
| 4827 | Jan. 28, 1998 | 3 | RTA00000197AF.e.24.1 | M00001456B:F10 | 39250 |
| 4828 | Jan. 28, 1998 | 669 | RTA00000192AF.c.2.1 | M00004121B:G01 | 0 |
| 4829 | Jan. 28, 1998 | 718 | RTA00000196F.l.14.2 | M00001408B:G06 | 23144 |
| 4830 | Feb. 24, 1998 | 1259 | RTA00000420F.l.19.2 | M00005231A:H04 | 0 |
| 4831 | Jan. 28, 1998 | 717 | RTA00000200F.o.10.2 | M00004269B:C08 | 36432 |
| 4832 | Feb. 24, 1998 | 107 | RTA00000125A.g.16.1 | M00001544A:C09 | 21497 |
| 4833 | Jan. 28, 1998 | 697 | RTA00000193AF.e.21.1 | M00004271B:B06 | 0 |
| 4834 | Feb. 24, 1998 | 829 | RTA00000411F.m.11.1 | M00003867A:D12 | 73196 |
| 4835 | Jan. 28, 1998 | 409 | RTA00000180AF.d.1.3 | M00001418D:B06 | 8526 |
| 4836 | Mar. 24, 1998 | 426 | RTA00000424F.k.21.1 | M00001614A:A04 | 73197 |
| 4837 | Feb. 24, 1998 | 874 | RTA00000346F.o.22.1 | M00004300C:H09 | 7381 |
| 4838 | Mar. 24, 1998 | 136 | RTA00000424F.m.22.1 | M00001614C:E11 | 72943 |
| 4839 | Feb. 24, 1998 | 636 | RTA00000418F.e.21.1 | M00001577B:A03 | 74773 |
| 4840 | Feb. 24, 1998 | 1202 | RTA00000347F.h.10.1 | M00004206A:E02 | 22779 |
| 4841 | Feb. 24, 1998 | 1030 | RTA00000125A.c.17.1 | M00001542A:E04 | 80619 |
| 4842 | Feb. 24, 1998 | 753 | RTA00000345F.o.13.1 | M00001546B:F12 | 11500 |
| 4843 | Feb. 24, 1998 | 221 | RTA00000414F.f.13.1 | M00005259D:H08 | 0 |
| 4844 | Feb. 24, 1998 | 193 | RTA00000347F.b.10.1 | M00001546C:C07 | 8044 |
| 4845 | Feb. 24, 1998 | 1104 | RTA00000126A.b.10.1 | M00001547A:F06 | 0 |
| 4846 | Feb. 24, 1998 | 1177 | RTA00000126A.b.9.1 | M00001547A:F11 | 81279 |
| 4847 | Feb. 24, 1998 | 923 | RTA00000126A.d.19.1 | M00001548A:G01 | 79474 |
| 4848 | Feb. 24, 1998 | 98 | RTA00000411F.l.03.1 | M00003854D:A12 | 62702 |
| 4849 | Feb. 24, 1998 | 625 | RTA00000126A.h.22.2 | M00001549A:F01 | 0 |
| 4850 | Jan. 28, 1998 | 710 | RTA00000196AF.l.3.1 | M00001405B:D07 | 20864 |
| 4851 | Feb. 24, 1998 | 1102 | RTA00000126A.j.15.2 | M00001549A:H11 | 40425 |
| 4852 | Mar. 24, 1998 | 467 | RTA00000528F.h.02.2 | M00001632C:D08 | 1701 |
| 4853 | Jan. 28, 1998 | 411 | RTA00000179AF.j.13.3 | M00001400B:H06 | 0 |
| 4854 | Feb. 24, 1998 | 1126 | RTA00000136A.h.6.1 | M00001550A:D09 | 81620 |
| 4855 | Jan. 28, 1998 | 712 | RTA00000201F.b.21.1 | M00004341B:G03 | 9071 |
| 4856 | Feb. 24, 1998 | 1257 | RTA00000419F.h.21.1 | M00003856C:B08 | 64828 |
| 4857 | Feb. 24, 1998 | 194 | RTA00000124A.k.5.1 | M00001538A:F12 | 80252 |
| 4858 | Jan. 28, 1998 | 508 | RTA00000187AF.i.14.2 | M00001679B:H07 | 19406 |
| 4858 | Feb. 24, 1998 | 928 | RTA00000340F.m.04.1 | M00001679B:H07 | 19406 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4859 | Jan. 28, 1998 | 3 | RTA00000197AF.e.24.1 | M00001456B:F10 | 39250 |
| 4859 | Jan. 28, 1998 | 674 | RTA00000197AR.e.24.1 | M00001456B:F10 | 39250 |
| 4860 | Feb. 24, 1998 | 606 | RTA00000420F.l.20.2 | M00005232A:C10 | 0 |
| 4861 | Feb. 24, 1998 | 30 | RTA00000411F.m.24.1 | M00003870B:B08 | 77568 |
| 4862 | Feb. 24, 1998 | 31 | RTA00000134A.j.10.1 | M00001534A:G06 | 81383 |
| 4863 | Feb. 24, 1998 | 1136 | RTA00000406F.c.05.1 | M00003870A:H01 | 22077 |
| 4864 | Feb. 24, 1998 | 411 | RTA00000420F.m.12.1 | M00005234D:B04 | 0 |
| 4865 | Feb. 24, 1998 | 1086 | RTA00000403F.n.22.2 | M00001578B:B05 | 26775 |
| 4865 | Feb. 24, 1998 | 1085 | RTA00000403F.n.22.1 | M00001578B:B05 | 26775 |
| 4866 | Feb. 24, 1998 | 1018 | RTA00000413F.j.21.1 | M00004688A:A02 | 0 |
| 4867 | Feb. 24, 1998 | 657 | RTA00000124A.k.20.1 | M00001538A:C08 | 80913 |
| 4868 | Feb. 24, 1998 | 718 | RTA00000124A.k.23.1 | M00001538A:D03 | 81350 |
| 4869 | Feb. 24, 1998 | 1092 | RTA00000125A.c.2.1 | M00001542A:F06 | 40148 |
| 4870 | Feb. 24, 1998 | 615 | RTA00000135A.b.23.1 | M00001538A:D12 | 35241 |
| 4871 | Feb. 24, 1998 | 639 | RTA00000414F.d.09.1 | M00005231C:B01 | 0 |
| 4872 | Feb. 24, 1998 | 1086 | RTA00000403F.n.22.2 | M00001578B:B05 | 26775 |
| 4872 | Feb. 24, 1998 | 1085 | RTA00000403F.n.22.1 | M00001578B:B05 | 26775 |
| 4873 | Feb. 24, 1998 | 99 | RTA00000420F.m.19.1 | M00005254D:B05 | 0 |
| 4874 | Feb. 24, 1998 | 1085 | RTA00000403F.n.22.1 | M00001578B:B05 | 26775 |
| 4874 | Feb. 24, 1998 | 1086 | RTA00000403F.n.22.2 | M00001578B:B05 | 26775 |
| 4875 | Feb. 24, 1998 | 1086 | RTA00000403F.n.22.2 | M00001578B:B05 | 26775 |
| 4875 | Feb. 24, 1998 | 1085 | RTA00000403F.n.22.1 | M00001578B:B05 | 26775 |
| 4876 | Jan. 28, 1998 | 725 | RTA00000197AF.b.1.1 | M00001441D:E04 | 12134 |
| 4877 | Feb. 24, 1998 | 215 | RTA00000403F.j.18.1 | M00001539D:E10 | 5790 |
| 4878 | Feb. 24, 1998 | 1010 | RTA00000408F.n.16.2 | M00001540C:B03 | 73720 |
| 4879 | Feb. 24, 1998 | 1074 | RTA00000423F.h.11.1 | M00003867C:E11 | 38977 |
| 4880 | Feb. 24, 1998 | 27 | RTA00000420F.n.19.2 | M00005259B:C01 | 0 |
| 4881 | Jan. 28, 1998 | 578 | RTA00000180AF.g.17.1 | M00001426A:A09 | 16653 |
| 4882 | Feb. 24, 1998 | 1172 | RTA00000423F.h.03.1 | M00003875D:D09 | 37903 |
| 4883 | Feb. 24, 1998 | 1008 | RTA00000414F.f.07.1 | M00005259C:B05 | 0 |
| 4884 | Feb. 24, 1998 | 582 | RTA00000414F.e.14.1 | M00005236B:F10 | 0 |
| 4885 | Jan. 28, 1998 | 178 | RTA00000200F.o.03.1 | M00004257C:H06 | 22807 |
| 4885 | Jan. 28, 1998 | 249 | RTA00000200R.o.03.2 | M00004257C:H06 | 22807 |
| 4885 | Jan. 28, 1998 | 85 | RTA00000200R.o.03.1 | M00004257C:H06 | 22807 |
| 4886 | Feb. 24, 1998 | 1223 | RTA00000347F.a.14.1 | M00001429D:F11 | 7421 |
| 4887 | Feb. 24, 1998 | 488 | RTA00000339F.k.23.1 | M00001429D:H12 | 0 |
| 4888 | Mar. 24, 1998 | 100 | RTA00000424F.i.21.1 | M00001596A:E07 | 73482 |
| 4889 | Mar. 24, 1998 | 64 | RTA00000424F.i.24.1 | M00001596A:G06 | 79101 |
| 4890 | Mar. 24, 1998 | 207 | RTA00000424F.j.07.1 | M00001596B:C11 | 79211 |
| 4891 | Mar. 24, 1998 | 327 | RTA00000424F.j.08.1 | M00001596B:D09 | 73972 |
| 4892 | Mar. 24, 1998 | 349 | RTA00000424F.j.09.1 | M00001596B:H05 | 74387 |
| 4893 | Mar. 24, 1998 | 154 | RTA00000522F.h.13.1 | M00001596C:F09 | 40823 |
| 4894 | Feb. 24, 1998 | 1252 | RTA000004000F.g.08.1 | M00001639A:C11 | 1275 |
| 4895 | Feb. 24, 1998 | 261 | RTA00000341F.b.06.1 | M00003794A:E12 | 17008 |
| 4896 | Jan. 28, 1998 | 312 | RTA00000193AF.h.2.1 | M00004290A:B03 | 3273 |
| 4897 | Jan. 28, 1998 | 590 | RTA00000190AF.d.2.1 | M00003906B:F12 | 2444 |
| 4898 | Jan. 28, 1998 | 213 | RTA00000200F.o.04.1 | M00004260D:C12 | 12514 |
| 4899 | Feb. 24, 1998 | 333 | RTA00000399F.f.11.1 | M00001487F:F01 | 40167 |
| 4900 | Jan. 28, 1998 | 249 | RTA00000200R.o.03.2 | M00004257C:H06 | 22807 |
| 4900 | Jan. 28, 1998 | 178 | RTA00000200F.o.03.1 | M00004257C:H06 | 22807 |
| 4900 | Jan. 28, 1998 | 85 | RTA00000200R.o.03.1 | M00004257C:H06 | 22807 |
| 4901 | Jan. 28, 1998 | 85 | RTA00000200R.o.03.1 | M00004257C:H06 | 22807 |
| 4901 | Jan. 28, 1998 | 178 | RTA00000200F.o.03.1 | M00004257C:H06 | 22807 |
| 4901 | Jan. 28, 1998 | 249 | RTA00000200R.o.03.2 | M00004257C:H06 | 22807 |
| 4902 | Jan. 28, 1998 | 85 | RTA00000200R.o.03.1 | M00004257C:H06 | 22807 |
| 4902 | Jan. 28, 1998 | 249 | RTA00000200R.o.03.2 | M00004257C:H06 | 22807 |
| 4902 | Jan. 28, 1998 | 178 | RTA00000200F.o.03.1 | M00004257C:H06 | 22807 |
| 4903 | Jan. 28, 1998 | 249 | RTA00000200R.o.03.2 | M00004257C:H06 | 22807 |
| 4903 | Jan. 28, 1998 | 85 | RTA00000200R.o.03.1 | M00004257C:H06 | 22807 |
| 4903 | Jan. 28, 1998 | 178 | RTA00000200F.o.03.1 | M00004257C:H06 | 22807 |
| 4904 | Jan. 28, 1998 | 249 | RTA00000200R.o.03.2 | M00004257C:H06 | 22807 |
| 4904 | Jan. 28, 1998 | 85 | RTA00000200R.o.03.1 | M00004257C:H06 | 22807 |
| 4904 | Jan. 28, 1998 | 178 | RTA00000200F.o.03.1 | M00004257C:H06 | 22807 |
| 4905 | Mar. 24, 1998 | 133 | RTA00000425F.f.04.1 | M00001607A:B06 | 24633 |
| 4906 | Mar. 24, 1998 | 169 | RTA00000425F.f.05.1 | M00001607A:D10 | 24090 |
| 4907 | Feb. 24, 1998 | 44 | RTA00000418F.k.14.1 | M00001639A:H06 | 76133 |
| 4908 | Feb. 24, 1998 | 1204 | RTA00000419F.l.02.1 | M00003879A:C01 | 75736 |
| 4909 | Feb. 24, 1998 | 748 | RTA00000346F.f.11.1 | M00003793C:D09 | 38528 |
| 4910 | Feb. 24, 1998 | 4 | RTA00000339F.i.20.1 | M00001438D:C06 | 4356 |
| 4911 | Jan. 28, 1998 | 93 | RTA00000200F.o.11.1 | M00004270A:F11 | 0 |
| 4912 | Jan. 28, 1998 | 435 | RTA00000182AR.c.22.1 | M00001467C:D08 | 16283 |
| 4913 | Jan. 28, 1998 | 683 | RTA00000187AR.j.01.1 | M00001679C:D01 | 79028 |
| 4914 | Mar. 24, 1998 | 469 | RTA00000522F.e.20.1 | M00001590B:H10 | 26770 |
| 4915 | Jan. 28, 1998 | 172 | RTA00000186AF.p.09.2 | M00001655C:E04 | 6879 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4916 | Feb. 24, 1998 | 806 | RTA00000345F.f.08.1 | M00001413B:H09 | 0 |
| 4917 | Jan. 28, 1998 | 677 | RTA00000197AF.i.19.1 | M00001490B:H11 | 39554 |
| 4918 | Jan. 28, 1998 | 443 | RTA00000197AR.i.17.1 | M00001490A:E11 | 3516 |
| 4919 | Feb. 24, 1998 | 863 | RTA00000406F.p.08.1 | M00004032C:B02 | 37573 |
| 4920 | Mar. 24, 1998 | 55 | RTA00000528F.e.23.1 | M00001593B:D10 | 19242 |
| 4921 | Feb. 24, 1998 | 1211 | RTA00000399F.f.14.1 | M00001487D:C11 | 11483 |
| 4922 | Jan. 28, 1998 | 609 | RTA00000196AF.n.05.1 | M00001418B:F07 | 12531 |
| 4922 | Feb. 24, 1998 | 1120 | RTA00000353R.l.23.1 | M00001418B:F07 | 12531 |
| 4923 | Jan. 28, 1998 | 609 | RTA00000196AF.n.05.1 | M00001418B:F07 | 12531 |
| 4923 | Feb. 24, 1998 | 1120 | RTA00000353R.l.23.1 | M00001418B:F07 | 12531 |
| 4924 | Mar. 24, 1998 | 474 | RTA00000522F.h.05.1 | M00001595C:H11 | 73358 |
| 4925 | Jan. 28, 1998 | 284 | RTA00000199F.d.10.2 | M00003808C:B05 | 22049 |
| 4925 | Feb. 24, 1998 | 816 | RTA00000354R.n.04.1 | M00003808C:B05 | 22049 |
| 4926 | Feb. 24, 1998 | 1112 | RTA00000418F.c.05.1 | M00001487B:F02 | 76475 |
| 4927 | Jan. 28, 1998 | 687 | RTA00000197F.g.4.1 | M00001464B:B03 | 8821 |
| 4928 | Feb. 24, 1998 | 990 | RTA00000121A.h.19.1 | M00001471A:D04 | 80334 |
| 4929 | Jan. 28, 1998 | 696 | RTA00000180AR.d.16.3 | M00001419D:C10 | 11393 |
| 4929 | Feb. 24, 1998 | 1184 | RTA00000345F.h.08.1 | M00001419D:C10 | 11393 |
| 4930 | Jan. 28, 1998 | 751 | RTA00000179AF.c.4.3 | M00001392D:B11 | 0 |
| 4931 | Jan. 28, 1998 | 696 | RTA00000180AR.d.16.3 | M00001419D:C10 | 11393 |
| 4931 | Feb. 24, 1998 | 1184 | RTA00000345F.h.08.1 | M00001419D:C10 | 11393 |
| 4932 | Jan. 28, 1998 | 162 | RTA00000201F.e.15.1 | M00004444B:D11 | 9960 |
| 4933 | Jan. 28, 1998 | 126 | RTA00000201F.d.16.1 | M00004388B:A08 | 0 |
| 4934 | Jan. 28, 1998 | 332 | RTA00000193AR.n.04.3 | M00004375C:D01 | 9850 |
| 4935 | Feb. 24, 1998 | 838 | RTA00000408F.k.19.1 | M00001487C:G03 | 77593 |
| 4936 | Feb. 24, 1998 | 113 | RTA00000401F.e.02.1 | M00003805B:C04 | 0 |
| 4937 | Mar. 24, 1998 | 278 | RTA00000522F.g.21.1 | M00001595C:A09 | 77310 |
| 4938 | Mar. 24, 1998 | 54 | RTA00000425F.f.19.1 | M00001653D:G07 | 32635 |
| 4939 | Feb. 24, 1998 | 976 | RTA00000419F.b.17.1 | M00003808D:D04 | 63261 |
| 4940 | Feb. 24, 1998 | 59 | RTA00000346F.j.08.1 | M00003879B:A06 | 39951 |
| 4941 | Feb. 24, 1998 | 151 | RTA00000341F.c.21.1 | M00003789C:F06 | 7899 |
| 4942 | Jan. 28, 1998 | 67 | RTA00000200AF.g.07.1 | M00004128B:G01 | 0 |
| 4943 | Feb. 24, 1998 | 324 | RTA00000340F.p.17.1 | M00003750C:H05 | 0 |
| 4944 | Feb. 24, 1998 | 476 | RTA00000345F.h.01.1 | M00001441B:D11 | 10834 |
| 4945 | Feb. 24, 1998 | 245 | RTA00000195AF.d.20.1 | M00004117A:D11 | 37574 |
| 4945 | Jan. 28, 1998 | 87 | RTA00000195AF.d.20.1 | M00004117A:D11 | 37574 |
| 4946 | Feb. 24, 1998 | 245 | RTA00000195AF.d.20.1 | M00004117A:D11 | 37574 |
| 4946 | Jan. 28, 1998 | 87 | RTA00000195AF.d.20.1 | M00004117A:D11 | 37574 |
| 4947 | Feb. 24, 1998 | 991 | RTA00000419F.b.10.1 | M00001694C:G04 | 78566 |
| 4948 | Feb. 24, 1998 | 14 | RTA00000419F.b.09.1 | M00001694C:F12 | 78128 |
| 4949 | Jan. 28, 1998 | 261 | RTA00000192AF.a.24.1 | M00004114C:F11 | 13183 |
| 4950 | Jan. 28, 1998 | 24 | RTA00000200AF.f.11.1 | M00004111D:D11 | 0 |
| 4951 | Mar. 24, 1998 | 408 | RTA00000522F.o.10.1 | M00001660D:E05 | 78798 |
| 4952 | Jan. 28, 1998 | 328 | RTA00000200AF.g.09.1 | M00004131B:H09 | 22785 |
| 4952 | Jan. 28, 1998 | 26 | RTA00000200R.g.09.1 | M00004131B:H09 | 22785 |
| 4953 | Feb. 24, 1998 | 861 | RTA00000419F.b.06.1 | M00001694B:B08 | 76728 |
| 4954 | Mar. 24, 1998 | 24 | RTA00000522F.n.08.1 | M00001656A:D10 | 76343 |
| 4955 | Feb. 24, 1998 | 760 | RTA00000423F.d.04.1 | M00001694A:B12 | 11307 |
| 4956 | Mar. 24, 1998 | 220 | RTA00000522F.o.18.1 | M00001669B:H06 | 76366 |
| 4957 | Feb. 24, 1998 | 279 | RTA00000418F.i.21.1 | M00001596D:E10 | 78728 |
| 4958 | Jan. 28, 1998 | 84 | RTA00000191AF.h.14.1 | M00004056B:D09 | 13553 |
| 4959 | Jan. 28, 1998 | 284 | RTA00000199F.d.10.2 | M00003808C:B05 | 22049 |
| 4959 | Feb. 24, 1998 | 816 | RTA00000354R.n.04.1 | M00003808C:B05 | 22049 |
| 4960 | Feb. 24, 1998 | 217 | RTA00000399F.o.17.1 | M00001599D:A09 | 1106 |
| 4961 | Jan. 28, 1998 | 287 | RTA00000200AF.b.07.1 | M00004039C:C01 | 17125 |
| 4961 | Jan. 28, 1998 | 173 | RTA00000200AR.b.07.1 | M00004039C:C01 | 17125 |
| 4962 | Jan. 28, 1998 | 287 | RTA00000200AF.b.07.1 | M00004039C:C01 | 17125 |
| 4962 | Jan. 28, 1998 | 173 | RTA00000200AR.b.07.1 | M00004039C:C01 | 17125 |
| 4963 | Jan. 28, 1998 | 287 | RTA00000200AF.b.07.1 | M00004039C:C01 | 17125 |
| 4963 | Jan. 28, 1998 | 173 | RTA00000200AR.b.07.1 | M00004039C:C01 | 17125 |
| 4964 | Jan. 28, 1998 | 287 | RTA00000200AF.b.07.1 | M00004039C:C01 | 17125 |
| 4964 | Jan. 28, 1998 | 173 | RTA00000200AR.b.07.1 | M00004039C:C01 | 17125 |
| 4965 | Mar. 24, 1998 | 464 | RTA00000522F.p.18.1 | M00001671A:H06 | 76376 |
| 4966 | Mar. 24, 1998 | 453 | RTA00000522F.p.22.1 | M00001671B:F02 | 73322 |
| 4967 | Mar. 24, 1998 | 54 | RTA00000399F.o.01.1 | M00001595C:E01 | 3055 |
| 4968 | Feb. 24, 1998 | 1219 | RTA00000347F.e.20.1 | M00003771B:E05 | 39911 |
| 4969 | Feb. 24, 1998 | 825 | RTA00000404F.k.22.2 | M00001635D:C12 | 39084 |
| 4969 | Feb. 24, 1998 | 364 | RTA00000404F.k.22.1 | M00001635D:C12 | 39084 |
| 4970 | Jan. 28, 1998 | 241 | RTA00000200AF.l.17.1 | M00004217C:D03 | 12771 |
| 4970 | Jan. 28, 1998 | 151 | RTA00000200R.l.17.1 | M00004217C:D03 | 12771 |
| 4970 | Jan. 28, 1998 | 202 | RTA00000200R.l.17.2 | M00004217C:D03 | 12771 |
| 4971 | Jan. 28, 1998 | 241 | RTA00000200AF.l.17.1 | M00004217C:D03 | 12771 |
| 4971 | Jan. 28, 1998 | 151 | RTA00000200R.l.17.1 | M00004217C:D03 | 12771 |
| 4971 | Jan. 28, 1998 | 202 | RTA00000200R.l.17.2 | M00004217C:D03 | 12771 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 4972 | Jan. 28, 1998 | 241 | RTA00000200AF.l.17.1 | M00004217C:D03 | 12771 |
| 4972 | Jan. 28, 1998 | 202 | RTA00000200R.l.17.2 | M00004217C:D03 | 12771 |
| 4972 | Jan. 28, 1998 | 151 | RTA00000200R.l.17.1 | M00004217C:D03 | 12771 |
| 4973 | Jan. 28, 1998 | 241 | RTA00000200AF.l.17.1 | M00004217C:D03 | 12771 |
| 4973 | Jan. 28, 1998 | 202 | RTA00000200R.l.17.2 | M00004217C:D03 | 12771 |
| 4973 | Jan. 28, 1998 | 151 | RTA00000200R.l.17.1 | M00004217C:D03 | 12771 |
| 4974 | Jan. 28, 1998 | 241 | RTA00000200AF.l.17.1 | M00004217C:D03 | 12771 |
| 4974 | Jan. 28, 1998 | 202 | RTA00000200R.l.17.2 | M00004217C:D03 | 12771 |
| 4974 | Jan. 28, 1998 | 151 | RTA00000200R.l.17.1 | M00004217C:D03 | 12771 |
| 4975 | Jan. 28, 1998 | 241 | RTA00000200AF.l.17.1 | M00004217C:D03 | 12771 |
| 4975 | Jan. 28, 1998 | 151 | RTA00000200R.l.17.1 | M00004217C:D03 | 12771 |
| 4975 | Jan. 28, 1998 | 202 | RTA00000200R.l.17.2 | M00004217C:D03 | 12771 |
| 4976 | Jan. 28, 1998 | 241 | RTA00000200AF.l.17.1 | M00004217C:D03 | 12771 |
| 4976 | Jan. 28, 1998 | 151 | RTA00000200R.l.17.1 | M00004217C:D03 | 12771 |
| 4976 | Jan. 28, 1998 | 202 | RTA00000200R.l.17.2 | M00004217C:D03 | 12771 |
| 4977 | Jan. 28, 1998 | 241 | RTA00000200AF.l.17.1 | M00004217C:D03 | 12771 |
| 4977 | Jan. 28, 1998 | 151 | RTA00000200R.l.17.1 | M00004217C:D03 | 12771 |
| 4977 | Jan. 28, 1998 | 202 | RTA00000200R.l.17.2 | M00004217C:D03 | 12771 |
| 4978 | Jan. 28, 1998 | 241 | RTA00000200AF.l.17.1 | M00004217C:D03 | 12771 |
| 4978 | Jan. 28, 1998 | 151 | RTA00000200R.l.17.1 | M00004217C:D03 | 12771 |
| 4978 | Jan. 28, 1998 | 202 | RTA00000200R.l.17.2 | M00004217C:D03 | 12771 |
| 4979 | Jan. 28, 1998 | 366 | RTA00000192AF.o.19.1 | M00004208D:H08 | 3549 |
| 4980 | Jan. 28, 1998 | 328 | RTA00000200AF.g.09.1 | M00004131B:H09 | 22785 |
| 4980 | Jan. 28, 1998 | 26 | RTA00000200R.g.09.1 | M00004131B:H09 | 22785 |
| 4981 | Jan. 28, 1998 | 245 | RTA00000200AF.k.7.1 | M00004193C:G11 | 0 |
| 4982 | Feb. 24, 1998 | 1036 | RTA00000339F.k.08.1 | M00001439B:A10 | 8133 |
| 4983 | Feb. 24, 1998 | 72 | RTA00000347F.a.08.1 | M00001592C:G04 | 3135 |
| 4984 | Feb. 24, 1998 | 1163 | RTA00000341F.b.14.1 | M00003763A:C01 | 5992 |
| 4985 | Feb. 24, 1998 | 278 | RTA00000404F.c.10.1 | M00001593B:E11 | 23534 |
| 4986 | Jan. 28, 1998 | 250 | RTA00000192AF.j.21.1 | M00004176D:B12 | 2289 |
| 4987 | Feb. 24, 1998 | 511 | RTA00000341F.b.13.1 | M00003762B:H09 | 0 |
| 4988 | Jan. 28, 1998 | 27 | RTA00000192AF.i.12.1 | M00004619C:C12 | 5319 |
| 4989 | Feb. 24, 1998 | 416 | RTA00000404F.c.19.1 | M00001594A:D06 | 39026 |
| 4990 | Feb. 24, 1998 | 351 | RTA00000340F.p.20.1 | M00003752B:C02 | 17008 |
| 4991 | Jan. 28, 1998 | 215 | RTA00000192AR.e.14.3 | M00004142A:D08 | 3300 |
| 4992 | Jan. 28, 1998 | 163 | RTA00000192AR.e.13.3 | M00004142A:B12 | 9457 |
| 4993 | Jan. 28, 1998 | 318 | RTA00000200AF.g.17.1 | M00004138A:H09 | 0 |
| 4994 | Feb. 24, 1998 | 1105 | RTA00000340F.p.18.1 | M00003751C:A04 | 287 |
| 4995 | Feb. 24, 1998 | 1080 | RTA00000351R.g.06.1 | M00003771D:G05 | 0 |
| 4996 | Feb. 24, 1998 | 478 | RTA00000418F.h.08.1 | M00001589B:E07 | 76401 |
| 4997 | Feb. 24, 1998 | 584 | RTA00000418F.d.22.1 | M00001573B:C06 | 75324 |
| 4998 | Feb. 24, 1998 | 493 | RTA00000129A.d.1.2 | M00001587A:F05 | 80058 |
| 4999 | Feb. 24, 1998 | 402 | RTA00000420F.e.16.1 | M00004110A:E04 | 63639 |
| 5000 | Feb. 24, 1998 | 1006 | RTA00000129A.e.14.1 | M00001587A:F08 | 80053 |
| 5001 | Feb. 24, 1998 | 285 | RTA00000413F.i.02.1 | M00004110D:A10 | 65857 |
| 5002 | Jan. 28, 1998 | 659 | RTA00000185AR.k.23.2 | M00001601A:E09 | 0 |
| 5003 | Feb. 24, 1998 | 122 | RTA00000420F.f.06.1 | M00004115D:D08 | 64812 |
| 5004 | Feb. 24, 1998 | 245 | RTA00000195AF.d.20.1 | M00004117A:D11 | 37574 |
| 5004 | Jan. 28, 1998 | 87 | RTA00000195AF.d.20.1 | M00004117A:D11 | 37574 |
| 5005 | Jan. 28, 1998 | 87 | RTA00000195AF.d.20.1 | M00004117A:D11 | 37574 |
| 5005 | Feb. 24, 1998 | 245 | RTA00000195AF.d.20.1 | M00004117A:D11 | 37574 |
| 5006 | Feb. 24, 1998 | 720 | RTA00000129A.d.2.4 | M00001587A:G06 | 80119 |
| 5007 | Feb. 24, 1998 | 687 | RTA00000350R.g.10.1 | M00001587C:C10 | 9026 |
| 5008 | Mar. 24, 1998 | 18 | RTA00000522F.e.16.1 | M00001590A:C08 | 75283 |
| 5009 | Jan. 28, 1998 | 447 | RTA00000198AF.d.8.1 | M00001587A:H03 | 0 |
| 5010 | Jan. 28, 1998 | 554 | RTA00000186AR.e.07.4 | M00001623D:G03 | 4175 |
| 5010 | Jan. 28, 1998 | 400 | RTA00000186AR.e.07.3 | M00001623D:G03 | 4175 |
| 5011 | Jan. 28, 1998 | 526 | RTA00000185AF.e.20.1 | M00001585A:D06 | 5865 |
| 5012 | Feb. 24, 1998 | 1 | RTA00000404F.a.02.1 | M00001589B:E12 | 9738 |
| 5013 | Jan. 28, 1998 | 530 | RTA00000185AF.d.24.2 | M00001582D:F05 | 0 |
| 5014 | Feb. 24, 1998 | 1096 | RTA00000421F.a.06.1 | M00001589C:A11 | 2385 |
| 5015 | Jan. 28, 1998 | 131 | RTA00000185AF.d.11.2 | M00001579D:C03 | 6539 |
| 5015 | Jan. 28, 1998 | 626 | RTA00000185AR.d.11.1 | M00001579D:C03 | 6539 |
| 5016 | Jan. 28, 1998 | 626 | RTA00000185AR.d.11.1 | M00001579D:C03 | 6539 |
| 5016 | Jan. 28, 1998 | 131 | RTA00000185AF.d.11.2 | M00001579D:C03 | 6539 |
| 5017 | Feb. 24, 1998 | 1020 | RTA00000412F.p.06.1 | M00004038B:H10 | 65485 |
| 5018 | Jan. 28, 1998 | 671 | RTA00000185AR.d.08.1 | M00001579C:E09 | 6562 |
| 5019 | Feb. 24, 1998 | 1240 | RTA00000404F.a.18.1 | M00001590B:B02 | 36267 |
| 5020 | Feb. 24, 1998 | 115 | RTA00000418F.h.19.1 | M00001590B:C05 | 0 |
| 5021 | Feb. 24, 1998 | 211 | RTA00000404F.a.19.1 | M00001590B:C07 | 38624 |
| 5022 | Jan. 28, 1998 | 455 | RTA00000198AF.d.12.1 | M00001589A:C01 | 21142 |
| 5023 | Jan. 28, 1998 | 622 | RTA00000186AR.m.14.2 | M00001649B:G12 | 9800 |
| 5024 | Feb. 24, 1998 | 958 | RTA00000195AF.c.8.1 | M00001678B:H01 | 0 |
| 5024 | Jan. 28, 1998 | 520 | RTA00000195AF.c.8.1 | M00001678B:H01 | 0 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 5025 | Jan. 28, 1998 | 520 | RTA00000195AF.c.8.1 | M00001678B:H01 | 0 |
| 5025 | Feb. 24, 1998 | 958 | RTA00000195AF.c.8.1 | M00001678B:H01 | 0 |
| 5026 | Jan. 28, 1998 | 690 | RTA00000198R.l.21.1 | M00001673A:A04 | 19194 |
| 5027 | Feb. 24, 1998 | 772 | RTA00000413F.e.04.1 | M00004090C:C07 | 64176 |
| 5028 | Feb. 24, 1998 | 834 | RTA00000407F.b.11.1 | M00004090C:C10 | 0 |
| 5029 | Feb. 24, 1998 | 1154 | RTA00000403F.m.09.2 | M00001575B:G01 | 26814 |
| 5030 | Feb. 24, 1998 | 1203 | RTA00000413F.e.10.1 | M00004092C:B03 | 31033 |
| 5031 | Feb. 24, 1998 | 12 | RTA00000339F.b.17.1 | M00001366D:E12 | 10020 |
| 5032 | Feb. 24, 1998 | 947 | RTA00000347F.g.08.1 | M00004096B:F05 | 23121 |
| 5033 | Jan. 28, 1998 | 39 | RTA00000189AR.b.19.1 | M00003832B:E01 | 5294 |
| 5033 | Feb. 24, 1998 | 239 | RTA00000346F.j.02.1 | M00003832B:E01 | 5294 |
| 5034 | Jan. 28, 1998 | 39 | RTA00000189AR.b.19.1 | M00003832B:E01 | 5294 |
| 5034 | Feb. 24, 1998 | 239 | RTA00000346F.j.02.1 | M00003832B:E01 | 5294 |
| 5035 | Feb. 24, 1998 | 560 | RTA00000419F.d.16.1 | M00003828B:E07 | 64357 |
| 5036 | Feb. 24, 1998 | 568 | RTA00000403F.m.03.1 | M00001573D:D10 | 39179 |
| 5037 | Feb. 24, 1998 | 191 | RTA00000419F.d.17.1 | M00003828B:F09 | 64353 |
| 5038 | Feb. 24, 1998 | 607 | RTA00000420F.d.16.1 | M00004103D:F10 | 64485 |
| 5039 | Feb. 24, 1998 | 1130 | RTA00000354R.p.01.1 | M00004104C:H12 | 0 |
| 5040 | Feb. 24, 1998 | 710 | RTA00000413F.g.24.1 | M00004104D:A04 | 65481 |
| 5041 | Feb. 24, 1998 | 24 | RTA00000423F.l.09.1 | M00004118A:H08 | 9752 |
| 5042 | Feb. 24, 1998 | 896 | RTA00000423F.l.20.1 | M00004105C:E09 | 12580 |
| 5043 | Feb. 24, 1998 | 1078 | RTA00000423F.f.03.1 | M00003829C:D10 | 63852 |
| 5044 | Jan. 28, 1998 | 558 | RTA00000186AR.h.14.1 | M00001632D:H07 | 0 |
| 5045 | Feb. 24, 1998 | 155 | RTA00000413F.h.13.1 | M00004107A:D01 | 65190 |
| 5046 | Feb. 24, 1998 | 926 | RTA00000399F.k.20.1 | M00001585C:D10 | 3003 |
| 5047 | Feb. 24, 1998 | 1194 | RTA00000420F.e.05.1 | M00004107D:E12 | 63908 |
| 5048 | Jan. 28, 1998 | 400 | RTA00000186AR.e.07.3 | M00001623D:G03 | 4175 |
| 5048 | Jan. 28, 1998 | 554 | RTA00000186AR.e.07.4 | M00001623D:G03 | 4175 |
| 5049 | Feb. 24, 1998 | 570 | RTA00000405F.n.13.1 | M00003824A:G10 | 23810 |
| 5050 | Feb. 24, 1998 | 334 | RTA00000408F.p.05.1 | M00001575B:B02 | 9649 |
| 5051 | Feb. 24, 1998 | 1029 | RTA00000411F.f.04.1 | M00003813A:G04 | 64526 |
| 5052 | Mar. 24, 1998 | 134 | RTA00000424F.c.14.3 | M00001476D:A09 | 76614 |
| 5053 | Feb. 24, 1998 | 396 | RTA00000406F.e.21.1 | M00003877D:G05 | 9090 |
| 5054 | Mar. 24, 1998 | 230 | RTA00000424F.g.14.1 | M00001572A:B06 | 74879 |
| 5055 | Feb. 24, 1998 | 617 | RTA00000423F.f.23.1 | M00003816C:E09 | 15390 |
| 5056 | Feb. 24, 1998 | 5 | RTA00000408F.o.12.2 | M00001572A:A10 | 78578 |
| 5057 | Feb. 24, 1998 | 689 | RTA00000419F.p.03.1 | M00004035A:G10 | 1937 |
| 5058 | Mar. 24, 1998 | 273 | RTA00000424F.a.02.4 | M00001575A:D06 | 78806 |
| 5059 | Feb. 24, 1998 | 241 | RTA00000339F.d.13.1 | M00001395C:F11 | 0 |
| 5060 | Mar. 24, 1998 | 237 | RTA00000522F.c.01.1 | M00001576A:C11 | 74938 |
| 5061 | Jan. 28, 1998 | 745 | RTA00000183AF.m.11.1 | M00001536D:G02 | 8927 |
| 5062 | Jan. 28, 1998 | 408 | RTA00000183AR.l.15.1 | M00001535C:E01 | 39383 |
| 5063 | Feb. 24, 1998 | 464 | RTA00000195AF.c.12.1 | M00003818B:G12 | 37582 |
| 5063 | Jan. 28, 1998 | 300 | RTA00000195AF.c.12.1 | M00003818B:G12 | 37582 |
| 5064 | Jan. 28, 1998 | 647 | RTA00000197F.m.11.1 | M00001530B:D10 | 16488 |
| 5065 | Feb. 24, 1998 | 464 | RTA00000195AF.c.12.1 | M00003818B:G12 | 37582 |
| 5065 | Jan. 28, 1998 | 300 | RTA00000195AF.c.12.1 | M00003818B:G12 | 37582 |
| 5066 | Mar. 24, 1998 | 395 | RTA00000522F.d.06.1 | M00001578B:A02 | 74809 |
| 5067 | Feb. 24, 1998 | 516 | RTA00000339F.f.20.1 | M00001399A:C03 | 6494 |
| 5068 | Feb. 24, 1998 | 890 | RTA00000418F.j.19.1 | M00001634D:D02 | 78399 |
| 5069 | Feb. 24, 1998 | 435 | RTA00000340F.b.02.1 | M00001503C:G05 | 10185 |
| 5070 | Mar. 24, 1998 | 175 | RTA00000528F.d.18.1 | M00001582C:E01 | 2684 |
| 5071 | Feb. 24, 1998 | 168 | RTA00000411F.e.22.1 | M00003812B:D07 | 63638 |
| 5072 | Feb. 24, 1998 | 1071 | RTA00000404F.k.18.2 | M00001635A:C06 | 5475 |
| 5073 | Feb. 24, 1998 | 189 | RTA00000347F.a.13.1 | M00001402D:F02 | 22446 |
| 5074 | Feb. 24, 1998 | 825 | RTA00000404F.k.22.2 | M00001635D:C12 | 39084 |
| 5074 | Feb. 24, 1998 | 364 | RTA00000404F.k.22.1 | M00001635D:C12 | 39084 |
| 5075 | Mar. 24, 1998 | 25 | RTA00000425F.c.06.1 | M00001585D:D11 | 78041 |
| 5076 | Mar. 24, 1998 | 186 | RTA00000425F.c.07.1 | M00001585C:F03 | 76042 |
| 5077 | Mar. 24, 1998 | 208 | RTA00000424F.m.10.1 | M00001586C:E06 | 34251 |
| 5078 | Feb. 24, 1998 | 420 | RTA00000422F.b.16.1 | M00003813B:A11 | 17045 |
| 5079 | Mar. 24, 1998 | 103 | RTA00000424F.b.22.1 | M00001530A:F11 | 72971 |
| 5079 | Mar. 24, 1998 | 88 | RTA00000424F.b.22.4 | M00001530A:F11 | 72971 |
| 5080 | Mar. 24, 1998 | 318 | RTA00000523F.a.01.1 | M00001671C:F11 | 74923 |
| 5081 | Feb. 24, 1998 | 676 | RTA00000411F.g.21.1 | M00003823D:G05 | 64500 |
| 5082 | Mar. 24, 1998 | 3 | RTA00000528F.b.23.1 | M00001479C:F10 | 1605 |
| 5083 | Feb. 24, 1998 | 1244 | RTA00000418F.h.23.1 | M00001591A:B08 | 75153 |
| 5084 | Feb. 24, 1998 | 321 | RTA00000339F.c.21.1 | M00001389C:A08 | 5325 |
| 5085 | Jan. 28, 1998 | 429 | RTA00000196F.i.19.1 | M00001390C:C11 | 39498 |
| 5085 | Feb. 24, 1998 | 925 | RTA00000353R.h.10.1 | M00001390C:C11 | 39498 |
| 5086 | Jan. 28, 1998 | 429 | RTA00000196F.i.19.1 | M00001390C:C11 | 39498 |
| 5086 | Feb. 24, 1998 | 925 | RTA00000353R.h.10.1 | M00001390C:C11 | 39498 |
| 5087 | Mar. 24, 1998 | 471 | RTA00000528F.c.11.1 | M00001486D:D12 | 1701 |
| 5088 | Feb. 24, 1998 | 103 | RTA00000418F.j.12.1 | M00001626C:G08 | 73316 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 5089 | Feb. 24, 1998 | 1148 | RTA00000345F.d.23.1 | M00001390D:E03 | 5862 |
| 5090 | Feb. 24, 1998 | 87 | RTA00000403F.l.20.1 | M00001573A:A06 | 18267 |
| 5091 | Mar. 24, 1998 | 427 | RTA00000522F.b.08.1 | M00001570D:E06 | 26915 |
| 5092 | Jan. 28, 1998 | 661 | RTA00000198R.b.04.1 | M00001565A:H09 | 0 |
| 5093 | Feb. 24, 1998 | 200 | RTA00000339F.c.02.1 | M00001381C:B08 | 12975 |
| 5094 | Feb. 24, 1998 | 1243 | RTA00000404F.j.19.1 | M00001630D:H10 | 0 |
| 5095 | Jan. 28, 1998 | 750 | RTA00000198AF.a.19.1 | M00001561D:C05 | 0 |
| 5096 | Feb. 24, 1998 | 418 | RTA00000410F.a.01.1 | M00001631D:B10 | 73354 |
| 5097 | Mar. 24, 1998 | 458 | RTA00000424F.d.12.3 | M00001530D:E06 | 74342 |
| 5097 | Mar. 24, 1998 | 454 | RTA00000424F.d.12.2 | M00001530D:E06 | 74342 |
| 5098 | Mar. 24, 1998 | 458 | RTA00000424F.d.12.3 | M00001530D:E06 | 74342 |
| 5098 | Mar. 24, 1998 | 454 | RTA00000424F.d.12.2 | M00001530D:E06 | 74342 |
| 5099 | Feb. 24, 1998 | 159 | RTA00000348R.j.17.1 | M00001391D:C06 | 2641 |
| 5100 | Feb. 24, 1998 | 539 | RTA00000346F.m.15.1 | M00004037B:C04 | 13553 |
| 5101 | Feb. 24, 1998 | 170 | RTA00000422F.n.08.1 | M00001632B:E05 | 38655 |
| 5102 | Mar. 24, 1998 | 162 | RTA00000522F.a.12.1 | M00001567A:H05 | 33515 |
| 5103 | Feb. 24, 1998 | 315 | RTA00000419F.p.12.1 | M00004037A:E04 | 13767 |
| 5104 | Feb. 24, 1998 | 119 | RTA00000423F.k.05.1 | M00004036D:F02 | 37472 |
| 5105 | Mar. 24, 1998 | 12 | RTA00000522F.a.23.1 | M00001570C:A05 | 38613 |
| 5106 | Mar. 24, 1998 | 103 | RTA00000424F.b.22.1 | M00001530A:F11 | 72971 |
| 5106 | Mar. 24, 1998 | 88 | RTA00000424F.b.22.4 | M00001530A:F11 | 72971 |
| 5107 | Feb. 24, 1998 | 21 | RTA00000411F.g.08.1 | M00003822D:D04 | 45815 |
| 5108 | Jan. 28, 1998 | 35 | RTA00000191AF.n.17.1 | M00004091B:D11 | 7848 |
| 5109 | Mar. 24, 1998 | 39 | RTA00000527F.c.23.1 | M00003822C:A07 | 37742 |
| 5110 | Jan. 28, 1998 | 43 | RTA00000179AF.c.14.3 | M00001392D:H04 | 0 |
| 5111 | Feb. 24, 1998 | 54 | RTA00000399F.o.01.1 | M00001595C:E01 | 3055 |
| 5112 | Feb. 24, 1998 | 63 | RTA00000404F.l.20.2 | M00001639B:H05 | 38638 |
| 5113 | Jan. 28, 1998 | 82 | RTA00000183AF.l.18.1 | M00001535D:C01 | 3484 |
| 5114 | Mar. 24, 1998 | 84 | RTA00000527F.k.18.1 | M00003982B:C10 | 11332 |
| 5115 | Jan. 28, 1998 | 99 | RTA00000184AF.d.8.1 | M00001548A:A08 | 4393 |
| 5116 | Feb. 24, 1998 | 99 | RTA00000420F.m.19.1 | M00005254D:B08 | 0 |
| 5117 | Feb. 24, 1998 | 100 | RTA00000339F.o.23.1 | M00001473C:D09 | 7801 |
| 5118 | Feb. 24, 1998 | 104 | RTA00000421F.n.03.1 | M00001675C:A04 | 1638 |
| 5119 | Feb. 24, 1998 | 105 | RTA00000346F.d.08.1 | M00001671A:A10 | 39955 |
| 5120 | Feb. 24, 1998 | 114 | RTA00000341F.m.21.1 | M00004051D:E01 | 0 |
| 5121 | Jan. 28, 1998 | 137 | RTA00000181AF.m.4.3 | M00001455A:E09 | 13238 |
| 5122 | Jan. 28, 1998 | 162 | RTA00000201F.e.15.1 | M00004444B:D11 | 9960 |
| 5123 | Jan. 28, 1998 | 170 | RTA00000197AF.d.23.1 | M00001453A:E11 | 16130 |
| 5124 | Jan. 28, 1998 | 206 | RTA00000181AF.o.04.2 | M00001457C:C12 | 22205 |
| 5125 | Jan. 28, 1998 | 209 | RTA00000182AF.c.5.1 | M00001464D:F06 | 6397 |
| 5126 | Feb. 24, 1998 | 215 | RTA00000403F.j.18.1 | M00001539D:E10 | 5790 |
| 5127 | Feb. 24, 1998 | 219 | RTA00000419F.c.18.1 | M00003819D:B11 | 41394 |
| 5128 | Jan. 28, 1998 | 229 | RTA00000198AF.g.3.1 | M00001615C:F03 | 0 |
| 5129 | Jan. 28, 1998 | 230 | RTA00000185AR.b.18.1 | M00001575B:C09 | 12171 |
| 5130 | Mar. 24, 1998 | 245 | RTA00000522F.p.09.1 | M00001670A:F09 | 75204 |
| 5131 | Feb. 24, 1998 | 258 | RTA00000406F.k.15.1 | M00003907C:C04 | 38549 |
| 5132 | Jan. 28, 1998 | 262 | RTA00000186AF.c.17.1 | M00001619D:G05 | 8551 |
| 5133 | Jan. 28, 1998 | 269 | RTA00000183AF.k.13.1 | M00001534B:C12 | 0 |
| 5134 | Jan. 28, 1998 | 276 | RTA00000198AF.j.15.1 | M00001653B:E09 | 4369 |
| 5135 | Feb. 24, 1998 | 281 | RTA00000411F.l.13.1 | M00003857C:C09 | 43114 |
| 5136 | Jan. 28, 1998 | 284 | RTA00000199F.d.10.2 | M00003808C:B05 | 22049 |
| 5137 | Jan. 28, 1998 | 292 | RTA00000199AF.m.18.1 | M00003939C:F04 | 0 |
| 5138 | Jan. 28, 1998 | 297 | RTA00000178AF.f.9.3 | M00001371C:E09 | 7172 |
| 5139 | Feb. 24, 1998 | 301 | RTA00000401F.m.23.1 | M00003914C:C02 | 2801 |
| 5140 | Jan. 28, 1998 | 302 | RTA00000186AF.d.1.2 | M00001621C:C05 | 40044 |
| 5141 | Jan. 28, 1998 | 315 | RTA00000199R.d.23.1 | M00003815D:H09 | 37477 |
| 5142 | Feb. 24, 1998 | 315 | RTA00000419F.p.12.1 | M00004037A:E04 | 13767 |
| 5143 | Jan. 28, 1998 | 321 | RTA00000181AR.b.21.1 | M00001444C:D05 | 3266 |
| 5144 | Mar. 24, 1998 | 323 | RTA00000524F.c.12.1 | M00005218B:D09 | 0 |
| 5145 | Jan. 28, 1998 | 329 | RTA00000186AF.b.9.1 | M00001616C:F07 | 0 |
| 5146 | Jan. 28, 1998 | 334 | RTA00000181AR.b.21.3 | M00001444C:D05 | 3266 |
| 5147 | Feb. 24, 1998 | 334 | RTA00000408F.p.05.1 | M00001575B:B02 | 9649 |
| 5148 | Jan. 28, 1998 | 335 | RTA00000182AF.e.3.2 | M00001468B:H06 | 0 |
| 5149 | Jan. 28, 1998 | 336 | RTA00000186AF.f.24.1 | M00001629B:E06 | 0 |
| 5150 | Feb. 24, 1998 | 341 | RTA00000412F.g.20.2 | M00003972C:F08 | 25018 |
| 5151 | Feb. 24, 1998 | 343 | RTA00000422F.g.21.1 | M00001583A:F07 | 17232 |
| 5152 | Jan. 28, 1998 | 347 | RTA00000199F.b.03.2 | M00003779B:E12 | 38340 |
| 5153 | Feb. 24, 1998 | 354 | RTA00000404F.c.03.2 | M00001592C:F11 | 39198 |
| 5154 | Jan. 28, 1998 | 361 | RTA00000177AR.g.16.4 | M00001347A:B10 | 13576 |
| 5155 | Jan. 28, 1998 | 364 | RTA00000187AF.g.13.1 | M00001676C:C11 | 2991 |
| 5156 | Feb. 24, 1998 | 377 | RTA00000346F.i.01.1 | M00003797A:D06 | 22260 |
| 5157 | Feb. 24, 1998 | 389 | RTA00000411F.c.02.1 | M00001677B:B04 | 72852 |
| 5158 | Feb. 24, 1998 | 403 | RTA00000403F.d.22.1 | M00001473A:A07 | 10692 |
| 5159 | Jan. 28, 1998 | 407 | RTA00000178AF.e.20.1 | M00001370D:E12 | 3135 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 5160 | Jan. 28, 1998 | 422 | RTA00000189AF.b.12.1 | M00003829B:G03 | 17233 |
| 5161 | Feb. 24, 1998 | 429 | RTA00000422F.c.17.1 | M00004099D:F01 | 1360 |
| 5162 | Feb. 24, 1998 | 431 | RTA00000399F.j.15.1 | M00001578C:G06 | 1261 |
| 5163 | Jan. 28, 1998 | 439 | RTA00000185AF.d.14.2 | M00001579D:G07 | 8071 |
| 5164 | Feb. 24, 1998 | 448 | RTA00000127A.a.3.1 | M00001552A:H10 | 13232 |
| 5165 | Feb. 24, 1998 | 450 | RTA00000118A.a.23.1 | M00001395A:H02 | 3500 |
| 5166 | Jan. 28, 1998 | 451 | RTA00000200AF.b.20.1 | M00004043A:D02 | 40403 |
| 5167 | Feb. 24, 1998 | 455 | RTA00000399F.d.23.1 | M00001481B:A07 | 3310 |
| 5168 | Jan. 28, 1998 | 475 | RTA00000187AR.m.3.3 | M00001682C:B12 | 17055 |
| 5169 | Mar. 24, 1998 | 475 | RTA00000427F.i.06.1 | M00004097B:D03 | 41450 |
| 5170 | Mar. 24, 1998 | 477 | RTA00000527F.l.21.1 | M00003983D:H02 | 36439 |
| 5171 | Jan. 28, 1998 | 480 | RTA00000181AF.o.08.2 | M00001457C:H12 | 849 |
| 5172 | Mar. 24, 1998 | 480 | RTA00000424F.d.17.3 | M00001455A:E11 | 73958 |
| 5173 | Mar. 24, 1998 | 481 | RTA00000523F.j.02.1 | M00003857A:H10 | 62853 |
| 5174 | Jan. 28, 1998 | 483 | RTA00000192AF.h.19.1 | M00004162C:A07 | 4642 |
| 5175 | Feb. 24, 1998 | 489 | RTA00000406F.j.19.1 | M00003906A:F12 | 1685 |
| 5176 | Jan. 28, 1998 | 501 | RTA00000200R.k.11.1 | M00004197C:F03 | 9796 |
| 5177 | Feb. 24, 1998 | 502 | RTA00000341F.d.08.1 | M00003824C:D07 | 0 |
| 5178 | Feb. 24, 1998 | 508 | RTA00000420F.i.20.1 | M00005101C:E12 | 0 |
| 5179 | Jan. 28, 1998 | 510 | RTA00000178AF.n.23.1 | M00001387B:E02 | 3298 |
| 5180 | Jan. 28, 1998 | 511 | RTA00000196AF.g.10.1 | M00001376B:A02 | 12498 |
| 5181 | Feb. 24, 1998 | 519 | RTA00000404F.l.10.1 | M00001638B:F10 | 23136 |
| 5182 | Feb. 24, 1998 | 524 | RTA00000419F.f.23.1 | M00003840D:H10 | 65002 |
| 5183 | Jan. 28, 1998 | 525 | RTA00000198AF.c.7.1 | M00001575D:G05 | 19181 |
| 5184 | Jan. 28, 1998 | 526 | RTA00000185AF.e.20.1 | M00001585A:D06 | 5865 |
| 5185 | Jan. 28, 1998 | 527 | RTA00000198R.m.23.1 | M00001684B:G03 | 38469 |
| 5186 | Jan. 28, 1998 | 529 | RTA00000178AF.b.13.1 | M00001364A:E11 | 3114 |
| 5187 | Jan. 28, 1998 | 530 | RTA00000185AF.d.24.2 | M00001582D:F05 | 0 |
| 5188 | Jan. 28, 1998 | 540 | RTA00000179AF.b.10.3 | M00001391D:D10 | 0 |
| 5189 | Jan. 28, 1998 | 541 | RTA00000197AR.b.16.1 | M00001445C:A08 | 0 |
| 5190 | Jan. 28, 1998 | 545 | RTA00000196F.a.2.1 | M00001338B:E02 | 3575 |
| 5191 | Feb. 24, 1998 | 547 | RTA00000419F.h.02.1 | M00003845D:G08 | 63985 |
| 5192 | Jan. 28, 1998 | 548 | RTA00000179AF.f.23.3 | M00001397B:G03 | 35258 |
| 5193 | Jan. 28, 1998 | 550 | RTA00000183AF.g.14.1 | M00001513D:A03 | 0 |
| 5194 | Feb. 24, 1998 | 555 | RTA00000133A.d.22.1 | M00001469A:G11 | 11797 |
| 5195 | Jan. 28, 1998 | 569 | RTA00000196F.l.23.1 | M00001412A:E04 | 12052 |
| 5196 | Jan. 28, 1998 | 570 | RTA00000183AF.a.19.2 | M00001499A:A05 | 3788 |
| 5197 | Jan. 28, 1998 | 574 | RTA00000192AF.f.3.1 | M00004146C:C11 | 5257 |
| 5198 | Jan. 28, 1998 | 575 | RTA00000186AF.l.12.2 | M00001645A:C12 | 19267 |
| 5199 | Jan. 28, 1998 | 576 | RTA00000196AF.c.7.1 | M00001350B:G11 | 0 |
| 5200 | Feb. 24, 1998 | 579 | RTA00000413F.m.16.1 | M00004898C:F03 | 0 |
| 5201 | Jan. 28, 1998 | 580 | RTA00000197F.a.12.1 | M00001438B:B09 | 7895 |
| 5202 | Feb. 24, 1998 | 580 | RTA00000403F.o.07.1 | M00001579C:A01 | 39037 |
| 5203 | Feb. 24, 1998 | 584 | RTA00000418F.d.22.1 | M00001573B:C06 | 75324 |
| 5204 | Jan. 28, 1998 | 585 | RTA00000198AF.n.18.1 | M00001771A:A07 | 16715 |
| 5205 | Jan. 28, 1998 | 601 | RTA00000184AF.i.10.2 | M00001555A:B01 | 3744 |
| 5206 | Jan. 28, 1998 | 607 | RTA00000200AF.k.12.1 | M00004198B:D02 | 7359 |
| 5207 | Jan. 28, 1998 | 613 | RTA00000177AF.k.18.4 | M00001352C:A05 | 53729 |
| 5208 | Jan. 28, 1998 | 640 | RTA00000190AF.f.5.1 | M00003909A:H04 | 5015 |
| 5209 | Feb. 24, 1998 | 645 | RTA00000422F.p.12.2 | M00001661C:F10 | 9840 |
| 5210 | Jan. 28, 1998 | 654 | RTA00000186AF.j.21.2 | M00001639D:B07 | 22506 |
| 5211 | Jan. 28, 1998 | 680 | RTA00000177AF.f.10.1 | M00001345A:E01 | 6420 |
| 5212 | Jan. 28, 1998 | 699 | RTA00000175AF.a.12.1 | M00001362B:H06 | 0 |
| 5213 | Jan. 28, 1998 | 703 | RTA00000198F.l.09.1 | M00001664B:D06 | 3611 |
| 5214 | Jan. 28, 1998 | 704 | RTA00000190AF.o.12.1 | M00003972D:C09 | 3438 |
| 5215 | Jan. 28, 1998 | 723 | RTA00000183AF.p.24.1 | M00001543C:F01 | 3116 |
| 5216 | Feb. 24, 1998 | 733 | RTA00000405F.d.18.1 | M00001662C:B02 | 10494 |
| 5217 | Jan. 28, 1998 | 739 | RTA00000181AF.p.12.3 | M00001460C:H02 | 22204 |
| 5218 | Jan. 28, 1998 | 742 | RTA00000177AF.m.1.1 | M00001353D:D10 | 14929 |
| 5219 | Feb. 24, 1998 | 774 | RTA00000403F.e.24.1 | M00001476B:D10 | 16432 |
| 5220 | Feb. 24, 1998 | 775 | RTA00000405F.c.22.1 | M00001660C:B06 | 39053 |
| 5221 | Feb. 24, 1998 | 790 | RTA00000345F.n.08.1 | M00001517A:B11 | 0 |
| 5222 | Feb. 24, 1998 | 816 | RTA00000354R.n.04.1 | M00003808C:B05 | 22049 |
| 5223 | Feb. 24, 1998 | 829 | RTA00000411F.m.11.1 | M00003867A:D12 | 73196 |
| 5224 | Feb. 24, 1998 | 851 | RTA00000423F.d.07.1 | M00001678B:B12 | 0 |
| 5225 | Feb. 24, 1998 | 871 | RTA00000403F.f.23.1 | M00001479C:E01 | 39223 |
| 5226 | Feb. 24, 1998 | 877 | RTA00000418F.m.22.1 | M00001654D:E12 | 74567 |
| 5227 | Feb. 24, 1998 | 914 | RTA00000138A.m.15.1 | M00001624A:A03 | 41603 |
| 5228 | Feb. 24, 1998 | 923 | RTA00000126A.d.19.1 | M00001548A:G01 | 79474 |
| 5229 | Feb. 24, 1998 | 924 | RTA00000354R.m.02.1 | M00003890B:C08 | 12766 |
| 5230 | Feb. 24, 1998 | 940 | RTA00000414F.f.17.1 | M00005260A:F04 | 0 |
| 5231 | Feb. 24, 1998 | 1005 | RTA00000339F.e.17.1 | M00001397D:G08 | 7568 |
| 5232 | Feb. 24, 1998 | 1013 | RTA00000404F.b.18.1 | M00001592A:H05 | 13669 |
| 5233 | Feb. 24, 1998 | 1037 | RTA00000339F.l.12.1 | M00001450A:G11 | 7711 |

TABLE 1-continued

| SEQ ID NO: | Filing Date of Priority Appln | SEQ ID NO: in Priority Appln | Sequence Name | Clone Name | Cluster ID |
|---|---|---|---|---|---|
| 5234 | Feb. 24, 1998 | 1055 | RTA00000346F.a.04.1 | M00001607B:C05 | 5382 |
| 5235 | Feb. 24, 1998 | 1070 | RTA00000346F.n.22.1 | M00004137A:D06 | 0 |
| 5236 | Feb. 24, 1998 | 1096 | RTA00000421F.a.06.1 | M00001589C:A11 | 2385 |
| 5237 | Feb. 24, 1998 | 1125 | RTA00000118A.n.5.1 | M00001451A:C10 | 0 |
| 5238 | Feb. 24, 1998 | 1128 | RTA00000423F.a.02.3 | M00001656B:A08 | 39210 |
| 5239 | Feb. 24, 1998 | 1129 | RTA00000401F.m.07.1 | M00003907D:F11 | 2893 |
| 5240 | Feb. 24, 1998 | 1136 | RTA00000406F.c.05.1 | M00003870A:H01 | 22077 |
| 5241 | Feb. 24, 1998 | 1142 | RTA00000418F.i.06.1 | M00001591B:B06 | 75151 |
| 5242 | Feb. 24, 1998 | 1145 | RTA00000423F.k.21.2 | M00003984D:B08 | 37499 |
| 5243 | Feb. 24, 1998 | 1149 | RTA00000339F.b.02.1 | M00001344B:F12 | 0 |
| 5244 | Feb. 24, 1998 | 1166 | RTA00000347F.h.01.1 | M00004040A:G12 | 12043 |
| 5245 | Feb. 24, 1998 | 1177 | RTA00000126A.b.9.1 | M00001547A:F11 | 81279 |
| 5246 | Feb. 24, 1998 | 1187 | RTA00000120A.c.19.1 | M00001464A:B03 | 81016 |
| 5247 | Feb. 24, 1998 | 1203 | RTA00000413F.e.10.1 | M00004092C:B03 | 31033 |
| 5248 | Feb. 24, 1998 | 1205 | RTA00000419F.k.05.1 | M00003871C:E04 | 11757 |
| 5249 | Feb. 24, 1998 | 1230 | RTA00000399F.j.14.1 | M00001578C:F05 | 16942 |
| 5250 | Feb. 24, 1998 | 1233 | RTA00000418F.l.02.1 | M00001641C:C05 | 39316 |
| 5251 | Feb. 24, 1998 | 1248 | RTA00000419F.o.07.1 | M00003986C:E09 | 14059 |
| 5252 | Feb. 24, 1998 | 1261 | RTA00000404F.m.17.2 | M00001643B:E05 | 0 |

TABLE 2

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2503 | AB011149 | *Homo sapiens* mRNA for KIAA0577 protein, complete cds | 0 | 3043678 | (AB011149) KIAA0577 protein [*Homo sapiens*] | 1e-096 |
| 2504 | <NONE> | <NONE> | <NONE> | <NONE> | <NONE> | <NONE> |
| 2505 | Z59973 | *H. sapiens* CpG DNA, clone 184b10, forward read cpg184b10.ft1a. | 1e-009 | <NONE> | <NONE> | <NONE> |
| 2506 | AJ000742 | *Homo Sapiens* hisH1 gene, 5' UTR | 2e-016 | <NONE> | <NONE> | <NONE> |
| 2507 | U10324 | Human nuclear factor NF90 mRNA, complete cds. | 3e-009 | 1729881 | TETRACYCLINE RESISTANCE PROTEIN, CLASS H (TETA(H)) >gi\|392873 (U00792) tetracycline resistance protein [*Pasteurella multocida*] | 9.3 |
| 2508 | U95094 | *Xenopus laevis* XL-INCENP (XL-INCENP) mRNA, complete cds | 3e-010 | 1890128 | (U89949) folate binding protein [*Sus scrofa*] | 7.3 |
| 2509 | M15657 | Human aldolase B (ALDOB) gene, exons 2 through 6. | 0.002 | <NONE> | <NONE> | <NONE> |
| 2510 | U95094 | *Xenopus laevis* XL-INCENP (XL-INCENP) mRNA, complete cds | 8e-008 | <NONE> | <NONE> | <NONE> |
| 2511 | U39722 | Mycoplasma genitalium section 44 of 51 of the complete genome | 0.043 | 2773162 | (AF039595) sulfonylurea receptor 1B [*Rattus norvegicus*] | 10 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2512 | AB012174 | *Homo sapiens* DNA, anonymous heat-stable fragment RP7-1B | 7e-017 | <NONE> | <NONE> | <NONE> |
| 2513 | AB012174 | *Homo sapiens* DNA, anonymous heat-stable fragment RP7-1B | 7e-017 | <NONE> | <NONE> | <NONE> |
| 2514 | U95094 | *Xenopus laevis* XL-INCENP (XL-INCENP) mRNA, complete cds | 7e-007 | 2984585 | (AC004472) P1.11659_4 [*Homo sapiens*] | 1e-013 |
| 2515 | AF061016 | *Homo sapiens* UDP-glucose dehydrogenase (UGDH) mRNA, complete cds | 0 | 3127127 | (AF061016) UDP-glucose dehydrogenase [*Homo sapiens*] dehydrogenase [*Homo sapiens*] | 7e-035 |
| 2516 | U95102 | *Xenopus laevis* mitotic phosphoprotein 90 mRNA, complete cds | 6e-005 | 2983872 | (AE000742) putative protein [*Aquifex aeolicus*] | 1.5 |
| 2517 | X13293 | Human mRNA for B-myb gene | 3e-019 | 127584 | MYB-RELATED PROTEIN B(B-MYB) human >gi|29472 (X13293) B-myb protein (AA 1-700) [*Homo sapiens*] | 0.0002 |
| 2518 | Y10183 | *H. sapiens* mRNA for MEMD protein | 0 | 3882036 | (AJ010405) hypothetical protein | 2.5 |
| 2519 | M90297 | Human glucokinase (GCK) gene, exon 1 and 5' flanking region. | 4e-023 | 2851668 | HYPOTHETICAL OUTER MEMBRANE USHER PROTEIN IN RIBB-GLGS INTERGENIC REGION PRECURSOR | 7.8 |
| 2520 | V00436 | *Gallus gallus* fragment of gene X of ovalbumin family coding for the first leader exon. | 4.4 | <NONE> | <NONE> | <NONE> |
| 2521 | U95094 | *Xenopus laevis* XL-INCENP (XL-INCENP) mRNA, complete cds | 6e-006 | 3800811 | (AF072251) methyl-CpG binding protein 2 [*Mus musculus*] | 6.9 |
| 2522 | Y09540 | *H. sapiens* AHSG gene, partial | 2e-007 | 2135357 | HLA class I alpha chain - human (fragment) sapiens] | 3.1 |
| 2523 | U95098 | *Xenopus laevis* mitotic phosphoprotein 44 mRNA, partial cds | 3e-007 | <NONE> | <NONE> | <NONE> |
| 2524 | D87438 | Human mRNA for KIAA0251 gene, partial cds | 1e-011 | <NONE> | <NONE> | <NONE> |
| 2525 | AE001203 | *Treponema pallidum* section 19 of 87 of the complete genome | 0.42 | <NONE> | <NONE> | <NONE> |
| 2526 | U47322 | Cloning vector DNA, complete sequence. | 2e-036 | 987050 | (X65335) lacZ gene product [unidentified | 4e-008 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2527 | M97287 | Human MAR/SAR DNA binding protein (SATB1) mRNA, complete cds. > :: gb|I58691|I58691 Sequence 1 from U.S. Pat. No. 5,652,340 | 0 | 417747 | cloning vector] DNA-BINDING PROTEIN SATB1 (SPECIAL AT-RICH SEQUENCE BINDING PROTEIN 1) protein SATB1 - human >gi|337811 (M97287) putative [*Homo sapiens*] | 2e-009 |
| 2528 | AF005355 | *Oryctolagus cuniculus* translation initiation factor eIF2C mRNA, complete cds | 1e-094 | 3253159 | (AF005355) translation initiation factor eIF2C | 2e-084 |
| 2529 | L16978 | *Anadara trapezia* beta globin gene, complete cds. | 0.11 | <NONE> | <NONE> | <NONE> |
| 2530 | M24191 | Human beta globulin pseudogene, clone 46B | 0.013 | 3878519 | (Z92806) K10G4.7 [*Caenorhabditis elegans*] | 0.6 |
| 2531 | AF047611 | *Euroglyphus maynei* group 1 allergen Eur m 1 0102 | 0.12 | <NONE> | <NONE> | <NONE> |
| 2532 | AE001372 | *Plasmodium falciparum* chromosome 2, section 9 of 73 of the complete sequence | 0.002 | <NONE> | <NONE> | <NONE> |
| 2533 | J04700 | *Homo sapiens* calcium-dependent protease large subunit (CANPmL) gene, promoter region and exon 1. | 0.014 | <NONE> | <NONE> | <NONE> |
| 2534 | AF038958 | *Homo sapiens* synaptic glycoprotein SC2 spliced variant mRNA, complete cds | 4e-086 | 2144098 | SC2 - rat >gi|256994|bbs|115268 (S45663) SC2 = synaptic glycoprotein [rats, brain, Peptide, 308 aa] | 1e-033 |
| 2535 | L13434 | Human chromosome 3p21.1 gene sequence, complete cds. | 8e-008 | 1085432 | mucin (clone PGM-2A) - pig | 4.3 |
| 2536 | U95094 | *Xenopus laevis* XL-INCENP (XL-INCENP) mRNA, complete cds | 1e-011 | 3873713 | (Z74026) cDNA EST yk452h4.3 comes from this gene; cDNA EST yk452h4.5 comes from this gene | 4e-010 |
| 2537 | U95102 | *Xenopus laevis* mitotic phosphoprotein 90 mRNA, complete cds | 1e-011 | <NONE> | <NONE> | <NONE> |
| 2538 | U95102 | *Xenopus laevis* mitotic phosphoprotein 90 mRNA, complete cds | 2e-006 | 386644 | type la hair keratin a3 [human, Peptide, 404 aa] >gi|3724101|gnl|PID|e1330425 (Y16788) keratin, type I [*Homo sapiens*] | 1.9 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2539 | U95094 | *Xenopus laevis* XL-INCENP (XL-INCENP) mRNA, complete cds | 0.0005 | <NONE> | <NONE> | <NONE> |
| 2540 | <NONE> | <NONE> | <NONE> | <NONE> | <NONE> | <NONE> |
| 2541 | U79248 | Human clone 23826 mRNA sequence | 6e-005 | <NONE> | <NONE> | <NONE> |
| 2542 | D44598 | *Saccharomyces cerevisiae* chromosome VI phage 4121 | 1e-010 | 2828280 | (AL021687) putative protein [*Arabidopsis thaliana*] >gi|2832633|gnl|PID|e1249651 (AL021711) putative protein [*Arabidopsis thaliana*] | 6e-060 |
| 2543 | X64037 | *H. sapiens* mRNA for RNA polymerase II associated protein RAP74 | 0 | 35871 | (X64002) RAP74 [*Homo sapiens*] >gi|228483|prf||1804353A transcription factor RAP74 [*Homo sapiens*] | 4e-049 |
| 2544 | M18857 | *A. californica* nuclear polyhedrosis virus ORFs encoding a delayed early protein and two late protein, complete cds. | 0.38 | 3169096 | (AL023706) hypothetical protein | 3e-029 |
| 2545 | U95102 | *Xenopus laevis* mitotic phosphoprotein 90 mRNA, complete cds | 7e-006 | <NONE> | <NONE> | <NONE> |
| 2546 | L22403 | *Homo sapiens* DNA sequence, repeat region. | 1e-020 | <NONE> | <NONE> | <NONE> |
| 2547 | L22403 | *Homo sapiens* DNA sequence, repeat region. | 1e-020 | <NONE> | <NONE> | <NONE> |
| 2548 | D38417 | Mouse mRNA for arylhydrocarbon receptor, complete cds | 3e-028 | <NONE> | <NONE> | <NONE> |
| 2549 | U95094 | *Xenopus laevis* XL-INCENP (XL-INCENP) mRNA, complete cds | 2e-006 | <NONE> | <NONE> | <NONE> |
| 2550 | X04754 | Drosophila yolk polypeptide gene YP3 | 1e-012 | 2500649 | PROBABLE RNA 3'-TERMINAL PHOSPHATE CYCLASE (RNA-3'-PHOSPHATE CYCLASE) (RNA CYCLASE) | 1e-022 |
| 2551 | U95094 | *Xenopus laevis* XL-INCENP (XL-INCENP) mRNA, complete cds | 3e-011 | <NONE> | <NONE> | <NONE> |
| 2552 | U95102 | *Xenopus laevis* mitotic phosphoprotein 90 mRNA, complete cds | 2e-006 | <NONE> | <NONE> | <NONE> |
| 2553 | U49169 | *Dictyostelium discoideum* V- | 0.13 | 586429 | VERY HYPOTHETICAL | 1.1 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | ATPase A subunit (vatA) mRNA, complete cds | | | 13.2 KD PROTEIN IN PTC3-SAS3 INTERGENIC REGION >gi\|626813\|pir\|\|S4 5788 probable membrane protein YBL053w - yeast (*Saccharomyces cerevisiae*) >gi\|536079 (Z35814) ORF YBL053w | |
| 2554 | M22462 | Chicken protein p54 (ets-1) mRNA, complete cds. | 1.1 | 2078531 | (U89506) Mlark [*Mus musculus*] | 5.6 |
| 2555 | U73664 | Human t(11;14)(q13;q32) breakpoint junction sequence | 0.37 | 2909381 | (Y16569) ORF [*Mycobacterium tuberculosis*] | 3.3 |
| 2556 | U95102 | *Xenopus laevis* mitotic phosphoprotein 90 mRNA, complete cds | 6e-006 | 3025166 | PUTATIVE NUCLEOSIDE TRANSPORTER YEGT >gi\|1736823\|gnl\|PID\|d1016692 (D90848) Nucleoside permease NupG (Nucleoside-transport system protein NupG). [*Escherichia coli*] >gi\|1788415 (AE000299) putative nucleoside permease protein [*Escherichia coli*] | 1.4 |
| 2557 | U09210 | Human vesicular acetylcholine transporter mRNA, complete cds. | 0.041 | 3176395 | (AB015041) PIF1 [Caenorhabditis elegans] | 1e-006 |
| 2558 | U95094 | *Xenopus laevis* XL-INCENP (XL-INCENP) mRNA, complete cds | 0.002 | 540271 | (U14635) similar to GABA and glycine receptors | 1e-020 |
| 2559 | U95102 | *Xenopus laevis* mitotic phosphoprotein 90 mRNA, complete cds | 7e-007 | <NONE> | <NONE> | <NONE> |
| 2560 | U95102 | *Xenopus laevis* mitotic phosphoprotein 90 mRNA, complete cds | 1e-010 | <NONE> | <NONE> | <NONE> |
| 2561 | U95102 | *Xenopus laevis* mitotic phosphoprotein 90 mRNA, complete cds | 3e-009 | 1788739 | (AE000327) orf, hypothetical protein [*Escherichia coli*] | 6.8 |
| 2562 | AF073710 | *Homo sapiens* regulator of G-protein signaling 9 mRNA, complete cds | 1e-013 | 728831 | !!!! ALU SUBFAMILY J WARNING ENTRY | 0.38 |
| 2563 | U95102 | *Xenopus laevis* mitotic phosphoprotein | 1e-011 | 2072296 | (U95098) mitotic phosphoprotein 44 [*Xenopus laevis*] | 5.1 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2564 | U95102 | *Xenopus laevis* mitotic phosphoprotein 90 mRNA, complete cds | 6e-007 | <NONE> | <NONE> | <NONE> |
| 2565 | U95094 | *Xenopus laevis* XL-INCENP (XL-INCENP) mRNA, complete cds | 5e-015 | <NONE> | <NONE> | <NONE> |
| 2566 | M98502 | *Mus musculus* protein encoding twelve zinc finger proteins (pMLZ-4) mRNA, complete cds. | 2e-017 | 2370153 | (Y13374) putative prenylated protein prenylated protein [*Homo sapiens*] >gi\|3360403 (AF052096) putative prenylated protein [*Homo sapiens*] | 7.3 |
| 2567 | U95102 | *Xenopus laevis* mitotic phosphoprotein 90 mRNA, complete cds | 1e-009 | 2072296 | (U95098) mitotic phosphoprotein 44 [*Xenopus laevis*] | 2.5 |
| 2568 | U95094 | *Xenopus laevis* XL-INCENP (XL-INCENP) mRNA, complete cds | 3e-008 | 2580433 | (D76414) ppGpp hydrolase [*Staphylococcus aureus*] | 2.4 |
| 2569 | X82206 | *H. sapiens* mRNA for alpha-centractin | 4e-085 | 2909479 | (AL021930) hypothetical protein Rv0290 | 1.4 |
| 2570 | Z68758 | Human DNA sequence from cosmid cN85E10 on chromosome 22q11.2-qter | 8e-009 | 1082778 | secretory phospholipase A2 receptor precursor, transmembrane form - human >gi\|862375 | 7.1 |
| 2571 | U95102 | *Xenopus laevis* mitotic phosphoprotein 90 mRNA, complete cds | 0.0005 | 2583019 | (AF022724) ARIX homeodomain protein [*Homo sapiens*] | 0.64 |
| 2572 | L19637 | *Arabidopsis thaliana* adenine phosphoribosyltrans-ferase (apt) gene, complete cds. | 0.12 | <NONE> | <NONE> | <NONE> |
| 2573 | U95102 | *Xenopus laevis* mitotic phosphoprotein 90 mRNA, complete cds | 2e-008 | 388057 | (L22982) merozoite surface protein-1 [*Plasmodium chabaudi*] | 6.9 |
| 2574 | U95098 | *Xenopus laevis* mitotic phosphoprotein 44 mRNA, partial cds | 0.0005 | 3913436 | PROBABLE ATP-DEPENDENT RNA HELICASE A (NUCLEAR DNA HELICASE II) (NDH II) | 9.5 |
| 2575 | AJ005698 | *Homo sapiens* mRNA for poly(A)-specific ribonuclease | 3e-011 | 3776076 | (AJ005698) poly(A)-specific ribonuclease [*Homo sapiens*] | 0.28 |
| 2576 | Z96602 | *H. sapiens* telomeric DNA sequence, clone 3QTEL015, read 3QTELOO015.seq | 2e-006 | 2407641 | (AF018956) neuropilin [*Homo sapiens*] | 1.4 |
| 2577 | U95102 | *Xenopus laevis* mitotic | 4e-012 | 3880672 | (AL032633) cDNA EST | 0.82 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | phosphoprotein 90 mRNA, complete cds | | | EMBL:T00127 comes from this gene; cDNA EST EMBL:T01189 comes from this gene [*Caenorhabditis elegans*] | |
| 2578 | U95094 | *Xenopus laevis* XL-INCENP (XL-INCENP) mRNA, complete cds | 4e-012 | 2088843 | (AF00386) F59E12.9 gene product [*Caenorhabditis elegans*] | 3.5 |
| 2579 | U95315 | *Mycobacterium gordonae* IS1511 transposase and Tn554 tpna transposase homolog genes, complete cds | 3.8 | <NONE> | <NONE> | <NONE> |
| 2580 | U95094 | *Xenopus laevis* XL-INCENP (XL-INCENP) mRNA, complete cds | 6e-012 | 2072296 | (U95098) mitotic phosphoprotein 44 [*Xenopus laevis*] | 9.6 |
| 2581 | U95102 | *Xenopus laevis* mitotic phosphoprotein 90 mRNA, complete cds | 2e-013 | <NONE> | <NONE> | <NONE> |
| 2582 | U95094 | *Xenopus laevis* XL-INCENP (XL-INCENP) mRNA, complete cds | 3e-008 | <NONE> | <NONE> | <NONE> |
| 2583 | U85193 | Human nuclear factor I-B2 (NFIB2) mRNA, complete cds | 2e-038 | <NONE> | <NONE> | <NONE> |
| 2584 | U95102 | *Xenopus laevis* mitotic phosphoprotein 90 mRNA, complete cds | 3e-009 | 2072296 | (U95098) mitotic phosphoprotein 44 [*Xenopus laevis*] | 5.2 |
| 2585 | U67532 | *Methanococcus jannaschii* section 74 of 150 of the complete genome | 0.005 | 1938410 | (U97000) No definition line found [*Caenorhabditis elegans*] | 4.5 |
| 2586 | X65319 | Cloning vector pCAT-Enhancer | 3e-081 | 987050 | (X65335) lacZ gene product [unidentified cloning vector] | 3e-015 |
| 2587 | AB006534 | *Homo sapiens* mRNA for hepatocyte growth factor activator inhibitor type 2, complete cds | e-103 | 2065529 | (U78095) bikunin [*Homo sapiens*] | 3e-025 |
| 2588 | U95094 | *Xenopus laevis* XL-INCENP (XL-INCENP) mRNA, complete cds | 6e-006 | 3152559 | (AC002986) Similarity to *A. thaliana* gene product F21M12.20, gb\|AC000132. EST gb\|Z25651 comes from this gene. [*Arabidopsis thaliana*] | 6e-008 |
| 2589 | X82829 | *B. taurus* mRNA for nuclear DNA helicase II | 9e-009 | 1353239 | (U10245) putative RNA helicase A [*Arabidopsis thaliana*] | 3e-017 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2590 | AE001366 | *Plasmodium falciparum* chromosome 2, section 3 of 73 of the complete sequence | 0.047 | <NONE> | <NONE> | <NONE> |
| 2591 | D78572 | House mouse; *Musculus domesticus* mRNA for membrane glycoprotein, complete cds > :: dbj\|E12950\|E129 50 cDNA GA3-43 encoding novel polypeptide which appear when differentiate from embryo-tumor cell P19 to nerve cell | 1e-041 | 1545807 | (D78572) membrane glycoprotein [*Mus musculus*] | 1e-026 |
| 2592 | M77130 | *H. sapiens* (clone B7) hY4 Ro RNA pseudogene. | 4e-011 | 629174 | cellulose 1,4-beta-cellobiosidase (EC 3.2.1.91) - *Clostridium thermocellum* >gi\|530014 (X80993) cellulose 1,4-beta-cellobiosidase [*Clostridium thermocellum*] | 1.5 |
| 2593 | M34661 | Human chaperonin (HSP60) non-functional pseudogene 3. | 1 | <NONE> | <NONE> | <NONE > |
| 2594 | U95102 | *Xenopus laevis* mitotic phosphoprotein 90 mRNA, complete cds | 6e-006 | 1723894 | HYPOTHETICAL GTP-BINDING PROTEIN IN SEH1-PRP20 INTERGENIC REGION >gi\|2131584\|pir\|\|S 64106 hypothetical protein YGL099w - yeast (*Saccharomyces cerevisiae*) >gi\|1322637\|gnl\|PI D\|e243302 (Z72621) ORF YGL099w [*Saccharomyces cerevisiae*] | 9e-015 |
| 2595 | U95094 | *Xenopus laevis* XL-INCENP (XL-INCENP) mRNA, complete cds | 9e-010 | 2072296 | (U95098) mitotic phosphoprotein 44 [*Xenopus laevis*] | 0.16 |
| 2596 | U95094 | *Xenopus laevis* XL-INCENP (XL-INCENP) mRNA, complete cds | 1e-010 | 2072296 | (U95098) mitotic phosphoprotein 44 [*Xenopus laevis*] | 3.4 |
| 2597 | U57715 | *Rattus norvegicus* FGF receptor activating protein FRAG1 (FRAG1) mRNA, complete cds | 0 | 1518609 | (U57715) FGF receptor activating protein FRAG1 [*Rattus norvegicus*] | 2e-088 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2598 | Z64776 | H. sapiens CpG DNA, clone 167d8, forward read cpg167d8.ftlb. | 0.0002 | 1777782 | (U52513) ISG family member [Homo sapiens] | 2.4 |
| 2599 | U95102 | Xenopus laevis mitotic phosphoprotein 90 mRNA, complete cds | 3e-008 | <NONE> | <NONE> | <NONE> |
| 2600 | AF022158 | Homo sapiens KRAB domain zinc finger protein | 3e-010 | 2507553 | ZINC FINGER PROTEIN 33A (ZINC FINGER PROTEIN) KOX31) (KIAA0065) (HA0946) Kruppel-related. [Homo sapiens] | 1e-016 |
| 2601 | Y07660 | M. tuberculosis accBC gene | 2e-068 | 465847 | HYPOTHETICAL 66.5 KD PROTEIN F02A9.5 IN CHROMOSOME III >gi\|280542\|pir\|S28313 hypothetical protein F02A9.5 - Caenorhabditis elegans Genefinder; similar to Propionyl-CoA carboxylase beta chain; cDNA EST EMBL:M89018 comes from this gene; cDNA EST EMBL:D2806 | 8e-075 |
| 2602 | S51858 | MO25 gene [mice, embryos, mRNA, 2322 nt] | 0 | 547911 | MO25 PROTEIN >gi\|2143483\|pir\|I57997 hypothetical calcium-binding protein - mouse protein [mice, embryos, Peptide, 341 aa] [Mus sp.] | e-119 |
| 2603 | AB018345 | Homo sapiens mRNA for KIAA0802 protein, partial cds | e-131 | 3882325 | (AB018345) KIAA0802 protein [Homo sapiens] | e3-053 |
| 2604 | L41560 | Homo sapiens (clones HGPCD2 and HGPCD15) pterin-4a-carbinolamine dehydratase (PCBD) gene, complete cds. | 2e-005 | <NONE> | <NONE> | <NONE> |
| 2605 | AJ000041 | Homo sapiens mRNA for HOXC11 | e-180 | 987050 | (X65335) lacZ gene product [unidentified cloning vector] | 0.001 |
| 2606 | U55939 | Expression vector pVP-Nco, complete sequence. | 4e-043 | 987050 | (X65335) lacZ gene product [unidentified cloning vector] | 9e-009 |
| 2607 | U95094 | Xenopus laevis XL-INCENP (XL-INCENP) mRNA, complete cds | 2e-014 | 124139 | TRANS-ACTING TRANSCRIPTION-AL PROTEIN ICP0 >gi\|73901\|pir\|WZBE61 gene 61 | 0.48 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | protein - human herpesvirus 3 >gi\|60050 (X04370) ORF 61 (AA1-467) [Human herpesvirus 3] >gi\|228664\|prf\|\|18 08271A gene 61 protein | |
| 2608 | U95094 | *Xenopus laevis* XL-INCENP (XL-INCENP) mRNA, complete cds | 3e-009 | <NONE> | <NONE> | <NONE> |
| 2609 | U95102 | *Xenopus laevis* mitotic phosphoprotein 90 mRNA, complete cds | 1e-013 | 3878130 | (Z83112) predicted using Genefinder | 9 |
| 2610 | U95102 | *Xenopus laevis* mitotic phosphoprotein 90 mRNA, complete cds | 3e-010 | 2072296 | (U95098) mitotic phosphoprotein 44 [*Xenopus laevis*] | 5.3 |
| 2611 | D14965 | *C. elegans* gene for alpha-2 tubulin, complete cds | 3.7 | <NONE> | <NONE> | <NONE> |
| 2612 | Z61840 | *H. sapiens* CpG DNA, clone 59g12, forward read cpg59g12.ft1a. | 2e-080 | 3581872 | (AL031541) putative integral membrane protein [*Streptomyces coelicolor*] | 1.4 |
| 2613 | U59924 | *Sus scrofa* nitric oxide synthase (NOS) mRNA, complete cds | 1.1 | <NONE> | <NONE> | <NONE> |
| 2614 | U95094 | *Xenopus laevis* XL-INCENP (XL-INCENP) mRNA, complete cds | 2e-006 | <NONE> | <NONE> | <NONE> |
| 2615 | AF054625 | Reporter vector pSRF-Luc, complete sequence | 4e-065 | 987050 | (X65335) lacZ gene product [unidentified cloning vector] | 3e-015 |
| 2616 | U95094 | *Xenopus laevis* XL-INCENP (XL-INCENP) mRNA, complete cds | 1e-011 | 2072296 | (U95098) mitotic phosphoprotein 44 [*Xenopus laevis*] | 3.1 |
| 2617 | AF031924 | *Homo sapiens* homeobox transcription factor barx2 | e-161 | 2072296 | (U95098) mitotic phosphoprotein 44 [*Xenopus laevis*] | 5.5 |
| 2618 | U95102 | *Xenopus laevis* mitotic phosphoprotein 90 mRNA, complete cds | 4e-012 | 2072296 | (U95098) mitotic phosphoprotein 44 [*Xenopus laevis*] | 5.6 |
| 2619 | U95094 | *Xenopus laevis* XL-INCENP (XL-INCENP) mRNA, complete cds | 1e-009 | 2072296 | (U95098) mitotic phosphoprotein 44 [*Xenopus laevis*] | 5.6 |
| 2620 | AF053461 | Reporter vector pCRE-Luc, complete sequence | 1e-013 | 1065484 | (U40415) similar to *S. cerevisiae* LAG1 (SP:P38703) | 0.49 |
| 2621 | U95094 | *Xenopus laevis* XL-INCENP (XL-INCENP) mRNA, complete | 1e-009 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2622 | AF013758 | *Homo sapiens* polyadenylate binding protein-interacting protein-1 (PAIP1) mRNA, complete cds | 0 | 3046900 | (AF013758) polyadenylate binding protein-interacting protein-1 [*Homo sapiens*] | 3e-072 |
| 2623 | D29808 | Human mRNA for T-cell acute lymphoblastic leukemia associated antigen 1 (TALLA-1), complete cds | 0.014 | <NONE> | <NONE> | <NONE> |
| 2624 | U95094 | *Xenopus laevis* XL-INCENP (XL-INCENP) mRNA, complete cds | 5e-013 | 2690005 | (AE000794) *B. burgdorferi* predicted coding region BBF30 | 7.6 |
| 2625 | U95102 | *Xenopus laevis* mitotic phosphoprotein 90 mRNA, complete cds | 0.041 | <NONE> | <NONE> | <NONE> |
| 2626 | Z12112 | pWE15A cosmid vector DNA | 2e-067 | 987050 | (X65335) lacZ gene product [unidentified cloning vector] | 3e-008 |
| 2627 | AB018326 | *Homo sapiens* mRNA for KIAA0783 protein, complete cds | 0 | 3882287 | (AB018326) KIAA0783 protein [*Homo sapiens*] | 1e-073 |
| 2628 | U95094 | *Xenopus laevis* XL-INCENP (XL-INCENP) mRNA, complete cds | 1e-011 | 2072296 | (U95098) mitotic phosphoprotein 44 [*Xenopus laevis*] | 5.4 |
| 2629 | U95102 | *Xenopus laevis* mitotic phosphoprotein 90 mRNA, complete cds | 2e-016 | 2072296 | (U95098) mitotic phosphoprotein 44 [*Xenopus laevis*] | 5.4 |
| 2630 | U95094 | *Xenopus laevis* XL-INCENP (XL-INCENP) mRNA, complete cds | 2e-006 | 1001632 | (D64002) hypothetical protein | 3.2 |
| 2631 | U95102 | *Xenopus laevis* mitotic phosphoprotein 90 mRNA, complete cds | 3e-010 | 2072296 | (U95098) mitotic phosphoprotein 44 [*Xenopus laevis*] | 0.29 |
| 2632 | U95094 | *Xenopus laevis* XL-INCENP (XL-INCENP) mRNA, complete cds | 2e-006 | <NONE> | <NONE> | <NONE> |
| 2633 | X05167 | Barley gene for thiol protease aleurain | 0.13 | 1065515 | (U4020) weak similarity to procollagen alpha chain 1(V) chain [*Caenorhabditis elegans*] | 9e-018 |
| 2634 | Z96177 | *H. sapiens* telomeric DNA sequence, clone 10QTEL040, read 10QTELOO040.seq | 2e-060 | 987050 | (X65335) lacZ gene product [unidentified cloning vector] | 5e-010 |
| 2635 | U95094 | *Xenopus laevis* XL-INCENP (XL-INCENP) | 2e-006 | 123432 | ZERKNUELLT PROTEIN 1 (ZEN-1) | 3.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2636 | U95094 | *Xenopus laevis* XL-INCENP (XL-INCENP) mRNA, complete cds | 2e-006 | 123432 | ZERKNUELLT PROTEIN 1 (ZEN-1) | 3.4 |
| 2637 | U95094 | *Xenopus laevis* XL-INCENP (XL-INCENP) mRNA, complete cds | 5e-013 | 2072296 | (U95098) mitotic phosphoprotein 44 [*Xenopus laevis*] | 1.5 |
| 2638 | U95094 | *Xenopus laevis* XL-INCENP (XL-INCENP) mRNA, complete cds | 5e-013 | 2072296 | (U95098) mitotic phosphoprotein 44 [*Xenopus laevis*] | 1.5 |
| 2639 | AF103734 | Sindbis-like virus YN87448, complete genome | 3.5 | <NONE> | <NONE> | <NONE> |
| 2640 | M27280 | *H. influenzae* lic-1 operon licA, licB, licC and licD genes, encoding outer membrane lipopolysaccharide phase variation, complete cds. | 3.4 | 2529686 | (AC002535) putative G-beta-repeat containing protein, 5' partial [*Arabidopsis thaliana*] | 6e-018 |
| 2641 | AF103734 | Sindbis-like virus YN87448, complete genome | 3.5 | <NONE> | <NONE> | <NONE> |
| 2642 | X05167 | Barley gene for thiol protease aleurain | 0.13 | 1065515 | (U40420) weak similarity to procollagen alpha chain 1(V) chain [*Caenorhabditis elegans*] | 9e-018 |
| 2643 | L76159 | *Homo sapiens* FRG1 mRNA, complete cds. | 4e-032 | 1246233 | (L76159) FRG1 gene product [*Homo sapiens*] | 1e-005 |
| 2644 | AF086047 | *Homo sapiens* full length insert cDNA clone YX84A05 | 3e-008 | 628916 | Delta-12 desaturases - *Anabaena variabilis* desaturase [*Anabaena variabilis*] | 6 |
| 2645 | AF086136 | *Homo sapiens* full length insert cDNA clone ZA89C06 | 4e-021 | 3849864 | (AJ007629) palI protein [*Emericella nidulans*] | 4.6 |
| 2646 | AB004818 | *Homo sapiens* mRNA for ENX-2, complete cds | 1e-011 | <NONE> | <NONE> | <NONE> |
| 2647 | D87686 | *Homo sapiens* mRNA for KIAA0017 protein, complete cds | e-165 | 3540219 | (D87686) KIAA0017 protein [*Homo sapiens*] | 5e-054 |
| 2648 | Z49218 | *S. cerevisiae* chromosome XIII cosmid 7056 | 0.002 | 2984715 | (AF053957) dynamin associated protein isoform Dap160-1 | 0.33 |
| 2649 | U95094 | *Xenopus laevis* XL-INCENP (XL-INCENP) mRNA, complete cds | 1e-009 | 868241 | (U29488) C56C10.3 gene product [*Caenorhabditis elegans*] | 7e-030 |
| 2650 | D38417 | Mouse mRNA for arylhydrocarbon receptor, complete cds | 3e-028 | <NONE> | <NONE> | <NONE> |
| 2651 | L29252 | Human (clone D13-2) L-iditol-2- | 0.35 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2652 | U29171 | dehydrogenase gene, exon 4, exon 5, exon 6 and exon 7. Human casein kinase I delta mRNA, complete cds > | 3e-063 | 1176666 | HYPOTHETICAL 139.1 KD PROTEIN C08B11.3 IN CHROMOSOME II >gi\|3874171\|gnl\|PID\|e1343795 proteins; cDNA EST EMBL:T01154 comes from this gene; cDNA EST EMBL:T02016 comes from this gene; cDNA EST EMBL:D34307 comes from this gene; cDNA EST EMBL:D37339 comes from | 6.8 |
| 2653 | U63648 | *Mus musculus* p160 myb-binding protein (P160) mRNA, complete cds | 6e-058 | 2645205 | (U63648) p160 myb-binding protein [*Mus musculus*] | 2e-038 |
| 2654 | U95102 | *Xenopus laevis* mitotic phosphoprotein 90 mRNA, complete cds | 3e-010 | 2072296 | (U95098) mitotic phosphoprotein 44 [Xenopus laevis] | 5.9 |
| 2655 | Y11740 | *H. sapiens* whn gene, exon 1a and 1b | 0.12 | <NONE> | <NONE> | <NONE> |
| 2656 | D26179 | Rat mRNA for V-1 protein, complete cds | 2e-005 | 3879121 | (Z70310) predicted using Genefinder; Similarity to Mouse ankyrin (PIR Acc. No. S37771); cDNA EST EMBL:T01923 comes from this gene; cDNA EST EMBL:D32335 comes from this gene; cDNA EST EMBL:D32723 comes from this gene; cDNA ES . . . | 8e-087 |
| 2657 | U67518 | *Methanococcus jannaschii* section 60 of 150 of the complete genome | 1.2 | 3876465 | Genefinder; Similarity to M (Z81071) predicted using Genefinder; Similarity to Human small nuclear ribonucleoprotein E cDNA EST yk375g7.5 comes from this gene; cDNA EST yk435f5.3 comes from this gen . . . | 6e-011 |
| 2658 | U95102 | *Xenopus laevis* mitotic phosphoprotein 90 mRNA, | 3e-008 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2659 | U83176 | Mus musculus ROSA 26 transcription AS ROSA26AS mRNA, complete cds complete cds | 0 | 1778861 | (U83176) ROSA26AS [Mus musculus] | e-101 |
| 2660 | AB018374 | Mus musculus GARP34 mRNA, complete cds | 2e-065 | 3724364 | (AB018374) GARP34 [Mus musculus] | 7e-010 |
| 2661 | AB018374 | Mus musculus GARP34 mRNA, complete cds | 2e-065 | 3724364 | (AB018374) GARP34 [Mus musculus] | 7e-010 |
| 2662 | U95098 | Xenopus laevis mitotic phosphoprotein 44 mRNA, partial cds | 4e-011 | 2072296 | (U95098) mitotic phosphoprotein 44 [Xenopus laevis] | 4.6 |
| 2663 | AL022168 | Human DNA sequence from clone U247E12 on chromosome Xq22-23, complete sequence [Homo sapiens] | 8e-008 | <NONE> | <NONE> | <NONE> |
| 2664 | M10277 | Human cytoplasmic beta-actin gene, complete cds. | 5e-063 | <NONE> | <NONE> | <NONE> |
| 2665 | D83769 | Homo sapiens DNA, corresponding sequence for DHFR | 5e-014 | 763429 | (U22961) putative ORF; similar in part to the product encoded by human glycerol-3-phosphate dehydrogenase mRNA, GenBank Accession Number L34041; Method: conceptual translation supplied by author [Homo sapiens] | 5.9 |
| 2666 | U15426 | Human anonymous mRNA sequence with CCA repeat region. | 3e-071 | 1065484 | (U40415) similar to S. cerevisiae LAG1 (SP:P38703) | 3e-015 |
| 2667 | AF032900 | Homo sapiens timing protein CLK-1 mRNA, complete cds | 0 | 3811295 | (AF032900) timing protein CLK-1; ubiquinone biosynthesis protein COQ7 [Homo sapiens] | 3e-061 |
| 2668 | L39210 | Homo sapiens inosine monophosphate dehydrogenase type II gene, complete cds | e-111 | 2887425 | (AB007885) KIAA0425 [Homo sapiens] | 3e-036 |
| 2669 | U95102 | Xenopus laevis mitotic phosphoprotein 90 mRNA, complete cds | 7.00E-07 | <NONE> | <NONE> | <NONE> |
| 2670 | X93016 | S. scrofa mRNA for cytosolic malic enzyme NADP-dependent | 5e-045 | 101706 | hypothetical protein 2 - yeast (Saccharomyces kluyveri) plasmid pSKL >gi|4870 (X54850) ORF 2, has similarity to | 7.7 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2671 | J03068 | Human DNF1552 (lung) mRNA, complete cds. | 0.041 | 2414623 | DNA polymerase [*Saccharomyces kluyveri*] (Z99259) putative phosphotransferase | 7e-021 |
| 2672 | X81372 | *H. sapiens* mRNA for biphenyl hydrolase-related protein | 2e-016 | 728831 | !!!! ALU SUBFAMILY J WARNING ENTRY | 0.0001 |
| 2673 | AB012130 | *Homo sapiens* SBC2 mRNA for sodium bicarbonate cotransporter2, complete cds | 0.00E+00 | 3097316 | (AB012130) sodium bicarbonate cotransporter2 [*Homo sapiens*] | 3e-045 |
| 2674 | D83769 | *Homo sapiens* DNA, corresponding sequence for DHFR | 5e-014 | 763429 | (U22961) putative ORF; similar in part to the product encoded by human glycerol-3-phosphate dehydrogenase mRNA, GenBank Accession Number L34041; Method: conceptual translation supplied by author [*Homo sapiens*] | 5.9 |
| 2675 | D38522 | Human mRNA for KIAA0080 gene, partial cds | 1e-022 | 728831 | !!!! ALU SUBFAMILY J WARNING ENTRY | 0.002 |
| 2676 | D38522 | Human mRNA for KIAA0080 gene, partial cds | 1e-022 | 728831 | !!!! ALU SUBFAMILY J WARNING ENTRY | 0.002 |
| 2677 | AF072810 | *Homo sapiens* transcription factor WSTF mRNA, complete cds | 0 | 4049922 | (AF072810) transcription factor WSTF [*Homo sapiens*] | 1e-070 |
| 2678 | U41767 | Human metargidin precursor mRNA, complete cds | e-130 | 1235674 | (U41767) metargidin precursor [*Homo sapiens*] | 1.00E-02 |
| 2679 | L81613 | *Homo sapiens* (subclone 4_c7 from P1 H17) DNA sequence | 0.38 | <NONE> | <NONE> | <NONE> |
| 2680 | M68841 | Human L1 repetitive sequence with a region homologous to a mouse ORF. | 9.00E-30 | 106322 | hypothetical protein (L1H3' region) - human | 8e-008 |
| 2681 | U95094 | *Xenopus laevis* XL-INCENP (XL-INCENP) mRNA, complete cds | 0.0005 | <NONE> | <NONE> | <NONE> |
| 2682 | D87973 | *Mus musculus* Impact mRNA, complete cds | 0 | 4038076 | (D87973) Impact [*Mus musculus*] | 1e-095 |
| 2683 | M69175 | Human H-protein mRNA, complete cds. | 2e-017 | <NONE> | <NONE> | <NONE> |
| 2684 | Z80361 | *H. sapiens* HLA-DRB pseudogene, repeat region; | 1e-082 | 1706108 | MITOCHONDRIAL CARNITINE O-PALMITOYL-TRANSFERASE I, LIVER ISOFORM | 0.67 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | (CPTI) (CPTI-L) carnitine palmitoyltransferase I [Homo sapiens] I [Homo sapiens] | |
| 2685 | AF017044 | Dictyostelium discoideum LTR-retrotransposon Skipper, partial genomic sequence, 3' end | 0.014 | <NONE> | <NONE> | <NONE> |
| 2686 | U40825 | Mus musculus WW-domain binding protein 1 mRNA, complete cds | e-118 | 1777577 | (U40825) WW-domain binding protein 1 [Mus musculus] | 2.00E−29 |
| 2687 | U95094 | Xenopus laevis XL-INCENP (XL-INCENP) mRNA, complete cds | 2e-005 | 2281149 | (U58533) maturase [Carum carvi] | 4.6 |
| 2688 | U95102 | Xenopus laevis mitotic phosphoprotein 90 mRNA, complete cds | 8e-008 | 3328840 | (AE001314) Putative outer membrane protein A [Chlamydia trachomatis] | 5.8 |
| 2689 | <NONE> | <NONE> | <NONE> | <NONE> | <NONE> | <NONE> |
| 2690 | AB012130 | Homo sapiens SBC2 mRNA for sodium bicarbonate cotransport2, complete cds | 0.00E+00 | 3097316 | (AB012130) sodium bicarbonate cotransporter2 [Homo sapiens] | 3e-045 |
| 2691 | X69516 | H. sapiens gene for folate receptor | 3e-008 | <NONE> | <NONE> | <NONE> |
| 2692 | U95094 | Xenopus laevis XL-INCENP (XL-INCENP) mRNA, complete cds | 5.00E−04 | 1203965 | (L42379) bone-derived growth factor [Homo sapiens] | 0.17 |
| 2693 | Z15027 | H. sapiens HLA class III DNA | 3.00E−07 | 728836 | !!!! ALU SUBFAMILY SP WARNING ENTRY | 3.6 |
| 2694 | U95098 | Xenopus laevis mitotic phosphoprotein 44 mRNA, partial cds | 2e-006 | <NONE> | <NONE> | <NONE> |
| 2695 | U95098 | Xenopus laevis mitotic phosphoprotein 44 mRNA, partial cds | 2e-006 | <NONE> | <NONE> | <NONE> |
| 2696 | X77775 | G. gallus Gal beta 1,3 GalNAc-specific GalNAc alpha 2,6-sialyltransferase mRNA. | 1e-022 | 3873839 | (Z81029) W05H12.2 [Caenorhabditis elegans] >gi\|3880545\|gnl\|PID\|e1350077 (Z82072) W05H12.2 | 5.9 |
| 2697 | U95094 | Xenopus laevis XL-INCENP (XL-INCENP) mRNA, complete cds | 2e-005 | 2281149 | (U58533) maturase [Carum carvi] | 4.6 |
| 2698 | U33005 | Mus musculus tbc1 mRNA, complete cds. > :: gb\|I86429\|I86429 Sequence 1 from U.S. Pat. No. | 3e-093 | 3893077 | (Y17923) lyncein [Bos taurus] | 1e-040 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2699 | U74651 | 5,700,927 Human DNA polymerase gamma (polg) gene, promoter region and partial cds | 1e-022 | 113667 | !!!! ALU CLASS B WARNING ENTRY !!!! | 0.002 |
| 2700 | U95094 | Xenopus laevis XL-INCENP (XL-INCENP) mRNA, complete cds | 9e-009 | 3064257 | (AF043899) amphiphysin IIc1 [Homo sapiens] | 0.87 |
| 2701 | U43893 | Mus musculs ATP synthase gamma-subunit gene, nuclear gene encoding a mitochondrial protein, partial cds | 0.005 | 3929529 | (AF034611) intrinsic factor-B12 receptor precursor; cubilin [Homo sapiens] | 0.67 |
| 2702 | U43893 | Mus musculus ATP synthase gamma-subunit gene, nuclear gene encoding a mitochondrial protein, partial cds | 0.005 | 3929529 | (AF034611) intrinsic factor-B12 receptor precursor; cubilin [Homo sapiens] | 0.67 |
| 2703 | M30704 | Human amphiregulin (AR) mRNA, complete cds, clones lambda-AR1 and lambda-AR2. | 0 | 113754 | AMPHIREGULIN PRECURSOR (AR) | 4e-041 |
| 2704 | U95102 | Xenopus laevis mitotic phosphoprotein 90 mRNA, complete cds | 9e-010 | <NONE> | <NONE> | <NONE> |
| 2705 | U95102 | Xenopus laevis mitotic phosphoprotein 90 mRNA, complete cds | 3e-011 | 2072296 | (U95098) mitotic phosphoprotein 44 [Xenopus laevis] | 5.2 |
| 2706 | U95094 | Xenopus laevis XL-INCENP (XL-INCENP) mRNA, complete cds | 1e-009 | 2832664 | (AL021710) pollen-specific protein-like [Arabidopsis thaliana] | 8e-020 |
| 2707 | U00684 | Human unknown mRNA. | 2e-038 | 2500412 | 30S RIBOSOMAL PROTEIN S6 Mycoplasma pneumoniae (SGC3) (ATCC 29342) >gi\|1674305 similar to Swiss-Prot Accession Number P02358, from E. coli [Mycoplasma pneumoniae] | 1.3 |
| 2708 | U95102 | Xenopus laevis mitotic phosphoprotein 90 mRNA, complete cds | 5e-015 | 108693 | glutamic acid-rich protein, retinal - bovine taurus] | 0.067 |
| 2709 | U95102 | Xenopus laevis mitotic phosphoprotein 90 mRNA, complete cds | 1e-011 | 79703 | hypothetical 32K protein (frxC 5' region) - Synechocystis sp. (PCC 6803) | 0.8 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2710 | AF083395 | *Homo sapiens* phospholipase A2-activating protein mRNA, complete cds | e-175 | 4106818 | >gi|217091|gnl|PID|d1001745 (AF083395) phospholipase A2-activating protein [*Homo sapiens*] | 4e-039 |
| 2711 | U95094 | *Xenopus laevis* XL-INCENP (XL-INCENP) mRNA, complete cds | 3e-011 | <NONE> | <NONE> | <NONE> |
| 2712 | AB019488 | *Homo sapiens* DNA for TRKA, exon 17 and complete cds | 0 | 37403 | (X03541) trk gene product (aa 1-641) [*Homo sapiens*] | 1e-032 |
| 2713 | X62570 | *H. sapiens* mRNA for IFP53 | e-105 | 32709 | (X62570) IFP53 [*Homo sapiens*] | 6e-033 |
| 2714 | U95102 | *Xenopus laevis* mitotic phosphoprotein 90 mRNA, complete cds | 0.005 | 1170056 | GENERAL SECRETION PATHWAY PROTEIN F | 4.3 |
| 2715 | AF031924 | *Homo sapiens* homeobox transcription factor barx2 | e-161 | 2072296 | (U95098) mitotic phosphoprotein 44 [*Xenopus laevis*] | 5.5 |
| 2716 | AF031924 | *Homo sapiens* homeobox transcription factor barx2 | e-161 | 2072296 | (U95098) mitotic phosphoprotien 44 [*Xenopus laevis*] | 5.5 |
| 2717 | U95094 | *Xenopus laevis* XL-INCENP (XL-INCENP) mRNA, complete cds | 9e-010 | 2072296 | (U95098) mitotic phosphoprotein 44 [*Xenopus laevis*] | 5.4 |
| 2718 | U95094 | *Xenopus laevis* XL-INCENP (XL-INCENP) mRNA, complete cds | 9e-010 | 2072296 | (U95098) mitotic phosphoprotein 44 [*Xenopus laevis*] | 5.4 |
| 2719 | L20826 | Human I-plastin mRNA, complete cds. | e-163 | 2493466 | I-PLASTIN (INTESTINE-SPECIFIC PLASTIN) >gi|1362892|pir||A56536 plastin, intestine-specific-human >gi|405230 (L20826) I-plastin | 6e-069 |
| 2720 | Z54386 | *H. sapiens* CpG DNA, clone 10g3, forward read cpg10g3.ft1a | 7e-059 | 1788180 | (AE000281) biotin sulfoxide reductase 2 [*Escherichia coli*] | 5.8 |
| 2721 | AF086201 | *Homo sapiens* full length insert cDNA clone ZC42G09 | 1e-085 | 2564332 | (AB006630) KIAA0292 [*Homo sapiens*] | 5.4 |
| 2722 | U95102 | *Xenopus laevis* mitotic phosphoprotein 90 mRNA, complete cds | 4e-012 | 2072296 | (U95098) mitotic phosphoprotein 44 [*Xenopus laevis*] | 0.12 |
| 2723 | AJ006267 | *Homo sapiens* mRNA for ClpX-like protein | 0 | 3688380 | (AJ006267) ClpX-like protein [*Homo sapiens*] | 1e-091 |
| 2724 | AF064801 | *Homo sapiens* multiple membrane spanning receptor TRC8 (TRC8) mRNA, complete cds | 0 | 3395787 | (AF064801) multiple membrane spanning receptor TRC8 | e-123 |
| 2725 | U95102 | *Xenopus laevis* | 2e-006 | 2599526 | (AF029331) | 4.2 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mitotic phosphoprotein 90 mRNA, complete cds | | | immunoglobulin heavy chain V region [Homo sapiens] | |
| 2726 | Y08013 | S. salar. DNA segment containing GT repeat | 0.006 | <NONE> | <NONE> | <NONE> |
| 2727 | Y08013 | S. salar DNA segment containing GT repeat | 0.006 | <NONE> | <NONE> | <NONE> |
| 2728 | AE000971 | Archaeoglobus fulgidus section 136 of 172 of the complete genome | 0.041 | <NONE> | <NONE> | <NONE> |
| 2729 | U95094 | Xenopus laevis XL-INCENP (XL-INCENP) mRNA, complete cds | 7e-007 | 1170586 | RAS GTPASE-ACTIVATING-LIKE PROTEIN IQGAP1 (P195) (KIAA0051) >gi\|627594\|pir\|\|A54854 Ras GTPase activating-related protein - human sapiens] >gi\|536844 (L33075) ras GTPase-activating-like protein [Homo sapiens] | 9e-011 |
| 2730 | M60858 | Human nucleolin gene, complete cds. | e-129 | <NONE> | <NONE> | <NONE> |
| 2731 | M85145 | Human tumor necrosis factor receptor, 3' flank. | 2e-007 | <NONE> | <NONE> | <NONE> |
| 2732 | M85145 | Human tumor necrosis factor receptor, 3' flank. | 2e-007 | <NONE> | <NONE> | <NONE> |
| 2733 | U95102 | Xenopus laevis mitotic phosphoprotein 90 mRNA, complete cds | 4e-013 | <NONE> | <NONE> | <NONE> |
| 2734 | L07063 | Mus musculus FKBP65 binding protein mRNA, complete cds | 6e-089 | 2137294 | FKBP65 binding protein - mosue >gi\|894162 | 6e-024 |
| 2735 | X63432 | H. sapiens ACTB mRNA for mutant beta-actin | e-112 | 987050 | (X65335) lacZ gene product [unidentified cloning vector] | 3e-014 |
| 2736 | AF083395 | Homo sapiens phospholipase A2-activating protein mRNA, complete cds | 0 | 4106818 | (AF083395) phospholipase A2-activating protein [Homo sapiens] | 1e-094 |
| 2737 | AJ012449 | Homo sapiens mRNA for NS1-binding protein | 3e-009 | 3165570 | (AF067946) similar to Drosophila ring canal protein | 4e-032 |
| 2738 | M27878 | Human DNA binding protein (HPF2) mRNA, complete cds. | 3e-063 | 3702137 | (AL031393) dJ733D15.1 (Zinc-finger protein) [Homo sapiens] | 1e-040 |
| 2739 | <NONE> | <NONE> | <NONE> | <NONE> | <NONE> | <NONE> |
| 2740 | Y15230 | Homo sapiens pygl gene, exon 5 and partial intron 4 and 5 | e-166 | 3170407 | (AF046798) glycogen phosphorylase [Homo sapiens] | 1e-044 |
| 2741 | Z96177 | H. sapiens telomeric DNA | 1e-053 | 987050 | (X65335) lacZ gene product | 2e-005 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | sequence, clone 10QTEL040, read 10QTELOO040.seq | | | [unidentified cloning vector] | |
| 2742 | M90058 | Human serglycin gene, exons 1, 2, and 3. | 3e-010 | 2072296 | (U95098) mitotic phosphoprotein 44 [*Xenopus laevis*] | 8.8 |
| 2743 | X69878 | *H. sapiens* Flt4 mRNA for transmembrane tyrosine kinase | 2e-088 | <NONE> | <NONE> | <NONE> |
| 2744 | X69878 | *H. sapiens* Flt4 mRNA for transmembrane tyrosine kinase | 2e-088 | <NONE> | <NONE> | <NONE> |
| 2745 | AB007923 | *Homo sapiens* mRNA for KIAA0454 protein, partial cds | 0 | 3413870 | (AB007923) KIAA0454 protein [*Homo sapiens*] | 1e-098 |
| 2746 | AF042181 | *Homo sapiens* testis-specific Y-encoded-like protein (TSPYL) mRNA, partial cds | 2e-047 | 2072296 | (U95098) mitotic phosphoprotein 44 [*Xenopus laevis*] | 3 |
| 2747 | AL021173 | *Caenorhabditis elegans* cosmid VK10D6R, complete sequence [*Caenorhabditis elegans*] | 1.2 | <NONE> | <NONE> | <NONE> |
| 2748 | U95102 | *Xenopus laevis* mitotic phosphoprotein 90 mRNA, complete cds | 4e-012 | 2072296 | (U95098) mitotic phosphoprotein 44 [*Xenopus laevis*] | 0.12 |
| 2749 | U95102 | *Xenopus laevis* mitotic phosphoprotein 90 mRNA, complete cds | 2e-008 | <NONE> | <NONE> | <NONE> |
| 2750 | U95102 | *Xenopus laevis* mitotic phosphoprotein 90 mRNA, complete cds | 2e-008 | <NONE> | <NONE> | <NONE> |
| 2751 | M22970 | Human pancreatic phospholipase A-2 (PLA-2) gene, exons 1 to 3. | 1e-032 | 113671 | !!!! ALU CLASS F WARNING ENTRY !!!! | 3e-066 |
| 2752 | U95094 | *Xenopus laevis* XL-INCENP (XL-INCENP) mRNA, complete cds | 1e-011 | 2072296 | (U95098) mitotic phosphoprotein 44 [*Xenopus laevis*] | 5.2 |
| 2753 | U95102 | *Xenopus laevis* mitotic phosphoprotein 90 mRNA, complete cds | 3e-011 | 3219914 | HYPOTHETICAL 16.8 KD PROTEIN C30D10.04 IN CHROMOSOME II >gi\|2276353\|gnl\|PID\|e330328 pombe] | 1e-011 |
| 2754 | U95094 | *Xenopus laevis* XL-INCENP (XL-INCENP) mRNA, complete cds | 1e-011 | 3875246 | (Z81490) similar to WD domain, G-beta repeats (2 domains); cDNA EST EMBL:T00482 comes from this gene; cDNA EST EMBL:T00923 | 6e-078 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2755 | D79205 | Human mRNA for ribosomal protein L39, complete cds | 1e-086 | 1173044 | comes from this gene; cDNA EST yk449d4.3 comes from this gene; cDNA EST yk449d4.5 comes from this gen . . . 60S RIBOSOMAL PROTEIN L39 norvegicus] >gi\|373419 (U57846) ribosomal protein L39 ribosomal protein L39 [Homo sapiens] | 4e-009 |
| 2756 | AB014591 | Homo sapiens mRNA for KIAA0691 protein, complete cds | 0 | 3327196 | (AB014591) KIAA0691 protein [Homo sapiens] | 1e-047 |
| 2757 | U95102 | Xenopus laevis mitotic phosphoprotein 90 mRNA, complete cds | 1e-012 | 115409 | CUTICLE COLLAGEN ROL-6 elegans] >gi\|3879235\|gnl\|PID\|e1348932 (Z66499) similar to cuticle collagen ROL-6; cDNA EST cm10c4 comes from this gene; cDNA EST EMBL:M88874 comes from this gene; cDNA EST yk265e2.3 comes from this gene; cDNA EST yk265e2.5 comes fro | 0.031 |
| 2758 | U78096 | Human macrophage colony stimulating factor receptor (c-fms) gene, exon 1A, 2 and partial cds | 4e-012 | 126296 | LINE-1 REVERSE TRANSCRIPTASE HOMOLOG protein [Nycticebus coucang] | 0.0005 |
| 2759 | U95094 | Xenopus laevis XL-INCENP (XL-INCENP) mRNA, complete cds | 3e-010 | <NONE> | <NONE> | <NONE> |
| 2760 | M27878 | Human DNA binding protein (HPF2) mRNA, complete cds. | 3e-063 | 3702137 | (AL031393) dJ733D15.1 (Zinc-finger protein) [Homo sapiens] | 1e-040 |
| 2761 | U43076 | Mus musculus cdc37 homolog mRNA, complete cds | 2e-017 | 755484 | (U20281) cell division cycle control protein 37 [Gallus gallus] | 8e-022 |
| 2762 | U95094 | Xenopus laevis XL-INCENP (XL-INCENP) mRNA, complete cds | 1e-011 | 2072296 | (U95098) mitotic phosphoprotein 44 [Xenopus laevis] | 5.2 |
| 2763 | U95094 | Xenopus laevis XL-INCENP (XL-INCENP) mRNA, complete cds | 2e-005 | 1171883 | SODIUM-INDEPENDENT ORGANIC ANION TRANSPORTER (ORGANIC ANION TRANSPORTING | 2e-036 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | POLYPEPTIDE) anion - rat >gi\|410311 (L19031) oatp [*Rattus norvegicus*] | |
| 2764 | X54452 | *D. discoideum* culmination spiA (Dd31) gene | 3.3 | <NONE> | <NONE> | <NONE> |
| 2765 | U95094 | *Xenopus laevis* XL-INCENP (XL-INCENP) mRNA, complete cds | 4e-012 | <NONE> | <NONE> | <NONE> |
| 2766 | AF053698 | Reporter vector pAP1-Luc, complete sequence | 3e-019 | 987050 | (X65335) lacZ gene product [unidentified cloning vector] | 0.2 |
| 2767 | U95102 | *Xenopus laevis* mitotic phosphoprotein 90 mRNA, complete cds | 1e-012 | 3582428 | (AB017257) glycocyamine kinase beta chain [*Neanthes diversicolor*] | 4.3 |
| 2768 | <NONE> | <NONE> | <NONE> | <NONE> | <NONE> | <NONE> |
| 2769 | U95098 | *Xenopus laevis* mitotic phosphoprotein 44 mRNA, partial cds | 6e-006 | 3511122 | (AF060503) zinc finger protein [*Homo sapiens*] | 5.3 |
| 2770 | U95094 | *Xenopus laevis* XL-INCENP (XL-INCENP) mRNA, complete cds | 1e-012 | <NONE> | <NONE> | <NONE> |
| 2771 | U95094 | *Xenopus laevis* XL-INCENP (XL-INCENP) mRNA, complete cds | 1e-012 | <NONE> | <NONE> | <NONE> |
| 2772 | U95094 | *Xenopus laevis* XL-INCENP (XL-INCENP) mRNA, complete cds | 2e-006 | <NONE> | <NONE> | <NONE> |
| 2773 | U95094 | *Xenopus laevis* XL-INCENP (XL-INCENP) mRNA, complete cds | 1e-013 | 804788 | (M13002) 2855 is the position of the first start codon in ORF 2; putative [*Mus musculus*] | 0.64 |
| 2774 | U95098 | *Xenopus laevis* mitotic phosphoprotein 44 mRNA, partial cds | 8e-008 | <NONE> | <NONE> | <NONE> |
| 2775 | M86526 | Rat proline-rich protein (PRP) gene, 5' end, and containing several Alu-like repetitive elements. | 0.37 | <NONE> | <NONE> | <NONE> |
| 2776 | Z22923 | *M. musculus* alpha2 (IX) collagen gene, complete CDS. | 0.002 | <NONE> | <NONE> | <NONE> |
| 2777 | Z22923 | *M. musculus* alpha2 (IX) collagen gene, complete CDS. | 0.002 | <NONE> | <NONE> | <NONE> |
| 2778 | U95102 | *Xenopus laevis* mitotic phosphoprotein 90 mRNA, complete cds | 1e-012 | 2072296 | (U95098) mitotic phosphoprotein 44 [*Xenopus laevis*] | 5.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2779 | Z74035 | Caenorhabditis elegans cosmid F47G9, complete sequence [Caenorhabditis elegans] | 3.4 | 2879805 | (AL021813) hypothetical protein | 5.7 |
| 2780 | U95094 | Xenopus laevis XL-INCENP (XL-INCENP) mRNA, complete cds | 1e-012 | <NONE> | <NONE> | <NONE> |
| 2781 | AG001356 | Homo sapiens genomic DNA, 21q region, clone: 9H11BG25 | 2e-015 | <NONE> | <NONE> | <NONE> |
| 2782 | D83006 | Saccharomyces cerevisiae MNN4 gene, complete cds | 1.2 | <NONE> | <NONE> | <NONE> |
| 2783 | Z59640 | H. sapiens CpG DNA, clone 167g11, forward read cpg167g11.ftlb. | 0.12 | <NONE> | <NONE> | <NONE> |
| 2784 | AF049069 | Pinus radiata PRE87 mRNA, complete cds | 1.1 | 1518141 | (U66568) myocyte enhancer factor 2A MEF2A [Danio rerio] | 3.1 |
| 2785 | U95094 | Xenopus laevis XL-INCENP (XL-INCENP) mRNA, complete cds | 4e-012 | 2072296 | (U95098) mitotic phosphoprotein 44 [Xenopus laevis] | 5.4 |
| 2786 | AF031931 | Hydra oligactis cyclic GMP-dependent protein kinase (hyGK) mRNA, complete cds | 0.13 | <NONE> | <NONE> | <NONE> |
| 2787 | Z96177 | H. sapiens telomeric DNA sequence, clone 10QTEL040, read 10QTELOO040.seq | 3e-041 | 987050 | (X65335) lacZ gene product [unidentified cloning vector] | 0.015 |
| 2788 | L48716 | Homo sapiens galactose-1-phosphate uridyl transferase (GALT) mutant F117S gene, exons 3 and 4 | 1.1 | 77657 | hypothetical 30.1K protein - Pseudomonas aeruginosa | 0.095 |
| 2789 | U73902 | Mus musculus emerin (Sta) mRNA, complete cds | 0.37 | 529773 | (U06752) Heterodimeric complex composed of a mucin subunit, ASGP-1, which is predominantly O-glycosylated, and a cysteine-rich transmembrane subunit, ASGP-2, which is predominantly N-glycosylated [Rattus norvegicus] | 0.009 |
| 2790 | X54171 | H. sapiens NG2-6 DNA | 4e-021 | <NONE> | <NONE> | <NONE> |
| 2791 | M30519 | Mouse mammary tumor virus gag gene, 3' end, pol gene, 5' end. | 0.12 | 1262926 | (U51903) RasGAP-related protein [Homo sapiens] | 4.3 |
| 2792 | AJ223355 | Rattus norvegicus | 0.38 | 128059 | NEGATIVE | 2 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mRNA for mitochondrial dicarboxylate carrier | | | FACTOR (F-PROTEIN) (27 KD PROTEIN) (3'ORF) >gi\|77283\|pir\|\|S07 993 nef protein - simian immunodeficiency virus SIVsm (isolate F236) immunodeficiency virus] | |
| 2793 | AF086022 | *Homo sapiens* full length insert cDNA clone YW23E02 | 6e-005 | 3402679 | (AC004697) unknown protein [*Arabidopsis thaliana*] | 9e-016 |
| 2794 | U47322 | Cloning vector DNA, complete sequence. | 9e-010 | <NONE> | <NONE> | <NONE> |
| 2795 | U95094 | *Xenopus laevis* XL-INCENP (XL-INCENP) mRNA, complete cds | 6e-006 | 3873667 | (Z71178) similar to collagen | 0.093 |
| 2796 | U95102 | *Xenopus laevis* mitotic phosphoprotein 90 mRNA, complete cds | 3e-009 | 2745961 | (U51869) Bcd orf2 [*Hom sapiens*] | 0.47 |
| 2797 | AF041209 | *Homo sapiens* midline 1 fetal kidney isoform 2 | 0.0002 | <NONE> | <NONE> | <NONE> |
| 2798 | AF092564 | *Homo sapiens* chromosome-associated protein-C | 5e-056 | 4092846 | (AB019987) chromosome-associated polypeptide-C [*Homo sapiens*] | 3e-017 |
| 2799 | U95094 | *Xenopus laevis* XL-INCENP (XL-INCENP) mRNA, complete cds | 6e-006 | <NONE> | <NONE> | <NONE> |
| 2800 | M95623 | *Homo sapiens* hydroxymethyl-bilane synthase gene, complete cds. | 0.005 | 4007760 | (AL034433) importin alpha subunit | 4.2 |
| 2801 | U95102 | *Xenopus laevis* mitotic phosphoprotein 90 mRNA, complete cds | 7e-007 | <NONE> | <NONE> | <NONE> |
| 2802 | U95094 | *Xenopus laevis* XL-INCENP (XL-INCENP) mRNA, complete cds | 6e-006 | 1065945 | (U40799) coded for by *C. elegans* cDNA yk28f2.3; coded for by *C. elegans* cDNA yk12c10.3; coded for by *C. elegans* cDNA yk5a12.3; coded for by *C. elegans* cDNA yk49a8.3; coded for by *C. elegans* cDNA yk12c10.5; coded for by *C. elegans* cDNA yk28f2 . . . | 0.12 |
| 2803 | U95094 | *Xenopus laevis* XL-INCENP (XL-INCENP) mRNA, complete cds | 0.04 | <NONE> | <NONE> | <NONE> |
| 2804 | M74558 | Human SIL | e-126 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2805 | M72885 | mRNA, complete cds. > :: gb|G28581|G28581 human STS SHGC-35335. Human GOS2 gene, 5' flank and cds. | 0.36 | 3873821 | (Z68213) cDNA EST yk2664c4.5 comes from this gene; cDNA EST yk266c4.3 comes from this gene | 1.8 |
| 2806 | U27341 | *Bos taurus* endothelin converting enzyme-2 Sequence 1 from U.S. Pat. No. 5,736,376 | 6e-078 | 2136744 | endothelin converting enzyme-2-bovine | 3e-028 |
| 2807 | U36756 | *Mus musculus* thrombin receptor (Cf2r) gene, exon 1 | 0.013 | <NONE> | <NONE> | <NONE> |
| 2808 | AJ003209 | Human immunodeficiency virus type 1 mRNA for reverse transcriptase, isolate H-20, partial | 0.12 | <NONE> | <NONE> | <NONE> |
| 2809 | U95094 | *Xenopus laevis* XL-INCENP (XL-INCENP) mRNA, complete cds | 1e-010 | <NONE> | <NONE> | <NONE> |
| 2810 | U95094 | *Xenopus laevis* XL-INCENP (XL-INCENP) mRNA, complete cds | 8e-009 | 1272701 | (L11900) cytochrome b [*Cratogeomys bulleri*] | 9.3 |
| 2811 | U95102 | *Xenopus laevis* mitotic phosphoprotein 90 mRNA, complete cds | 3e-009 | <NONE> | <NONE> | <NONE> |
| 2812 | AB006572 | *Homo sapiens* RMP mRNA for RPB5 mediating protein, complete cds | 0 | 3970833 | (AB006572) RPB5 mediating protein [*Homo sapiens*] | 5e-037 |
| 2813 | U95102 | *Xenopus laevis* mitotic phosphoprotein 90 mRNA, complete cds | 2e-006 | 1109865 | (U41540) coded for by *C. elegans* cDNA yk42d12.5; coded for by *C. elegans* cDNA yk27e10.5; coded for by *C. elegans* cDNA cm08h6; coded for by *C. elegans* cDNA yk88e12.5; coded for by *C. elegans* cDNA yk42d12.3; coded for by *C. elegans* cDNA yk27e1 . . . | 2e-009 |
| 2814 | Z26259 | *H. sapiens* isoform 1 gene for L-type calcium channel, exon 4 | 3e-029 | 3426264 | (AF037269) cell division protein [*Mycobacterium smegmatis*] | 0.47 |
| 2815 | U95102 | *Xenopus laevis* mitotic phosphoprotein 90 mRNA, | 0.0002 | 2358285 | (AF010403) ALR [*Homo sapiens*] | 0.27 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2816 | AC004498 | Homo sapiens chromosome 5, P1 clone 1209C1 (LBNL H104), complete sequence [Homo sapiens] complete cds | 2e-006 | <NONE> | <NONE> | <NONE> |
| 2817 | U95102 | Xenopus laevis mitotic phosphoprotein 90 mRNA, complete cds | 3e-010 | 2072296 | (U05098) mitotic phosphoprotein 44 [Xenopus laevis] | 3.1 |
| 2818 | U43626 | Human chromosome 15q11-q13 putative DNA replication origin in the g-aminobutyric acid receptor b3 and a5 gene cluster | 2e-018 | 2197085 | (AF003535) ORF2-like protein [Homo sapiens] | 0.0002 |
| 2819 | Z96402 | H. sapiens telomeric DNA sequence, clone 18QTEL022, read 18QTELOO022.seq | 0.001 | 386792 | (M32334) intercellular adhesion molecule 2 (ICAM-2) [Homo sapiens] | 9.2 |
| 2820 | U43626 | Human chromosome 15q11-q13 putative DNA replication origin in the g-aminobutyric acid receptor b3 and a5 gene cluster | 2e-018 | 2197085 | (AF003535) ORF2-like protein [Homo sapiens] | 0.0002 |
| 2821 | U66534 | Human beta4-integrin (ITGB4) gene, exon 14, 15, 16, 17 and 18 | 0.12 | <NONE> | <NONE> | <NONE> |
| 2822 | U95094 | Xenopus laevis XL-INCENP (XL-INCENP) mRNA, complete cds | 3e-009 | 2072296 | (U95098) mitotic phosphoprotein 44 [Xenopus laevis] | 3.2 |
| 2823 | AC001462 | Homo sapiens (subclone 2_h10 from BAC H107) DNA sequence | 3e-011 | 2072296 | (U95098) mitotic phosphoprotein 44 [Xenopus laevis] | 7.1 |
| 2824 | AE000464 | Escherichia coli K-12 MG1655 section 354 of 400 of the complete genome | 6e-005 | 3879850 | (Z81592) predicted using Genefinder | 2e-039 |
| 2825 | AB018304 | Homo sapiens mRNA for KIAA0761 protein, partial cds | 3e-009 | <NONE> | <NONE> | <NONE> |
| 2826 | AL008982 | Plasmodium falciparum DNA *** SEQUENCING IN PROGRESS *** from contig 3-52, complete sequence | 3.2 | 3880930 | (AL021481) similar to Phosphoglucomutase and phosphomannomutase phosphoserine; cDNA EST EMBL:D36168 comes from this gene; cDNA EST EMBL:D70697 comes from this gene; cDNA EST yk373h9.5 comes | 5e-053 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2827 | Z54196 | S. cereale DNA for repeat unit (D1100 family) | 0.36 | 2500714 | from this gene; cDNA EST EMBL:T008 . . . HYPOTHETICAL 35.0 KD PROTEIN F48E8.1 IN CHROMOSOME III >gi\|746485 (U23514) similar to antigen domain of venom allergen (SP:VA52_DOLM A, P10736) and to antigen 5 (PIR:A37329) [Caenorhabditis elegans] | 4.1 |
| 2828 | Z95979 | Homo sapiens hRED1 gene, exons 7, 8, 9 and 10 | 7e-017 | 113668 | !!!! ALU CLASS C WARNING ENTRY !!!! | 0.002 |
| 2829 | Z15030 | H. sapiens gene for ventricular myosin light chain 2 > :: gb\|L01652\|HUM VMLC Human ventricular myosin light chain 2 gene, seven exons. | 5e-024 | 565265 | (M76741) biliary glycoprotein [Homo sapiens] | 9.2 |
| 2830 | U56440 | Human His-1 gene sequence | 8e-007 | <NONE> | <NONE> | <NONE> |
| 2831 | AF009941 | Tomocichla tuba cytochrome b (cytb) gene, mitochondrial gene encoding mitochondrial protein, complete cds | 1.2 | <NONE> | <NONE> | <NONE> |
| 2832 | X68011 | H. sapiens ZNF81 gene | 3e-030 | 1731442 | ZINC FINGER PROTEIN 81 human (fragment) >gi\|454325 (X68011) ZNF81 gene product | 1e-020 |
| 2833 | U36499 | Human lymphoid-specific SP100 homolog (LYSP100-A) mRNA, complete cds | 1e-020 | <NONE> | <NONE> | <NONE> |
| 2834 | Z60692 | H. sapiens CpG DNA, clone 31f7, reverse read cpg31f7.rt1a. | 3e-059 | <NONE> | <NONE> | <NONE> |
| 2835 | X92485 | P. vivax pval gene | 0.0002 | <NONE> | <NONE> | <NONE> |
| 2836 | U95102 | Xenopus laevis mitotic phosphoprotein 90 mRNA, complete cds | 0.0005 | 576257 | Prostatic Acid Phosphatase (E.C.3.1.3.2) Complexed With Tartaric Acid >gi\|576258\|pdb\|1R PT\|Prostatic Acid Phosphatase (E.C.3.1.3.2) Complexed With Vanadate | 3e-009 |
| 2837 | U72372 | Scandia geniculata 18S ribosomal RNA | 0.12 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | and 25S ribosomal RNA genes, partial sequence, and internal transcribed spacer 1, 5.8S ribosomal RNA gene and internal transcribed spacer 2, complete sequence | | | | |
| 2838 | D49425 | *Anabaena variabilis* rbpD gene for RNA-binding protein, complete cds | 3.2 | <NONE> | <NONE> | <NONE> |
| 2839 | X95844 | *S. cerevisiae* POP3 gene | 3.5 | <NONE> | <NONE> | <NONE> |
| 2840 | AE001425 | *Plasmodium falciparum* chromosome 2, section 62 of 73 of the complete sequence | 0.041 | 3880909 | (AL032636) Y40B1B.3 [*Caenorhabditis elegans*] | 5.5 |
| 2841 | U95102 | *Xenopus laevis* mitotic phosphoprotein 90 mRNA, complete cds | 2e-007 | <NONE> | <NONE> | <NONE> |
| 2842 | X69064 | *M. musculus* Ank-1 mRNA for erythroid ankyrin | 1.3 | <NONE> | <NONE> | <NONE> |
| 2843 | U61950 | *Caenorhabditis elegans* cosmid C45E5 | 0.13 | <NONE> | <NONE> | <NONE> |
| 2844 | U73332 | Human non-coding genomic sequence upstream from unique L0 sequence in the alpha-globin gene cluster | 1e-010 | <NONE> | <NONE> | <NONE> |
| 2845 | U21051 | Human G protein-coupled receptor (GPR4) gene, complete cds. | 0.13 | <NONE> | <NONE> | <NONE> |
| 2846 | X57921 | *O. sativa* random single-copy DNA fragment 12RG214R | 4.1 | <NONE> | <NONE> | <NONE> |
| 2847 | AF037219 | *Homo sapiens* PIX1 mRNA sequence | 0.043 | <NONE> | <NONE> | <NONE> |
| 2848 | M55124 | Human cystic fibrosis transmembrane conductance regulator (CFTR) gene, exon 17b | 0.005 | <NONE> | <NONE> | <NONE> |
| 2849 | AF035527 | *Mus musculus* EHF (Ehf) mRNA, complete cds | e-164 | 3138930 | (AF035527) EHF [*Mus musculus*] | 5e-084 |
| 2850 | AF052695 | *Rattus norvegicus* cell cycle protein p55CDC gene, complete cds | 3.7 | 2894379 | (Y14573) ring finger protein [*Hordeum vulgare*] | 8.2 |
| 2851 | <NONE> | <NONE> | <NONE> | 3327112 | (AB014549) KIAA0649 protein [*Homo sapiens*] | 3.8 |
| 2852 | M34664 | Human | 0 | 2501737 | TRANSCRIPTIO- | 4.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | chaperonin (HSP60) mRNA, complete cds. | | | NAL ACTIVATOR PROTEIN ACU-15 >gi\|1922895\|gnl\|PID\|e308394 (Y11565) transcriptional activator protein [*Neurospora crassa*] | |
| 2853 | D49701 | *Aspergillus oryzae* niaD gene for nitrate reductase, complete cds | 0.042 | 3879556 | (Z70756) T06E4.11 [*Caenorhabditis elegans*] | 0.5 |
| 2854 | AF016266 | *Homo sapiens* TRAIL receptor 2 mRNA, complete cds | 1e-010 | 134846 | SMALL PROLINE-RICH PROTEIN II rich protein [*Homo sapiens*] | 1.5 |
| 2855 | U44862 | Human Down Syndrome region of chromosome 21, clone A11E6-2B6. | 1.2 | <NONE> | <NONE> | <NONE> |
| 2856 | X14503 | *Chlamydomonas eugametos* petD gene for cytochrome b6/f complex subunit IV | 0.13 | <NONE> | <NONE> | <NONE> |
| 2857 | U95094 | *Xenopus laevis* XL-INCENP (XL-INCENP) mNA, complete cds | 2e-006 | 3228515 | (U70256) SomA [*Synechococcus* PCC6301] | 4.6 |
| 2858 | M25534 | Chicken actin-capping protein (CapZ 36/32) alpha subunit mRNA, complete cds. | 0.41 | <NONE> | <NONE> | <NONE> |
| 2859 | X84372 | *D. melanogaster* lethal(3)73Ah gene | 1.1 | <NONE> | <NONE> | <NONE> |
| 2860 | AF053551 | *Homo sapiens* metaxin 2 (MTX2) mRNA, nuclear gene encoding mitochondrial protein, complete cds | 0 | 3283049 | (AF053551) metaxin 2 [*Homo sapiens*] | 2e-089 |
| 2861 | U95102 | *Xenopus laevis* mitotic phosphoprotein 90 mRNA, complete cds | 6e-005 | 3877358 | (Z66520) similar to RBB3 like protein; cDNA EST EMBL:C08891 comes from this gene; cDNA EST EMBL:C09371 comes from this gene; cDNA EST yk468f10.5 comes from this gene [*Caenorhabditis elegans*] | 3e-005 |
| 2862 | AB002450 | *Homo sapiens* mRNA from chromosome 5q21-22, clone:A3-A | 2e-014 | 3790760 | (AF099922) No definition line found [*Caenorhabditis elegans*] | 2.5 |
| 2863 | AF053698 | Reporter vector | 1e-009 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2864 | AF045086 | pAP1-Luc, complete sequence *Drosophila prosaltans* 14045-0901.4 cytochrome oxidase II (COII) gene, mitochondrial gene encoding mitochondrial protein, complete cds | 0.005 | <NONE> | <NONE> | <NONE> |
| 2865 | Y09312 | *C. botulinum* HA-70 gene (partial) and HA-17 gene | 0.002 | 1171601 | (X95276) rps8 [*Plasmodium falciparum*] | 5.7 |
| 2866 | AJ001597 | *Homo sapiens* gene encoding cAMP-dependent protein kinase gamma isoform | 0.005 | 1869883 | (Z86099) RS1 [human herpesvirus 2] herpesvirus 2] | 0.52 |
| 2867 | AF022962 | *Mus musculus* Sec8 mRNA, complete cds | 1.1 | <NONE> | <NONE> | <NONE> |
| 2868 | U95102 | *Xenopus laevis* mitotic phosphoprotein 90 mRNA, complete cds | 0.0005 | 2499622 | PROBABLE SERINE/THREO-NINE-PROTEIN KINASE YOL113W PROTEIN KINASE 75490 D) | 3.5 |
| 2869 | AJ005262 | *Dictyostelium discoideum* gene encoding a novel glycoprotein | 0.12 | <NONE> | <NONE> | <NONE> |
| 2870 | U08214 | *Rattus* sp. DNA binding protein (URE-B1) mRNA, complete cds. | 0.12 | 4033834 | (AJ009556) cytoskeleton assembly control protein S1a2p [*Candida albicans*] | 0.13 |
| 2871 | <NONE> | <NONE> | <NONE> | <NONE> | <NONE> | <NONE> |
| 2872 | M31061 | Human ornithine decarboxylase gene, complete cds. | 2e-015 | 3808095 | (Y08560) SCO-spondin [*Bos taurus*] | 0.098 |
| 2873 | U21914 | Human duplicate spinal muscular atrophy mRNA, clone 5G7, partial cds. | 0.002 | <NONE> | <NONE> | <NONE> |
| 2874 | <NONE> | <NONE> | <NONE> | 1228047 | (D83782) the KIAA0199 gene is expressed ubiquitously.; the KIAA0199 protein shows similarity to sea urchin hydroxymethylglut-alyl-CoA reductase, and retains 8 hydrophobic domains. [*Homo sapiens*] | 2.5 |
| 2875 | U95102 | *Xenopus laevis* mitotic phosphoprotein 90 mRNA, complete cds | 0.0002 | 4105505 | (AF046914) multiple inositol polyphosphate phosphatase | 5.6 |
| 2876 | Z96120 | *H. sapiens* telomeric DNA sequence, clone | 0.014 | 2347056 | (AJ000085) Nedd4 protein [*Xenopus laevis*] | 5.8 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2877 | U95094 | 12PTEL057, read 12PTELOO057.seq *Xenopus laevis* XL-INCENP (XL-INCENP) mRNA, complete cds | 5e-013 | 2133693 | masquerade precursor - fruit fly (*Drosophila melanogaster*) >gi\|665545 (U18130) masquerade [*Drosophila melanogaster*] >gi\|1095942\|prf\|2 110286A masquerade gene | 1.2 |
| 2878 | X54252 | *C. elegans* complete mitochondrial genome | 0.38 | <NONE> | <NONE> | <NONE> |
| 2879 | S81913 | adrenocorticotropin receptor [*Papio anubis* = baboons, adrenal, mRNA Partial, 426 nt] | 1.2 | <NONE> | <NONE> | <NONE> |
| 2880 | X65997 | *M. musculus* c-kit mRNA for truncated tyrosine-kinase | 0.13 | <NONE> | <NONE> | <NONE> |
| 2881 | AE000588 | *Helicobacter pylori* section 66 of 134 of the complete genome | 1.1 | <NONE> | <NONE> | <NONE> |
| 2882 | U64861 | *Caenorhabditis elegans* cosmid D47D2. | 0.12 | <NONE> | <NONE> | <NONE> |
| 2883 | U23173 | *Caenorhabditis elegans* cosmid K07E1 | 0.37 | 2854192 | (AF045645) contains similarity to microsomal triglyceride transfer proteins [*Caenorhabditis elegans*] | 7.2 |
| 2884 | AB014579 | *Homo sapiens* mRNA for KIAA0679 protein, partial cds | 0 | 3327172 | (AB014579) KIAA0679 protein [*Homo sapiens*] | 2e-053 |
| 2885 | U95102 | *Xenopus laevis* mitotic phosphoprotein 90 mRNA, complete cds | 3e-009 | 1707032 | (U80445) coded for by *C. elegans* cDNA yk13g5.3; coded for by *C. elegans* cDNA yk21g6.3; coded for by *C. elegans* cDNA CEMSE18F; coded for by *C. elegans* cDNA yk126b1.3; coded for by *C. elegans* cDNA yk65h8.3; coded for by *C. elegans* cDNA yk65h8 . . . | 0.17 |
| 2886 | Z22795 | *H. sapiens* microsatellite repeat. | 6e-005 | <NONE> | <NONE> | <NONE> |
| 2887 | AE001061 | *Archaeoglobus fulgidus* section 46 of 172 of the complete genome | 1.1 | 3738162 | (AL031856) putative involvement in protein glycosylation in the golgi [*Schizosaccharomyces pombe*] | 2.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2888 | U95094 | Xenopus laevis XL-INCENP (XL-INCENP) mRNA, complete cds | 6e-006 | <NONE> | <NONE> | <NONE> |
| 2889 | Z96643 | H. sapiens telomeric DNA sequence, clone 5QTEL064, read 5QTELOO064.seq | 0.0005 | 1363732 | probable membrane protein YLR454w - yesst | 4 |
| 2890 | Z96643 | H. sapiens telomeric DNA sequence, clone 5QTEL064, read 5QTELOO064.seq | 0.0005 | 1363732 | probable membrane protein YLR454w - yeast | 4 |
| 2891 | X80169 | M. musculus mRNA for 200 kD protein | e-177 | 1717793 | PROTEIN TSG24 (MEIOTIC CHECK POINT REGULATOR) >gi\|1083553\|pir\|\|A 55117 tsg24 protein - mouse | 5e-069 |
| 2892 | U95094 | Xenopus laevis XL-INCENP (XL-INCENP) mRNA, complete cds | 9e-009 | 3832555 | (AF077439) immunoglobulin heavy chain variable region | 4.4 |
| 2893 | AC002359 | Homo sapiens Xp22 Cosmid U239B3 (from Lawrence Livermore X library) complete sequence [Homo sapiens] | 2e-007 | 3599342 | (AF081112) ORF2 [Mus musculus domesticus] | 0.61 |
| 2894 | U95094 | Xenopus laevis XL-INCENP (XL-INCENP) mRNA, complete cds | 4e-011 | 3123058 | HYPOTHETICAL WD-REPEAT PROTEIN SLL0163 >gi\|1001440\|gnl\|PID\|d1010715 (D63999) beta transducin-like protein [Synechocystis sp.] | 0.001 |
| 2895 | U95102 | Xenopus laevis mitotic phosphoprotein 90 mRNA, complete cds | 9e-010 | 2072296 | (U95098) mitotic phosphoprotein 44 [Xenopus laevis] | 5.2 |
| 2896 | Z46940 | H. sapiens PRM1 gene, PRM2 gene and TNP2 gene | 0.013 | <NONE> | <NONE> | <NONE> |
| 2897 | Z47735 | H. sapiens NFKB1 gene, exons 11 & 12 | 2e-008 | <NONE> | <NONE> | <NONE> |
| 2898 | U95098 | Xenopus laevis mitotic phosphoprotein 44 mRNA, partial cds | 0.004 | 2224611 | (AB002333) KIAA0335 [Homo sapiens] | 4 |
| 2899 | U95094 | Xenopus laevis XL-INCENP (XL-INCENP) mRNA, complete cds | 0.0002 | <NONE> | <NONE> | <NONE> |
| 2900 | X00367 | Chlamydomonas chloroplast DNA region with ARS element 03 (ARS = autonomously replicating sequence) | 0.12 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2901 | U41222 | *Dictyostelium discoideum* RacE (racE) gene, complete cds | 0.35 | <NONE> | <NONE> | <NONE> |
| 2902 | AB007504 | *Triticum aestivum* TaMADS#11 mRNA for MADS box transcription factor, complete cds | 0.042 | <NONE> | <NONE> | <NONE> |
| 2903 | X65319 | Cloning vector pCAT-Enhancer | 7e-069 | 987050 | (X65335) lacZ gene product [unidentified cloning vector] | 7e-011 |
| 2904 | U95094 | *Xenopus laevis* XL-INCENP (XL-INCENP) mRNA, complete cds | 0.0005 | 3924670 | (AC004990) supported by Genscan and several ESTs: C83049 | 6e-042 |
| 2905 | U95094 | *Xenopus laevis* XL-INCENP (XL-INCENP) mRNA, complete cds | 0.041 | 2132051 | hypothetical protein YOR083w - yeast | 3.3 |
| 2906 | Z12112 | pWE15A cosmid vector DNA | 6e-068 | 987050 | (X65335) lacZ gene product [unidentified cloning vector] | 2e-009 |
| 2907 | U95094 | *Xenopus laevis* XL-INCENP (XL-INCENP) mRNA, complete cds | 2e-006 | 2995374 | (AL022245) hypothetical protein | 5e-005 |
| 2908 | U47322 | Cloning vector DNA, complete sequence. | 3e-009 | <NONE> | <NONE> | <NONE> |
| 2909 | X71623 | *H. sapiens* ZNF74-1 mRNA > :: gb\|G27154\|G27154 human STS SHGC-31580. | 4e-012 | 113669 | !!!! ALU CLASS D WARNING ENTRY !!!! | 4.1 |
| 2910 | U43626 | Human chromosome 15q11-q13 putative DNA replication origin in the g-aminobutyric acid receptor b3 and a5 gene cluster | 7e-007 | 2394501 | (AF024503) No definition line found [*Caenorhabditis elegans*] | 9.6 |
| 2911 | U95094 | *Xenopus laevis* XL-INCENP (XL-INCENP) mRNA, complete cds | 5e-014 | 2072296 | (U95098) mitotic phosphoprotein 44 [*Xenopus laevis*] | 5.3 |
| 2912 | U95094 | *Xenopus laevis* XL-INCENP (XL-INCENP) mRNA, complete cds | 1e-012 | 2688749 | (AE001179) conserved hypothetical protein [*Borrelia burgdorferi*]. | 2.3 |
| 2913 | U95102 | *Xenopus laevis* mitotic phosphoprotein 90 mRNA, complete cds | 4e-013 | 2072296 | (U95098) mitotic phosphoprotein 44 [*Xenopus laevis*] | 3.9 |
| 2914 | U95094 | *Xenopus laevis* XL-INCENP (XL-INCENP) mRNA, complete cds | 4e-013 | 2072296 | (U95098) mitotic phosphoprotein 44 [*Xenopus laevis*] | 4 |
| 2915 | U95094 | *Xenopus laevis* | 0.0002 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2916 | U95094 | Xenopus laevis XL-INCENP (XL-INCENP) mRNA, complete cds | 0.004 | 1209842 | (U45423) minus strand repeat motif-containing gene | 0.092 |
| 2917 | X80283 | P. polycephalum genomic DNA containing Taq I repetitive element | 3.3 | <NONE> | <NONE> | <NONE> |
| 2918 | U95094 | Xenopus laevis XL-INCENP (XL-INCENP) mRNA, complete cds | 6e-006 | <NONE> | <NONE> | <NONE> |
| 2919 | U95094 | Xenopus laevis XL-INCENP (XL-INCENP) mRNA, complete cds | 6e-006 | <NONE> | <NONE> | <NONE> |
| 2920 | Z97333 | Homo sapiens RHCE gene | 9e-020 | 113667 | !!!! ALU CLASS B WARNING ENTRY !!!! | 4e-005 |
| 2921 | AF082350 | Homo sapiens bone morphogenetic protein 15 precursor (BMP15) gene, exon 2 and complete cds | 1 | <NONE> | <NONE> | <NONE> |
| 2922 | L14684 | Rattus norvegicus nuclear-encoded mitochondrial elongation factor G mRNA, complete cds. | 0 | 585084 | ELONGATON FACTOR G, MITOCHONDRI- AL PRECURSOR (MEF-G) >gi\|543383\|pir\|\|S4 0780 translation elongation factor G, mitochondrial - rat >gi\|310102 | 9e-089 |
| 2923 | D78335 | Human mRNA for 5'-terminal region of UMK, complete cds | e-163 | 1718058 | URIDINE KINASE (URIDINE MONOPHOSPHO- KINASE) >gi\|471981 (L31783) uridine kinase | 7e-072 |
| 2924 | U95094 | Xenopus laevis XL-INCENP (XL-INCENP) mRNA, complete cds | 2e-007 | <NONE> | <NONE> | <NONE> |
| 2925 | U95094 | Xenopus laevis XL-INCENP (XL-INCENP) mRNA, complete cds | 1e-013 | 1351922 | AMINE OXIDASE PRECURSOR (MONAMINE OXIDASE) (TYRAMINE OXIDASE) >gi\|419575\|pir\|\|B4 1836 amine oxidase (flavin-containing) (EC 1.4.3.4) precursor - Klebsiella pneumoniae >gi\|216723\|gnl\|PI D\|d1001529 | 5.6 |
| 2926 | U95094 | Xenopus laevis | 9e-009 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2927 | U95102 | XL-INCENP (XL-INCENP) mRNA, complete cds<br>Xenopus laevis mitotic phosphoprotein 90 mRNA, complete cds | 1e-013 | 2072296 | (U95098) mitotic phosphoprotein 44 [Xenopus laevis] | 9.7 |
| 2928 | AB018285 | Homo sapiens mRNA for KIAA0742 protein, partial cds | 0 | 3882205 | (AB018285) KIAA0742 protein [Homo sapiens] | 2e-093 |
| 2929 | U95102 | Xenopus laevis mitotic phosphoprotein 90 mRNA, complete cds | 6e-006 | 3882183 | (AB018274) KIAA0731 protein [Homo sapiens] | 4e-049 |
| 2930 | X94762 | H. sapiens DNA for Ki-67 antigen 5'-region (exon 1 & 2) | 2e-068 | 631020 | Kallmann syndrome protein homolog - chicken | 5.6 |
| 2931 | U95102 | Xenopus laevis mitotic phosphoprotein 90 mRNA, complete cds | 2e-007 | 3522948 | (AC004411) hypothetical protein [Arabidopsis thaliana] | 2e-026 |
| 2932 | U95094 | Xenopus laevis XL-INCENP (XL-INCENP) mRNA, complete cds | 4e-011 | 2072296 | (U95098) mitotic phosphoprotein 44 [Xenopus laevis] | 6.5 |
| 2933 | U95102 | Xenopus laevis mitotic phosphoprotein 90 mRNA, complete cds | 9e-008 | <NONE> | <NONE> | <NONE> |
| 2934 | M18795 | Gorilla pseudo-beta- and delta-globin gene intergenic region with 2 Alu repeats. | 7e-028 | <NONE> | <NONE> | <NONE> |
| 2935 | U95102 | Xenopus laevis mitotic phosphoprotein 90 mRNA, complete cds | 0.0005 | <NONE> | <NONE> | <NONE> |
| 2936 | U95094 | Xenopus laevis XL-INCENP (XL-INCENP) mRNA, complete cds | 3e-007 | <NONE> | <NONE> | <NONE> |
| 2937 | U09874 | Mus musculus SKD3 mRNA, complete cds. | 2e-086 | 2493735 | SKD3 PROTETN SKD3 [Mus musculus] | 6e-036 |
| 2938 | U95094 | Xenopus laevis XL-INCENP (XL-INCENP) mRNA, complete cds | 1e-012 | 2072296 | (U95098) mitotic phosphoprotein 44 [Xenopus laevis] | 5.6 |
| 2939 | D38417 | Mouse mRNA for arylhydrocarbon receptor, complete cds | e-154 | 2072296 | (U95098) mitotic phosphoprotein 44 [Xenopus laevis] | 3.4 |
| 2940 | U95102 | Xenopus laevis mitotic phosphoprotein 90 mRNA, complete cds | 3e-008 | 3879062 | (Z81576) predicted using Genefinder | 9.2 |
| 2941 | AE001368 | Plasmodium falciparum chromosome 2, | 0.014 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | section 5 of 73 of the complete sequence | | | | |
| 2942 | U95094 | Xenopus laevis XL-INCENP (XL-INCENP) mRNA, complete cds | 2e-005 | <NONE> | <NONE> | <NONE> |
| 2943 | U95102 | Xenopus laevis mitotic phosphoprotein 90 mRNA, complete cds | 7e-007 | <NONE> | <NONE> | <NONE> |
| 2944 | AF083322 | Homo sapiens centriole associated protein CEP110 mRNA, complete cds | e-133 | 3435244 | (AF083322) centriole associated protein CEP110 [Homo sapiens] | 9e-015 |
| 2945 | U95102 | Xenopus laevis mitotic phosphoprotein 90 mRNA, complete cds | 0.014 | <NONE> | <NONE> | <NONE> |
| 2946 | L07040 | pFNeo eukaryotic expression vector, complete sequence. | 2e-038 | 987050 | (X65335) lacZ gene product [unidentified cloning vector] | 4e-005 |
| 2947 | X65319 | Cloning vector pCAT-Enhancer | 2e-078 | 987050 | (X65335) lacZ gene product [unidentified cloning vector] | 1e-013 |
| 2948 | U95102 | Xenopus laevis mitotic phosphoprotein 90 mRNA, complete cds | 3e-008 | <NONE> | <NONE> | <NONE> |
| 2949 | AL031844 | Human DNA sequence from clone 361H15 on chromosome 22q13.2-13.33, complete sequence [Homo sapiens] | 3.2 | <NONE> | <NONE> | <NONE> |
| 2950 | AC002186 | Homo sapiens (subclone 1_f12 from P1 H115) DNA sequence | 2e-037 | 2072966 | (U93570) p40 [Homo sapiens] | 4e-013 |
| 2951 | U95102 | Xenopus laevis mitotic phosphoprotein 90 mRNA, complete cds | 6e-005 | 4105414 | (AF045593) ETS DNA binding protein Yan [Drosophila virilis] | 1.4 |
| 2952 | U95102 | Xenopus laevis mitotic phosphoprotein 90 mRNA, complete cds | 3e-008 | 629692 | hypothetical protein - common tobacco tabacum] | 4.3 |
| 2953 | S60885 | LYAR = cell growth regulating nucleolar protein [mice, EL4 cells, mRNA, 1474 nt] | 5e-035 | 2498524 | CELL GROWTH REGULATING NUCLEOLAR PROTEIN >gi\|423488\|pir\|\|A40683 cell growth regulating nucleolar protein LYAR - mouse >gi\|300372\|bbs\|131782 | 5e-014 |
| 2954 | U95102 | Xenopus laevis mitotic phosphoprotein 90 mRNA, complete cds | 1e-012 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2955 | Z23090 | H. sapiens mRNA for 28 kDa heat shock protein. | 1e-063 | 1709972 | 60S RIBOSOMAL PROTEIN L10A (CSA-19) | 3e-020 |
| 2956 | X87817 | M. musculus mRNA for Ulip protein | 0.0005 | <NONE> | <NONE> | <NONE> |
| 2957 | U87997 | Enterococcus faecium enterocin B (entB) gene, complete cds | 1.2 | <NONE> | <NONE> | <NONE> |
| 2958 | U95098 | Xenopus laevis mitotic phosphoprotein 44 mRNA, partial cds | 0.001 | <NONE> | <NONE> | <NONE> |
| 2959 | U95102 | Xenopus laevis mitotic phosphoprotein 90 mRNA, complete cds | 1e-011 | <NONE> | <NONE> | <NONE> |
| 2960 | U95098 | Xenopus laevis mitotic phosphoprotein 44 mRNA, partial cds | 3e-009 | <NONE> | <NONE> | <NONE> |
| 2961 | U95098 | Xenopus laevis mitotic phosphoprotein 44 mRNA, partial cds | 3e-009 | <NONE> | <NONE> | <NONE> |
| 2962 | U95094 | Xenopus laevis XL-INCENP (XL-INCENP) mRNA, complete cds | 1e-009 | <NONE> | <NONE> | <NONE> |
| 2963 | X62025 | H. sapiens rod cG-PDE G gene for 3',5'-cyclic nucleotide phosphodiesterase | 4e-034 | 728838 | !!!! ALU SUBFAMILY SX WARNING ENTRY | 9e-006 |
| 2964 | AJ223364 | Homo sapiens germ-line DNA upstream of Jkappa locus | 1e-023 | 2072296 | (U95098) mitotic phosphoprotein 44 [Xenopus laevis] | 4.2 |
| 2965 | Z47046 | Human cosmid QLL2C9 from Xq28 | 3e-020 | 804808 | (M13100) unknown protein [Rattus norvegicus] | 7e-005 |
| 2966 | U95094 | Xenopus laevis XL-INCENP (XL-INCENP) mRNA, complete cds | 0.0002 | <NONE> | <NONE> | <NONE> |
| 2967 | U95098 | Xenopus laevis mitotic phosphoprotein 44 mRNA, partial cds | 9e-009 | 464502 | PEROXISOMAL TARGETING SIGNAL RECEPTOR (PEROXISOMAL PROTEIN PAS10) (PEROXIN-5) (PTS1 RECEPTOR) >gi\|1078412\|pir\|\|A 49403 tetratricopeptide-repeat protein PAS10 - yeast tetratricopeptide-repeat protein [Saccharomyces cerevisiae] >gi\|817830 (Z49701) Pas10p | 9.5 |

TABLE 2-continued

| SEQ ID | ACCESSION | Nearest Neighbor (BlastN vs. Genbank) DESCRIPTION | P VALUE | ACCESSION | Nearest Neighbor (BlastX vs. Non-Redundant Proteins) DESCRIPTION | P VALUE |
|---|---|---|---|---|---|---|
| 2968 | AF035940 | Homo sapiens MAGOH mRNA, complete cds | 3e-050 | 2306969 | [Sa (AF007860) xl-Mago [Xenopus laevis] | 1e-041 |
| 2969 | <NONE> | <NONE> | <NONE> | <NONE> | <NONE> | <NONE> |
| 2970 | X66297 | H. sapiens Alu repeat (terminator 3) | 5e-014 | <NONE> | <NONE> | <NONE> |
| 2971 | AB007934 | Homo sapiens mRNA for KIAA0465 protein, partial cds | 0 | 3413892 | (AB007934) KIAA0465 protein [Homo sapiens] | e-118 |
| 2972 | X15982 | Ascobolus immersus DNA of linear mitochondrial plasmid pA12 with virus like replication | 0.042 | <NONE> | <NONE> | <NONE> |
| 2973 | U95094 | Xenopus laevis XL-INCENP (XL-INCENP) mRNA, complete cds | 4e-012 | <NONE> | <NONE> | <NONE> |
| 2974 | AC002181 | Homo sapiens (subclone 2_a12 from BAC H111) DNA sequence | 2e-014 | 3879351 | (Z35663) Short region of similarity with glucose-6-phosphate 1 - dehydrogenase from Plasmodium falciparum; cDNA EST EMBL:C12945 comes from this gene; cDNA EST yk251d3.3 comes from this gene; cDNA EST yk251d3.5 comes from this . . . | 0.69 |
| 2975 | U95094 | Xenopus laevis XL-INCENP (XL-INCENP) mRNA, complete cds | 0.002 | <NONE> | <NONE> | <NONE> |
| 2976 | U95094 | Xenopus laevis XL-INCENP (XL-INCENP) mRNA, complete cds | 5e-013 | 3334221 | 4-HYDROXYPHEN-YLPYRUVATE DIOXYGENASE 4-hydroxyphenylpy-ruvate dioxygenase [Mycosphaerella graminicola] | 2e-012 |
| 2977 | S60885 | LYAR = cell growth regulating nucleolar protein | 8e-028 | 2498524 | CELL GROWTH REGULATING NUCLEOLAR PROTEIN >gi\|423488\|pir\|\|A40683 cell growth regulating nucleolar protein LYAR - mouse >gi\|300372\|bbs\|131782 | 0.72 |
| 2978 | U43958 | Cloning vector pRcCMV-luc luciferase gene, complete cds | 1e-010 | 335109 | (M24873) major structural protein [Rhesus macaque polyomavirus] | 1.1 |
| 2979 | U95102 | Xenopus laevis mitotic phosphoprotein | 2e-014 | 399294 | CYTOCHROME P450 XXIA3 (STEROID 21- | 3.5 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | 90 mRNA, complete cds | | | HYDROXYLASE) (P450-C21) >gi\|2117374\|pir\|A 32525 steroid 21-monooxygenase (EC 1.14.99.10) cytochrome P450 21A1 - pig >gi\|164560 (M83939) steroid 21-hydroxylase | |
| 2980 | U95102 | Xenopus laevis mitotic phosphoprotein 90 mRNA, complete cds | 0.0002 | 1169449 | PROBABLE EARLY E4 33 KD PROTEIN | 1.9 |
| 2981 | U95094 | Xenopus laevis XL-INCENP (XL-INCENP) mRNA, complete cds | 4e-011 | 2072296 | (U95098) mitotic phosphoprotein 44 [Xenopus laevis] | 3.2 |
| 2982 | Z11711 | H. sapiens gene for alpha-2 macroglobulin, exon 1 | 2e-014 | 728835 | !!!! ALU SUBFAMILY SC WARNING ENTRY | 4.2 |
| 2983 | M76363 | Human (Papua New Guinean) Mitochondrial DNA control region, sequence 130. | 1e-053 | 2072296 | (U95098) mitotic phosphoprotein 44 [Xenopus laevis] | 5.9 |
| 2984 | U21228 | Promoter-probe vector pCG1408, complete sequence. | 3e-049 | <NONE> | <NONE> | <NONE> |
| 2985 | X52994 | Sheep mRNA for CD3 gamma subunit (partial) | 0.005 | 1084987 | cryptogene protein G4-Sauroleishmania tarentolae (strain LEM125) | 2.6 |
| 2986 | X52994 | Sheep mRNA for CD3 gamma subunit (partial) | 0.005 | 1084987 | cryptogene protein G4 - Sauroleishmania tarentolae (strain LEM125) | 2.6 |
| 2987 | <NONE> | <NONE> | <NONE> | <NONE> | <NONE> | <NONE> |
| 2988 | <NONE> | <NONE> | <NONE> | <NONE> | <NONE> | <NONE> |
| 2989 | U95102 | Xenopus laevis mitotic phosphoprotein 90 mRNA, complete cds | 3e-009 | 123398 | OCTAMER-BINDING TRANSCRIPTION FACTOR 1 (OTF-1) (NF-A1) >gi\|104811\|pir\|A3 4873 transcription factor Oct-1, octamer-binding-chicken >gi\|212467 | 3.2 |
| 2990 | U95102 | Xenopus laevis mitotic phosphoprotein 90 mRNA, complete cds | 1e-010 | 3881655 | (Z82090) similar to Alpha-2-macroglobulin family (3 domains); cDNA EST EMBL:D67694 comes from this gene [Caenorhabditis elegans] | 6e-019 |
| 2991 | AB018270 | Homo sapiens mRNA for KIAA0727 protein, partial cds | 0 | 2072296 | (U95098) mitotic phosphoprotein 44 [Xenopus laevis] | 2.5 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 2992 | U58745 | *Caenorhabditis elegans* cosmid C10G6. | 1.2 | 2677839 | (AF023476) meltrin-L precursor [*Homo sapiens*] | 0.24 |
| 2993 | X17051 | *E. gracilis* DNA for ribosomal protein operon | 0.13 | <NONE> | <NONE> | <NONE> |
| 2994 | Z14974 | *D. melanogaster* Cpo 61.1 gene for couch potato protein. | 1.1 | 3021409 | (Y12781) transducin (beta) like 1 protein [*Homo sapiens*] | 6e-017 |
| 2995 | U95098 | *Xenopus laevis* mitotic phosphoprotein 44 mRNA, partial cds | 8e-008 | 417442 | PARA-AMINOBENZO-ATE SYNTHASE *Streptomyces griseus* >gi|388263 (M93058) p-aminobenzoic acid synthase [*Streptomyces griseus*] | 4.2 |
| 2996 | U11270 | Human antithrombin III gene, exon 1 and partial cds. | 9e-020 | 113670 | !!!! ALU CLASS E WARNING ENTRY !!!! | 0.16 |
| 2997 | U95102 | *Xenopus laevis* mitotic phosphoprotein 90 mRNA, complete cds | 1e-010 | 3024528 | RAS-RELATED PROTEIN RAB2BV | 1.1 |
| 2998 | U95102 | *Xenopus laevis* mitotic phosphoprotein 90 mRNA, complete cds | 4e-012 | 728831 | !!!! ALU SUBFAMILY J WARNING ENTRY | 0.17 |
| 2999 | U51670 | *Barbus barbus* x *Barbus meridionalis* microsatellite clone no.77 | 0.13 | <NONE> | <NONE> | <NONE> |
| 3000 | U79776 | *Mus musculus* ajuba (Ajuba) mRNA, complete cds | 4e-094 | 1710382 | (U79776) ajuba; jub [*Mus musculus*] | 8e-037 |
| 3001 | U79776 | *Mus musculus* ajuba (Ajuba) mRNA, complete cds | 4e-094 | 1710382 | (U79776) ajuba; jub [*Mus musculus*] | 8e-037 |
| 3002 | U79776 | *Mus musculus* ajuba (Ajuba) mRNA, complete cds | e-100 | 1710382 | (U79776) ajuba; jub [*Mus musculus*] | 8e-019 |
| 3003 | U79776 | *Mus musculus* ajuba (Ajuba) mRNA, complete cds | e-100 | 1710382 | (U79776) ajuba; jub [*Mus musculus*] | 8e-019 |
| 3004 | U95102 | *Xenopus laevis* mitotic phosphoprotein 90 mRNA, complete cds | 0.0005 | 482227 | hypothetical protein T07C4.9 - *Caenorhabditis elegans* >gi|3879509|gnl|PID|e1349070 (Z29443) similar to Annexin; cDNA EST EMBL:C10640 comes from this gene; cDNA EST EMBL:C12433 comes from this gene; cDNA EST yk192f7.5 comes from this gene; cDNA EST | 0.64 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3005 | U95094 | *Xenopus laevis* XL-INCENP (XL-INCENP) mRNA, complete cds | 5e-013 | 1944590 | yk318c1 (Z94121) hypothetical protein Rv3899c | 7.8 |
| 3006 | <NONE> | <NONE> | <NONE> | <NONE> | <NONE> | <NONE> |
| 3007 | U40603 | *Rattus norvegicus* rat-slowpoke-alpha mRNA, complete cds | 0.12 | 1082665 | oligodendrocyte-specific proline-rich protein 2 - human >gi\|1408050\|gnl\|PID\|d1006205 (D28114) MOBP [*Homo sapiens*] | 0.22 |
| 3008 | AF044081 | *Rattus norvegicus* steroidogenic acute regulatory protein (StAR) mRNA, complete cds | 1.1 | 2213519 | (Z97050) sigG [*Mycobacterium tuberculosis*] | 3.1 |
| 3009 | U95102 | *Xenopus laevis* mitotic phosphoprotein 90 mRNA, complete cds | 7e-007 | <NONE> | <NONE> | <NONE> |
| 3010 | X13345 | Human gene for plasminogen activator inhibitor 1 | 1e-009 | <NONE> | <NONE> | <NONE> |
| 3011 | U95102 | *Xenopus laevis* mitotic phosphoprotein 90 mRNA, complete cds | 4e-012 | 395338 | (X66924) helix-loop-helix protein [*Homo sapiens*] | 0.85 |
| 3012 | U95094 | *Xenopus laevis* XL-INCENP (XL-INCENP) mRNA, complete cds | 1e-011 | 2072296 | (U95098) mitotic phosphoprotein 44 [*Xenopus laevis*] | 5.6 |
| 3013 | D78335 | Human mRNA for 5'-terminal region of UMK, complete cds | e-101 | 2072296 | (U95098) mitotic phosphoprotein 44 [*Xenopus laevis*] | 3.2 |
| 3014 | U03887 | Human BXP20 gene. | 6e-005 | <NONE> | <NONE> | <NONE> |
| 3015 | U43194 | *Mus musculus* rhophilin mRNA, complete cds | 4e-044 | 1176422 | (U43194) rhophilin [*Mus musculus*] | 7e-020 |
| 3016 | AC004507 | *Homo sapiens* chromosome 5, P1 clone 798F12 (LBNL H82), complete sequence [*Homo sapiens*] | 1.2 | <NONE> | <NONE> | <NONE> |
| 3017 | X63436 | *B. taurus* mRNA for poly(A) polymerase | 0 | 464345 | POLY(A) POLYMERASE (PAP) polynucleotide adenylyltransferase [*Bos taurus*] | 6e-065 |
| 3018 | M98512 | Human NFG genomic fragment. | 1e-021 | 728831 | !!!! ALU SUBFAMILY J WARNING ENTRY | 0.095 |
| 3019 | AJ005016 | *Homo sapiens* mRNA for putative ABC transporter, partial | e-159 | 3005931 | (AJ005016) ABC transporter [*Homo sapiens*] | 2e-039 |
| 3020 | AJ006778 | *Homo sapiens* mRNA for DRIM protein | 1e-053 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3021 | X65319 | Cloning vector pCAT-Enhancer | 3e-081 | 987050 | (X65335) lacZ gene product [unidentified cloning vector] | 3e-015 |
| 3022 | U14698 | Human Alu-Sb2 repeat, clone HSB-8P. | 1e-040 | 728834 | !!!! ALU SUBFAMILY SB2 WARNING ENTRY | 0.0001 |
| 3023 | U95094 | *Xenopus laevis* XL-INCENP (XL-INCENP) mRNA, complete cds | 1e-010 | 3218396 | (AL023860) hypothetical protein | 0.0003 |
| 3024 | U95098 | *Xenopus laevis* mitotic phosphoprotein 44 mRNA, partial cds | 1.20E-01 | <NONE> | <NONE> | <NONE> |
| 3025 | Z59351 | *H.sapiens* CpG DNA, clone 151a12, reverse read cpg151a12.rt1a. | 3e-020 | 1079063 | deep orange protein-fruit fly (*Drosophila melanogaster*) >gi\|798832 (X86683) deep orange (dor) | 9.90E-02 |
| 3026 | AB014564 | *Homo sapiens* mRNA for KIAA0664 protein, partial cds | e-164 | 2498095 | 5E5 ANTIGEN >gi\|1085558\|pir\|JC4163 DNA-binding protein 5E5-rat norvegicus] >gi\|1581020\|prf\|2 116328A DNA-binding protein 5E5 [*Rattus norvegicus*] | 3.2 |
| 3027 | U95094 | *Xenopus laevis* XL-INCENP (XL-INCENP) mRNA, complete cds | 1e-010 | <NONE> | <NONE> | <NONE> |
| 3028 | U95094 | *Xenopus laevis* XL-INCENP (XL-INCENP) mRNA, complete cds | 1e-010 | <NONE> | <NONE> | <NONE> |
| 3029 | U95094 | *Xenopus laevis* XL-INCENP (XL-INCENP) mRNA, complete cds | 1e-010 | <NONE> | <NONE> | <NONE> |
| 3030 | U95094 | *Xenopus laevis* XL-INCENP (XL-INCENP) mRNA, complete cds | 4.00E-12 | 2072296 | (U95098) mitotic phosphoprotein 44 [*Xenopus laevis*] | 5.6 |
| 3031 | U95098 | *Xenopus laevis* mitotic phosphoprotein 44 mRNA, partial cds | 1.20E-01 | <NONE> | <NONE> | <NONE> |
| 3032 | AF070523 | *Homo sapiens* JWA protein mRNA, complete cds | 0.00E+00 | <NONE> | <NONE> | <NONE> |
| 3033 | Z19055 | *B.aphidicola* tryptophan operon | 0.41 | <NONE> | <NONE> | <NONE> |
| 3034 | Z19055 | *B.aphidicola* tryptophan operon | 0.41 | <NONE> | <NONE> | <NONE> |
| 3035 | Z19055 | *B.aphidicola* tryptophan operon | 0.41 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3036 | U95098 | *Xenopus laevis* mitotic phosphoprotein 44 mRNA, partial cds | 7.00E-07 | <NONE> | <NONE> | <NONE> |
| 3037 | U95094 | *Xenopus laevis* XL-INCENP (XL-INCENP) mRNA, complete cds | 3e-009 | <NONE> | <NONE> | <NONE> |
| 3038 | AF064482 | *Homo sapiens* natural resistance-associated macrophage protein 2 (NRAMP2) gene, exons 16 and 16A, alternatively spliced IRE form, complete cds | 0 | <NONE> | <NONE> | <NONE> |
| 3039 | U95098 | *Xenopus laevis* mitotic phosphoprotein 44 mRNA, partial cds | 1.20E-01 | <NONE> | <NONE> | <NONE> |
| 3041 | U28153 | *Caenorhabditis elegans* UNC-76 (unc-76) gene, complete cds. | 0.38 | <NONE> | <NONE> | <NONE> |
| 3042 | U95094 | *Xenopus laevis* XL-INCENP (XL-INCENP) mRNA, complete cds | 5.00E-03 | 1079063 | deep orange protein-fruit fly (*Drosophila melanogaster*) >gi\|798832 (X86683) deep orange (dor) | 0.23 |
| 3043 | U95094 | *Xenopus laevis* XL-INCENP (XL-INCENP) mRNA, complete cds | 5.00E-03 | 1079063 | deep orange protein-fruit fly (*Drosophila melanogaster*) >gi\|798832 (X86683) deep orange (dor) | 0.23 |
| 3044 | U95098 | *Xenopus laevis* mitotic phosphoprotein 44 mRNA, partial cds | 2.00E-05 | <NONE> | <NONE> | <NONE> |
| 3045 | U95102 | *Xenopus laevis* mitotic phosphoprotein 90 mRNA, complete cds | 3e-009 | <NONE> | <NONE> | <NONE> |
| 3046 | U63810 | *Homo sapiens* WD40 protein Ciao 1 mRNA, complete cds | 0.00E+00 | 3219331 | (AC004020) Unknown gene product [*Homo sapiens*] | 2e-097 |
| 3047 | M21533 | Human MHC class I lymphocyte antigen (HLA-E) | 2e-005 | 120467 | V-FOS/FOX TRANSFORMING PROTEIN murine osteosarcoma virus (provirus) (fragment) | 9.9 |
| 3048 | U95098 | *Xenopus laevis* mitotic phosphoprotein 44 mRNA, partial cds | 6e-006 | 462702 | NEUROFILAMENT TRIPLET H PROTEIN (200 KD NEUROFILAMENT PROTEIN) (NF-H) | 2.6 |
| 3049 | U95102 | *Xenopus laevis* mitotic | 1e-010 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3050 | U95102 | Xenopus laevis mitotic phosphoprotein 90 mRNA, complete cds | 4e-011 | 2072296 | (U95098) mitotic phosphoprotein 44 [Xenopus laevis] | 3.6 |
| 3051 | U95102 | Xenopus laevis mitotic phosphoprotein 90 mRNA, complete cds | 5.00E-04 | 3116127 | (AL023287) hypothetical protein | 6.9 |
| 3052 | U95094 | Xenopus laevis XL-INCENP (XL-INCENP) mRNA, complete cds | 7.00E-06 | 586875 | HYPOTHETICAL 29.2 KD PROTEIN IN METS-KSGA INTERGENIC REGION >gi\|2127033\|pir\|\|S66068 hypothetical protein-Bacillus subtilis subtilis] >gi\|2632306\|gnl\|PID\|e1181972 (Z99104) similar to hypothetical proteins [Bacillus subtilis] | 2e-014 |
| 3053 | U95102 | Xenopus laevis mitotic phosphoprotein 90 mRNA, complete cds | 1e-010 | 1326350 | (U58748) similar to potential transmembrane domains in S. cerevisiae nulcear division RFT1 protein (SP:P38206) | 0.035 |
| 3054 | Y10938 | Homo sapiens retroviral-like sequence S71, 5LTR and env-like sequence | 6e-016 | 2072296 | (U95098) mitotic phosphoprotein 44 [Xenopus laevis] | 4.4 |
| 3055 | U95094 | Xenopus laevis XL-INCENP (XL-INCENP) mRNA, complete cds | 2.00E-05 | <NONE> | <NONE> | <NONE> |
| 3056 | AE000723 | Aquifex aeolicus section 55 of 109 of the complete genome | 1.20E+00 | <NONE> | <NONE> | <NONE> |
| 3057 | U18055 | Lycopersicon esculentum 1-aminocyclo-propane-1-carboxylate synthase (LE-ACS3) DNA, partial cds | 1.10E+00 | <NONE> | <NONE> | <NONE> |
| 3058 | AJ006025 | Cicer arietinum mRNA for acyl-coA synthetase, partial | 0.38 | <NONE> | <NONE> | <NONE> |
| 3059 | AJ006025 | Cicer arietinum mRNA for acyl-coA synthetase, partial | 0.38 | <NONE> | <NONE> | <NONE> |
| 3060 | U95102 | Xenopus laevis mitotic phosphoprotein 90 mRNA, complete cds | 0.014 | <NONE> | <NONE> | <NONE> |
| 3061 | U95102 | Xenopus laevis | 0.014 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3062 | U95102 | *Xenopus laevis* mitotic phosphoprotein 90 mRNA, complete cds | 3.00E-10 | 3880303 | (Z54238) T28C6.1 [*Caenorhabditis elegans*] | 4.10E-02 |
| 3063 | AE000723 | *Aquifex aeolicus* section 55 of 109 of the complete genome | 1.20E+00 | <NONE> | <NONE> | <NONE> |
| 3064 | Y14352 | *Gallus gallus* gene encoding neurofascin, exons 31 & 31 | 0.042 | 995644 | (Z54206) UL38 [*Bovine herpesvirus 1*] >gi\|1149580 (Z49078) UL38 [*Bovine herpesvirus 1*] >gi\|2653309\|gnl\|PID\|e1187305 | 1.9 |
| 3065 | AE000723 | *Aquifex aeolicus* section 55 of 109 of the complete genome | 1.20E+00 | <NONE> | <NONE> | <NONE> |
| 3066 | U95102 | *Xenopus laevis* mitotic phosphoprotein 90 mRNA, complete cds | 2.00E-03 | <NONE> | <NONE> | <NONE> |
| 3067 | U95102 | *Xenopus laevis* mitotic phosphoprotein 90 mRNA, complete cds | 2.00E-03 | <NONE> | <NONE> | <NONE> |
| 3068 | U95102 | *Xenopus laevis* mitotic phosphoprotein 90 mRNA, complete cds | 2.00E-03 | <NONE> | <NONE> | <NONE> |
| 3069 | U95094 | *Xenopus laevis* XL-INCENP (XL-INCENP) mRNA, complete cds | 0.38 | 1395143 | (D86080) aniline dioxygenase reductase component [*Acinetobacter* sp.] dioxygenase reductase component [*Acinetobacter* sp.] | 9.00E-05 |
| 3070 | AE001398 | *Plasmodium falciparum* chromosome 2, section 35 of 73 of the complete sequence | 0.0005 | <NONE> | <NONE> | <NONE> |
| 3071 | U95102 | *Xenopus laevis* mitotic phosphoprotein 90 mRNA, complete cds | 0.014 | <NONE> | <NONE> | <NONE> |
| 3072 | D16902 | Human HepG2 3' region cDNA, clone hmd2h10 | 2.00E-49 | <NONE> | <NONE> | <NONE> |
| 3073 | Z26494 | *S.cerevisiae* genes for histone H2A and H2B, trehalase, and hexaprenyl pyrophosphate synthetase | 1.1 | 3581891 | (AL031540) hypothetical wtf3 protein | 9.70E+00 |
| 3074 | U95102 | *Xenopus laevis* mitotic phosphoprotein | 2.00E-05 | 2224921 | (AF000606) insect intestinal mucin IIM22 | 1e-005 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | 90 mRNA, complete cds | | | [*Trichoplusia ni*] | |
| 3075 | U95094 | *Xenopus laevis* XL-INCENP (XL-INCENP) mRNA, complete cds | 0.37 | <NONE> | <NONE> | <NONE> |
| 3076 | U18157 | Human HLA class I genomic survey sequence. | 2.00E-05 | <NONE> | <NONE> | <NONE> |
| 3077 | U95094 | *Xenopus laevis* XL-INCENP (XL-INCENP) mRNA, complete cds | 4.20E-02 | 2622750 | (AE000921) DNA topoisomerase I [*Methanobacterium thermoautotrophicum*] | 2.5 |
| 3078 | AF022789 | *Homo sapiens* ubiquitin hydrolyzing enzyme I | 0.00E+00 | <NONE> | <NONE> | <NONE> |
| 3079 | U18055 | *Lycopersicon esculentum* 1-aminocyclo-propane-1-carboxylate synthase (LE-ACS3) DNA, partial cds | 1.10E+00 | <NONE> | <NONE> | <NONE> |
| 3080 | AF022388 | *Caenorhabditis elegans* putative transcription factor MAB-3 (mab-3) gene, complete cds | 1.40E-02 | 3747107 | (AF095741) unknown [*Rattus norvegicus*] | 6e-012 |
| 3081 | AF084594 | *Plasmodium falciparum* erythrocyte membrane protein 1 type w (var) gene, partial cds | 1.20E+00 | 3132802 | (AF063223) pol protein [Human immunodeficiency virus type 1] | 1.2 |
| 3082 | D16902 | Human HepG2 3' region cDNA, clone hmd2h10 | 2.00E-49 | <NONE> | <NONE> | <NONE> |
| 3083 | X65709 | *A.carrageenovora* gene for arylsulfatase | 0.014 | <NONE> | <NONE> | <NONE> |
| 3084 | AF060246 | *Mus musculus* strain C57BL/6 zinc finger protein 106 (Zfp106) mRNA, H3a-a allele, complete cds | 2e-078 | 3372657 | (AF060246) zinc finger protein 106 [*Mus musculus*] | 1e-031 |
| 3085 | AF037332 | *Homo sapiens* Eph-like receptor tyrosine kinase hEphB1b (EphB1) mRNA, complete cds | 3.70E-01 | <NONE> | <NONE> | <NONE> |
| 3086 | U17579 | Human growth hormone-releasing hormone receptor gene, alternatively spliced forms a, b, and c, partial cds | 0.053 | <NONE> | <NONE> | <NONE> |
| 3087 | U95102 | *Xenopus laevis* mitotic phosphoprotein 90 mRNA, complete cds | 0.39 | 2950453 | (AL022071) beta-transducin | 2.00E-05 |
| 3088 | U67479 | *Methanococcus* | 0.005 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | *jannaschii* section 21 of 150 of the complete genome | | | | |
| 3089 | U95102 | *Xenopus laevis* mitotic phosphoprotein 90 mRNA, complete cds | 9e-010 | 3283350 | (AF062378) calmodulin-binding protein SHA1 [*Mus musculus*] | 3e-006 |
| 3090 | Z59351 | *H.sapiens* CpG DNA, clone 151a12, reverse read cpg151a12.rt1a. | 3e-020 | 1079063 | deep orange protein-fruit fly (*Drosophila melanogaster*) >gi|798832 (X86683) deep orange (dor) | 9.90E-02 |
| 3091 | U95102 | *Xenopus laevis* mitotic phosphoprotein 90 mRNA, complete cds | 2e-005 | 1125753 | (U42833) coded for by *C. elegans* cDNA CEESN37F; Similar to ammonium transport protein. [*Caenorhabditis elegans*] | 1.00E-17 |
| 3092 | AF021834 | *Homo sapiens* tissue factor pathway inhibitor beta (TFPIbeta) mRNA, complete cds | e-172 | 125932 | TISSUE FACTOR PATHWAY INHIBITOR PRECURSOR (TFPI) (LIPOPROTEIN-ASSOCIATED COAGULATION INHIBITOR) (LACI) (EXTRINSIC PATHWAY INHIBITOR) (EPI) precursor-human >gi|180546 (J03225) lipoprotein-associated coagulation inhibitor precursor associated coagulation | 9e-032 |
| 3093 | AJ006778 | *Homo sapiens* mRNA for DRIM protein | 0.00E+00 | 3242214 | (AJ006778) DRIM protein [*Homo sapiens*] | 3e-095 |
| 3094 | AJ006778 | *Homo sapiens* mRNA for DRIM protein | 0.00E+00 | 3242214 | (AJ006778) DRIM protein [*Homo sapiens*] | 3e.095 |
| 3095 | U95098 | *Xenopus laevis* mitotic phosphoprotein 44 mRNA, partial cds | 6e-005 | <NONE> | <NONE> | <NONE> |
| 3096 | AJ006778 | *Homo sapiens* mRNA for DRIM protein | 0 | 3242214 | (AJ006778) DRIM protein [*Homo sapiens*] | 8.00E-93 |
| 3097 | U95094 | *Xenopus laevis* XL-INCENP (XL-INCENP) mRNA, complete cds | 2e-005 | <NONE> | <NONE> | <NONE> |
| 3098 | U95094 | *Xenopus laevis* XL-INCENP (XL-INCENP) mRNA, complete cds | 3.00E-09 | 1850115 | (Z86089) fadD2 [*Mycobacterium tuberculosis*] | 1.4 |
| 3099 | U95094 | *Xenopus laevis* XL-INCENP (XL-INCENP) mRNA, complete | 1e-009 | <NONE> | <NONE> | <NONE> |

TABLE 2-continued

| SEQ ID | ACCESSION | Nearest Neighbor (BlastN vs. Genbank) DESCRIPTION | P VALUE | Nearest Neighbor (BlastX vs. Non-Redundant Proteins) ACCESSION | DESCRIPTION | P VALUE |
|---|---|---|---|---|---|---|
| 3100 | U95094 | Xenopus laevis XL-INCENP (XL-INCENP) mRNA, complete cds | 1e-009 | <NONE> | <NONE> | <NONE> |
| 3101 | U67986 | Bacillus megaterium anthranilate synthase (trpD) gene, partial cds, indole glycerol phosphate synthetase N-phosphoribosylan thranilate isomerase (trpF) gene partial cds | 1.1 | 2102696 | (U72761) karyopherin beta 3 [Homo sapiens] | 1.90E+00 |
| 3102 | U95102 | Xenopus laevis mitotic phosphoprotein 90 mRNA, complete cds | 3e-010 | 2072296 | (U95098) mitotic phosphoprotein 44 [Xenopus laevis] | 5.5 |
| 3103 | U95102 | Xenopus laevis mitotic phosphoprotein 90 mRNA, complete cds | 1.00E-10 | 135554 | TETRACYCLINE RESISTANCE PROTEIN Bacillus cereus plasmid pBC16 >gi\|72838\|pir\|YTSOG tetracycline resistance protein-Streptococcus agalactiae plasmid pMV158 >gi\|80428\|pir\|JQ1211 tetracycline resistance protein-Bacillus sp. plasmid pTB19 >gi\|151696 (M63 | 1.4 |
| 3104 | AJ006778 | Homo sapiens mRNA for DRIM protein | 0 | 3242214 | (AJ006778) DRIM protein [Homo sapiens] | 8.00E-93 |
| 3105 | U95102 | Xenopus laevis mitotic phosphoprotein 90 mRNA, complete cds | 0.002 | <NONE> | <NONE> | <NONE> |
| 3106 | M60562 | Mus musculus Mhc class II A beta polypeptide, partial cds (exons 3 and 4) | 1.10E+00 | <NONE> | <NONE> | <NONE> |
| 3107 | U91985 | Human DNA fragmentation factor-45 mRNA, complete cds | e-133 | 2810997 | DNA FRAGMENTATION FACTOR-45 factor-45 [Homo sapiens] | 7e-013 |
| 3108 | Y11455 | S.salar microsatellite DNA, CA-repeat (AC)11.5 | 3.50E-01 | 3879530 | (Z49130) cDNA EST yk486b9.3 comes from this gene; cDNA EST yk486b9.5 comes from this gene | 0.0001 |
| 3109 | Y11455 | S.salar microsatellite DNA, CA-repeat (AC)11.5 | 3.50E-01 | 3879530 | (Z49130) cDNA EST yk486b9.3 comes from this gene; cDNA EST yk486b9.5 comes from this gene | 0.0001 |
| 3110 | AF052135 | Homo sapiens clone 23625 mRNA sequence | 4e-033 | 4098124 | (U73522) STAM SH3 domain associating molecule [Homo | 5e-033 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | sapiens] | |
| 3111 | U95098 | Xenopus laevis mitotic phosphoprotein 44 mRNA, partial cds | 6e-005 | <NONE> | <NONE> | <NONE> |
| 3112 | U95102 | Xenopus laevis mitotic phosphoprotein 90 mRNA, complete cds | 9e-009 | 1351538 | HYPOTHETICAL PROTEIN MG306 Mycoplasma genitalium (SGC3) >gi|3844885 (U39711) conserved hypothetical protein [Mycoplasma genitalium] | 1.4 |
| 3113 | L78777 | Homo sapiens (subclone 2_b8 from P1 H49) DNA sequence | 1.30E-01 | <NONE> | <NONE> | <NONE> |
| 3114 | U95102 | Xenopus laevis mitotic phosphoprotein 90 mRNA, complete cds | 0.002 | <NONE> | <NONE> | <NONE> |
| 3115 | U29917 | Human AMP deaminase (AMPD3) gene, exon 8 and 9. | 3.00E-10 | <NONE> | <NONE> | <NONE> |
| 3116 | U95102 | Xenopus laevis mitotic phosphoprotein 90 mRNA, complete cds | 9e-009 | <NONE> | <NONE> | <NONE> |
| 3117 | AE001038 | Archaeoglobus fulgidus section 69 of 172 of the complete genome | 0.14 | <NONE> | <NONE> | <NONE> |
| 3118 | AF042378 | Homo sapiens spindle pole body protein spc98 homolog GCP3 mRNA, complete cds | 0 | 2801699 | (AF042378) spindle pole body protein spc98 homolog GCP3 | 4e-080 |
| 3119 | U95094 | Xenopus laevis XL-INCENP (XL-INCENP) mRNA, complete cds | 2e-005 | <NONE> | <NONE> | <NONE> |
| 3120 | U95102 | Xenopus laevis mitotic phosphoprotein 90 mRNA, complete cds | 9e-009 | 1351538 | HYPOTHETICAL PROTEIN MG306 Mycoplasma genitalium (SGC3) >gi|3844885 (U39711) conserved hypothetical protein [Mycoplasma genitalium] | 1.4 |
| 3121 | U95102 | Xenopus laevis mitotic phosphoprotein 90 mRNA, complete cds | 7.00E-07 | 133361 | DNA-DIRECTED RNA POLYMERASE III 128 KD POLYPEPTIDE (RNA POLYMERASE III SUBUNIT 2) 2.7.7.6) III second-largest chain-fruit fly polymerase III second-largest | 4.40E+00 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | subunit [Drosophila melanogaster] | |
| 3122 | U95102 | Xenopus laevis mitotic phosphoprotein 90 mRNA, complete cds | 2.00E-05 | <NONE> | <NONE> | <NONE> |
| 3123 | U95102 | Xenopus laevis mitotic phosphoprotein 90 mRNA, complete cds | 2.00E-05 | <NONE> | <NONE> | <NONE> |
| 3124 | AJ011981 | Homo sapiens mRNA sequence, IMAGE clone 417820 | 2.00E-69 | 461950 | DPY-19 PROTEIN elegans >gi|156300 (L12018) putative [Caenorhabditis elegans] | 2e-026 |
| 3125 | U95102 | Xenopus laevis mitotic phosphoprotein 90 mRNA, complete cds | 2e-005 | <NONE> | <NONE> | <NONE> |
| 3126 | U95102 | Xenopus laevis mitotic phosphoprotein 90 mRNA, complete cds | 4e-011 | 2072296 | (U95098) mitotic phosphoprotein 44 [Xenopus laevis] | 3.60E+00 |
| 3127 | M26216 | Rat (lambda 20BH0.1) L-type 6-phosphofructo-2-kinase/fructose-2,6-bisphosphatase | 4.10E-02 | 205752 | (M94288) Nopp140 [Rattus norvegicus] | 1.1 |
| 3128 | U95094 | Xenopus laevis XL-INCENP (XL-INCENP) mRNA, complete cds | 5.00E-03 | <NONE> | <NONE> | <NONE> |
| 3129 | <NONE> | <NONE> | <NONE> | 730888 | OCTAPEPTIDE-REPEAT PROTEIN T2 >gi|296382 | 5.2 |
| 3130 | U95102 | Xenopus laevis mitotic phosphoprotein 90 mRNA, complete cds | 5.00E-03 | <NONE> | <NONE> | <NONE> |
| 3131 | X65446 | H.sapiens gene locus DXS278 (S232-RU2) DNA | 6e-011 | 119110 | EBNA-1 NUCLEAR PROTEIN herpesvirus 4 (strain B95-8) >gi|1334880 (V01555) BKRF1 encodes EBNA-1 protein, latent cycle gene. [Human herpesvirus 4] | 1e-005 |
| 3132 | X65446 | H.sapiens gene locus DXS278 (S232-RU2) DNA | 6e-011 | 119110 | EBNA-1 NUCLEAR PROTEIN herpesvirus 4 (strain B95-8) >gi|1334880 (V01555) BKRF1 encodes EBNA-1 protein, latent cycle gene. [Human herpesvirus 4] | 1e-005 |
| 3133 | X72219 | C.pasteurianum | 0.015 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3134 | U95094 | gap gene *Xenopus laevis* XL-INCENP (XL-INCENP) mRNA, complete cds | 2e-006 | <NONE> | <NONE> | <NONE> |
| 3135 | Z26494 | *S.cerevisiae* genes for histone H2A and H2B, trehalase, and hexaprenyl pyrophosphate synthetase | 1.1 | 3581891 | (AL031540) hypothetical wtf3 protein | 9.70E+00 |
| 3136 | U95102 | *Xenopus laevis* mitotic phosphoprotein 90 mRNA, complete cds | 4e-011 | 2072296 | (U95098) mitotic phosphoprotein 44 [*Xenopus laevis*] | 3.60E+00 |
| 3137 | AL010234 | *Plasmodium falciparum* DNA *** SEQUENCING IN PROGRESS *** from contig 4–55, complete sequence | 0.37 | 1213606 | (X95910) ftsA [*Campylobacter jejuni*] | 4.2 |
| 3138 | U28153 | *Caenorhabditis elegans* UNC-76 (unc-76) gene, complete cds. | 0.39 | <NONE> | <NONE> | <NONE> |
| 3139 | U95102 | *Xenopus laevis* mitotic phosphoprotein 90 mRNA, complete cds | 8.00E-07 | <NONE> | <NONE> | <NONE> |
| 3140 | J05073 | Human phosphoglycerate mutase (PGAM-M) gene, complete cds. | 1.00E-13 | 281501 | phenylalanine--tRNA ligase (EC 6.1.1.20) beta chain-*Thermus aquaticus* | 7 |
| 3141 | M90656 | Human gamma-glutamylcysteine synthetase (GCS) mRNA, complete cds. | 0 | 1346190 | GLUTAMATE--CYSTEINE LIGASE CATALYTIC SUBUNIT (GAMMA-GLUTAMYLCYS-TEINE SYNTHETASE) glutamate--cysteine ligase (EC 6.3.2.2) heavy chain-human >gi\|183039 (M90656) gamma-glutamylcysteine synthetase [*Homo sapiens*] | 2.00E-71 |
| 3142 | U95098 | *Xenopus laevis* mitotic phosphoprotein 44 mRNA, partial cds | 8e-006 | 951325 | (U31517) nuclear receptor XR78E/F [*Drosophila melanogaster*] | 9.4 |
| 3143 | AF053551 | *Homo sapiens* metaxin 2 (MTX2) mRNA, nuclear gene encoding mitochondrial protein, complete cds | 0.00E+00 | 3283049 | (AF053551) metaxin 2 [*Homo sapiens*] | 1.00E-79 |
| 3144 | AF088034 | *Homo sapiens* full length insert cDNA clone | e-125 | 1353059 | HYPOTHETICAL 27.4 KD PROTEIN IN | 9e-023 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | ZC24F03 | | | MER2-BNA1 INTERGENIC REGION >gi\|1077874\|pir\|\|S 57042 hypothetical protein YJR024c-yeast (*Saccharomyces cerevisiae*) >gi\|1015663 (Z49524) ORF YJR024c gene product [*Saccharomyces cerevisiae*] | |
| 3145 | AF087973 | *Homo sapiens* full length insert cDNA clone YU79H10 | 1e-033 | <NONE> | <NONE> | <NONE> |
| 3146 | AF032456 | *Homo sapiens* ubiquitin conjugating enzyme G2 | 8.00E-07 | <NONE> | <NONE> | <NONE> |
| 3147 | Y12259 | *R.norvegicus* mRNA for Kir3.1 protein | 6e-058 | <NONE> | <NONE> | <NONE> |
| 3148 | U95102 | *Xenopus laevis* mitotic phosphoprotein 90 mRNA, complete cds | 2.00E-07 | <NONE> | <NONE> | <NONE> |
| 3149 | X97154 | *D.willistoni* mitochondrial 12S rRNA gene | 1.20E+00 | 3875246 | (Z81490) similar to WD domain, G-beta repeats (2 domains); cDNA EST EMBL:T00482 comes from this gene; cDNA EST EMBL:T00923 comes from this gene; cDNA EST yk449d4.3 comes from this gene; cDNA EST yk449d4.5 comes from this gen. . . | 7e-016 |
| 3150 | U17247 | *Saccharomyces cerevisiae* chromosome XII cosmid L2142 | 1.20E-01 | <NONE> | <NONE> | <NONE> |
| 3151 | U95094 | *Xenopus laevis* XL-INCENP (XL-INCENP) mRNA, complete cds | 2e-005 | 172012 | (M12087) thr-tRNA-synthetase [*Saccharomyces cerevisiae*] | 0.21 |
| 3152 | L78777 | *Homo sapiens* (subclone 2_b8 from P1 H49) DNA sequence | 1.30E-01 | <NONE> | <NONE> | <NONE> |
| 3153 | AF053551 | *Homo sapiens* metaxin 2 (MTX2) mRNA, nuclear gene encoding mitochondrial protein, complete cds | 0.00E+00 | 3283049 | (AF053551) metaxin 2 [*Homo sapiens*] | 1.00E-79 |
| 3154 | X53616 | *C.domesticus* calnexin (pp90) mRNA | 1.1 | <NONE> | <NONE> | <NONE> |
| 3155 | U95094 | *Xenopus laevis* XL-INCENP | 0.043 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | (XL-INCENP) mRNA, complete cds | | | | |
| 3156 | U95098 | Xenopus laevis mitotic phosphoprotein 44 mRNA, partial cds | 0.002 | 3327080 | (AB014533) KIAA0633 protein [Homo sapiens] | 4.2 |
| 3157 | U60337 | Homo sapiens beta-mannosidase mRNA, complete cds | 0 | 3024091 | BETA-MANNOSIDASE PRECURSOR beta-mannosidase [Homo sapiens] | 4e-068 |
| 3158 | U32790 | Haemophilus influenzae Rd section 105 of 163 of the complete genome | 1.1 | <NONE> | <NONE> | <NONE> |
| 3159 | U95094 | Xenopus laevis XL-INCENP (XL-INCENP) mRNA, complete cds | 0.12 | <NONE> | <NONE> | <NONE> |
| 3160 | U95102 | Xenopus laevis mitotic phosphoprotein 90 mRNA, complete cds | 7e-007 | 1351696 | HYPOTHETICAL 30.4 KD PROTEIN C3H1.13 IN CHROMOSOME I >gi|1103514 (Z68144) unknown | 1.5 |
| 3161 | U50535 | Human BRCA2 region, mRNA sequence CG006 | 4e-012 | 728831 | !!!! ALU SUBFAMILY J WARNING ENTRY | 4.5 |
| 3162 | U95102 | Xenopus laevis mitotic phosphoprotein 90 mRNA, complete cds | 3e-009 | 2132302 | hypothetical protein YPR144c-yeast similarity near C-terminus to RNA Polymerase beta subunit (Swiss Prot. accession number P11213) and CCAAT-binding transcription factor (PIR accession number A36368) [Saccharomyces cerevisiae] | 4e-022 |
| 3163 | <NONE> | <NONE> | <NONE> | <NONE> | <NONE> | <NONE> |
| 3164 | U95102 | Xenopus laevis mitotic phosphoprotein 90 mRNA, complete cds | 3e-008 | 3123086 | HYPOTHETICAL PROTEIN MJ1050 Methanococcus jannaschii >gi|1499895 (U67548) conserved hypothetical protein [Methanococcus jannaschii] | 1.3 |
| 3165 | U95098 | Xenopus laevis mitotic phosphoprotein 44 mRNA, partial cds | 0.005 | <NONE> | <NONE> | <NONE> |
| 3166 | U95098 | Xenopus laevis mitotic phosphoprotein 44 mRNA, partial cds | 0.005 | <NONE> | <NONE> | <NONE> |
| 3167 | U95098 | Xenopus laevis | 0.005 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mitotic phosphoprotein 44 mRNA, partial cds | | | | |
| 3168 | U95094 | Xenopus laevis XL-INCENP (XL-INCENP) mRNA, complete cds | 1e-011 | 833783 | (X14338) NADH:ubiquinone oxidoreductase (428 AA) [Bos taurus] | 0.17 |
| 3169 | M20918 | C.thummi piger haemoglobin (Hb) gene DNA, complete cds. | 0.12 | 2496813 | HYPOTHETICAL 59.9 KD PROTEIN B0304.5 IN CHROMOSOME II >gi\|1041884 (U39472) B0304.5 gene product [Caenorhabditis elegans] | 0.12 |
| 3170 | U95094 | Xenopus laevis XL-INCENP (XL-INCENP) mRNA, complete cds | 1e-011 | 100827 | NADH dehydrogenase (ubiquinone) (EC 1.6.5.3) chain 4-wheat mitochondrion | 4.1 |
| 3171 | U28153 | Caenorhabditis elegans UNC-76 (unc-76) gene, complete cds. | 0.38 | <NONE> | <NONE> | <NONE> |
| 3172 | AJ008065 | Chrysolina bankii 16S rRNA gene, mitotype B2 | 0.045 | <NONE> | <NONE> | <NONE> |
| 3173 | AB014591 | Homo sapiens mRNA for KIAA0691 protein, complete cds | 7e-057 | 3327196 | (AB014591) KIAA0691 protein [Homo sapiens] | 8e-007 |
| 3174 | U95102 | Xenopus laevis mitotic phosphoprotein 90 mRNA, complete cds | 2e-007 | 3184082 | (AL023781) N-terminal acetyltransferase 1 [Schizosaccharomyces pombe] | 1e-036 |
| 3175 | U95102 | Xenopus laevis mitotic phosphoprotein 90 mRNA, complete cds | 3e-009 | 3219914 | HYPOTHETICAL 16.8 KD PROTEIN C30D10.04 IN CHROMOSOME II >gi\|2276353\|gnl\|PID\|e330328 pombe] | 2e-011 |
| 3176 | U95094 | Xenopus laevis XL-INCENP (XL-INCENP) mRNA, complete cds | 0.002 | 133361 | DNA-DIRECTED RNA POLYMERASE III 128 KD POLYPEPTIDE (RNA POLYMERASE III SUBUNIT 2) 2.7.7.6) III second-largest chain-fruit fly polymerase III second-largest subunit [Drosophila melanogaster] | 4.3 |
| 3177 | U95098 | Xenopus laevis mitotic phosphoprotein 44 mRNA, partial cds | 2e-006 | 2429362 | (AF020261) proline rich protein [Santalum album] | 0.033 |
| 3178 | U95094 | Xenopus laevis XL-INCENP (XL-INCENP) | 7e-007 | 3641258 | (AF064554) ventral anterior homeobox- | 0.68 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3179 | AB018323 | mRNA, complete cds Homo sapiens mRNA for KIAA0780 protein, partial cds | 3e-041 | 3327168 | containing protein 1 [Mus musculus] (AB014577) KIAA0677 protein [Homo sapiens] | 2e-021 |
| 3180 | U95102 | Xenopus laevis mitotic phosphoprotein 90 mRNA, complete cds | 0.002 | <NONE> | <NONE> | <NONE> |
| 3181 | U95094 | Xenopus laevis XL-INCENP (XL-INCENP) mRNA, complete cds | 1e-011 | 3283350 | (AF062378) calmodulin-binding protein SHA1 [Mus musculus] | 5e-006 |
| 3182 | Z96207 | H.sapiens telomeric DNA sequence, clone 12PTEL049, read 12PTELOO049.seq | 8e-008 | <NONE> | <NONE> | <NONE> |
| 3183 | AB017026 | Mus musculus mRNA for oxysterol-binding protein, complete cds | 0 | 3882265 | (AB018315) KIAA0772 protein [Homo sapiens] | 2e-091 |
| 3184 | U95102 | Xenopus laevis mitotic phosphoprotein 90 mRNA, complete cds | 9e-009 | <NONE> | <NONE> | <NONE> |
| 3185 | X05283 | Drosophila melanogaster PKCG7 gene exons 7–14 for protein kinase C | 4.6 | <NONE> | <NONE> | <NONE> |
| 3186 | AF026069 | Homo sapiens phosphomevalonate kinase (HUMPMKI) gene, partial cds | 0.42 | <NONE> | <NONE> | <NONE> |
| 3187 | AF052573 | Homo sapiens DNA polymerase eta (POLH) mRNA, complete cds | 0 | 3510695 | (AF052573) DNA polymerase eta [Homo sapiens] | 4e-011 |
| 3188 | M80198 | Human FKBP-12 pseudogene, clone lambda-512, 5' flank and complete cds. | 5e-014 | 2315521 | (AF016452) similar to the beta transducin family | 4e-027 |
| 3189 | U95102 | Xenopus laevis mitotic phosphoprotein 90 mRNA, complete cds | 8e-008 | <NONE> | <NONE> | <NONE> |
| 3190 | AJ001296 | Notophthalmus viridescens mRNA for cytokeratin 8 | 0.38 | 1175412 | HYPOTHETICAL 24.2 KD PROTEIN C13A11.03 IN CHROMOSOME I >gi\|984224 (Z54096) unknown | 2e-020 |
| 3191 | Z60048 | H.sapiens CpG DNA, clone 187a9, reverse read cpg187a9.rt1a. | 4e-054 | 547662 | HEPATOCYTE NUCLEAR FACTOR 3-BETA HNF-3 beta-mouse >gi\|402191 (X74937) HNF-3beta [Mus musculus] | 1e-020 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3192 | U95760 | Drosophila melanogaster strawberry notch (sno) mRNA, complete cds | 3e-071 | 2078282 | (U95760) Sno [Drosophila melanogaster] | 3e-068 |
| 3193 | L09604 | Homo sapiens differentiation-dependent A4 protein mRNA, complete cds. | 2e-035 | <NONE> | <NONE> | <NONE> |
| 3194 | AF054994 | Homo sapiens clone 23832 mRNA sequence | 0.12 | <NONE> | <NONE> | <NONE> |
| 3195 | AF026069 | Homo sapiens phosphomevalonate kinase (HUMPMKI) gene, partial cds | 0.42 | <NONE> | <NONE> | <NONE> |
| 3196 | AF026069 | Homo sapiens phosphomevalonate kinase (HUMPMKI) gene, partial cds | 0.42 | <NONE> | <NONE> | <NONE> |
| 3197 | AB007918 | Homo sapiens mRNA for KIAA0449 protein, partial cds | 0.015 | 138240 | GLYCOPROTEIN E PRECURSOR I >gi\|59566\|gnl\|PID\|e312380 (X14112) virion glycoprotein E [human herpesvirus 1] >gi\|59882 (X02138) glycoprotein gE (Us8) [Human herpesvirus 1] >gi\|291496 (L00036) gE protein [Human herpesvirus 1] | 8.3 |
| 3198 | L07040 | pFNeo eukaryotic expression vector, complete sequence. | 1e-052 | 2072972 | (U93572) putative p150 [Homo sapiens] | 1e-019 |
| 3199 | U95098 | Xenopus laevis mitotic phosphoprotein 44 mRNA, partial cds | 0.002 | <NONE> | <NONE> | <NONE> |
| 3200 | M98502 | Mus musculus protein encoding twelve zinc finger proteins (pMLZ-4) mRNA, complete cds. | 5e-014 | <NONE> | <NONE> | <NONE> |
| 3201 | M95098 | Bos taurus lysozyme gene (cow 2), complete cds | 1.1 | 3882205 | (AB018285) KIAA0742 protein [Homo sapiens] | 2e-034 |
| 3202 | U49169 | Dictyostelium discoideum V-ATPase A subunit (vatA) mRNA, complete cds | 0.12 | 2126116 | cymH protein- Klebsiella oxytoca >gi\|854235 | 4.2 |
| 3203 | U95102 | Xenopus laevis mitotic phosphoprotein 90 mRNA, complete cds | 2e-006 | 2911548 | (Y15173) E2 protein [Human papillomavirus type 75] | 0.39 |
| 3204 | Z57610 | H.sapiens CpG DNA, clone 187a10, reverse read | 7e-090 | 417134 | HEPATOCYTE NUCLEAR FACTOR 3-BETA norvegicus] | 5e-019 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3205 | U95102 | cpg187a10.rt1a. *Xenopus laevis* mitotic phosphoprotein 90 mRNA, complete cds | 6e-006 | 4104093 | (AF031642) urea transporter UT4 [*Rattus norvegicus*] | 0.51 |
| 3206 | U95098 | *Xenopus laevis* mitotic phosphoprotein 44 mRNA, partial cds | 0.0002 | <NONE> | <NONE> | <NONE> |
| 3207 | <NONE> | <NONE> | <NONE> | <NONE> | <NONE> | <NONE> |
| 3208 | <NONE> | <NONE> | <NONE> | 2252814 | (AF006492) FOG [*Mus musculus*] | 3.4 |
| 3209 | AF035940 | *Homo sapiens* MAGOH mRNA, complete cds | e-131 | 2330011 | (AF007862) mm-Mago [*Mus musculus*] >gi\|2909828 (AF035939) similar to mago nashi [*Mus musculus*] >gi\|2909830 | 4e-044 |
| 3210 | U49169 | *Dictyostelium discoideum* V-ATPase A subunit (vatA) mRNA, complete cds | 0.12 | 1942101 | Porcine Ribonuclease Inhibitor Complexed With Ribonuclease A | 1.1 |
| 3211 | AF054994 | *Homo sapiens* clone 23832 mRNA sequence | 0.12 | <NONE> | <NONE> | <NONE> |
| 3212 | AF068627 | *Mus musculus* DNA cytosine-5 methyltransferase 3B2 (Dnmt3b) mRNA, alternatively spliced, complete cds | 0.0005 | 1869835 | (Z86099) protein kinase [human herpesvirus 2] | 0.86 |
| 3213 | X68553 | *C.elegans* repetitive DNA sequence | 0.41 | 854065 | (X83413) U88 [Human herpesvirus 6] | 7e-007 |
| 3214 | X68553 | *C.elegans* repetitive DNA sequence | 0.41 | 854065 | (X83413) U88 [Human herpesvirus 6] | 7e-007 |
| 3215 | U95098 | *Xenopus laevis* mitotic phosphoprotein 44 mRNA, partial cds | 6e-005 | <NONE> | <NONE> | <NONE> |
| 3216 | AF054994 | *Homo sapiens* clone 23832 mRNA sequence | 0.12 | <NONE> | <NONE> | <NONE> |
| 3217 | U95760 | *Drosophila melanogaster* strawberry notch (sno) mRNA, complete cds | 3e-071 | 2078282 | (U95760) Sno [*Drosophila melanogaster*] | 3e-068 |
| 3218 | X96400 | *P.tetraurelia* alpha-51D gene | 0.38 | <NONE> | <NONE> | <NONE> |
| 3219 | U95094 | *Xenopus laevis* XL-INCENP (XL-INCENP) mRNA, complete cds | 0.0002 | <NONE> | <NONE> | <NONE> |
| 3220 | AF067212 | *Caenorhabditis elegans* cosmid F37F2 | 0.005 | <NONE> | <NONE> | <NONE> |
| 3221 | Y08844 | *L.esculentum* PR1a2 gene | 1.1 | <NONE> | <NONE> | <NONE> |
| 3222 | Y08844 | *L.esculentum* PR1a2 gene | 1.1 | <NONE> | <NONE> | <NONE> |
| 3223 | U95094 | *Xenopus laevis* | 6.00E-05 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | XL-INCENP (XL-INCENP) mRNA, complete cds | | | | |
| 3224 | U08214 | *Rattus* sp. DNA binding protein (URE-B1) mRNA, complete cds. | 1.1 | 477513 | mesoderm development regulatory protein Sna-mouse >gi\|54121 (X67253) sna [*Mus musculus*] | 1.1 |
| 3225 | L19713 | Human dematin (HRD1) mRNA, complete cds. | 0.051 | <NONE> | <NONE> | <NONE> |
| 3226 | U95098 | *Xenopus laevis* mitotic phosphoprotein 44 mRNA, partial cds | 0.043 | 2645389 | (U83858) NADH dehydrogenase subunit 4 [*Onychomys leucogaster*] | 7.5 |
| 3227 | U95102 | *Xenopus laevis* mitotic phosphoprotein 90 mRNA, complete cds | 5.00E-03 | 2662477 | (AF034804) LACK [*Leishmania major*] | 3e-011 |
| 3228 | U95094 | *Xenopus laevis* XL-INCENP (XL-INCENP) mRNA, complete cds | 0.0002 | <NONE> | <NONE> | <NONE> |
| 3229 | U95102 | *Xenopus laevis* mitotic phosphoprotein 90 mRNA, complete cds | 4e-012 | 2072296 | (U95098) mitotic phosphoprotein 44 [*Xenopus laevis*] | 6.20E+00 |
| 3230 | U95098 | *Xenopus laevis* mitotic phosphoprotein 44 mRNA, partial cds | 0.0005 | <NONE> | <NONE> | <NONE> |
| 3231 | U95098 | *Xenopus laevis* mitotic phosphoprotein 44 mRNA, partial cds | 0.0005 | <NONE> | <NONE> | <NONE> |
| 3232 | AF036685 | *Caenorhabditis elegans* cosmid C05B10 | 0.38 | <NONE> | <NONE> | <NONE> |
| 3233 | <NONE> | <NONE> | <NONE> | <NONE> | <NONE> | <NONE> |
| 3234 | AL010153 | *Plasmodium falciparum* DNA *** SEQUENCING IN PROGRESS *** from contig 3–80, complete sequence | 6e-005 | <NONE> | <NONE> | <NONE> |
| 3235 | U95098 | *Xenopus laevis* mitotic phosphoprotein 44 mRNA, partial cds | 5.00E-04 | <NONE> | <NONE> | <NONE> |
| 3236 | U28153 | *Caenorhabditis elegans* UNC-76 (unc-76) gene, complete cds. | 0.39 | <NONE> | <NONE> | <NONE> |
| 3237 | U95094 | *Xenopus laevis* XL-INCENP (XL-INCENP) mRNA, complete cds | 1e-009 | <NONE> | <NONE> | <NONE> |
| 3238 | U95094 | *Xenopus laevis* XL-INCENP (XL-INCENP) mRNA, complete | 1e-009 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3239 | X65319 | Cloning vector pCAT-Enhancer cds | 5.00E-77 | 987050 | (X65335) lacZ gene product [unidentified cloning vector] | 3e-015 |
| 3240 | AG000140 | Homo sapiens genomic DNA, 21q region, clone: T171X2 | 1.60E-01 | 2494505 | HEPATOCYTE NUCLEAR FACTOR 3 FORKHEAD HOMOLOG 4 (HFH-4) >gi|2137385|pir||I49734 HNF-3/fork-head homolog-4-mouse >gi|550488 (L13204) HNF-3/fork-head homolog-4 [Mus musculus] | 7.5 |
| 3241 | L77886 | Human protein tyrosine phosphatase mRNA, complete cds | 1.00E-21 | 139560 | SATELLITE RNA 48 KD PROTEIN | 5.9 |
| 3242 | U95094 | Xenopus laevis XL-INCENP (XL-INCENP) mRNA, complete cds | 8e-008 | 3879988 | (Z68318) T21B10.4 [Caenorhabditis elegans] | 7.9 |
| 3243 | U95094 | Xenopus laevis XL-INCENP (XL-INCENP) mRNA, complete cds | 7e-007 | 3184286 | (AC004136) hypothetical protein [Arabidopsis thaliana] | 7.7 |
| 3244 | U95098 | Xenopus laevis mitotic phosphoprotein 44 mRNA, partial cds | 5.00E-04 | <NONE> | <NONE> | <NONE> |
| 3245 | U95098 | Xenopus laevis mitotic phosphoprotein 44 mRNA, partial cds | 0.005 | <NONE> | <NONE> | <NONE> |
| 3246 | U95098 | Xenopus laevis mitotic phosphoprotein 44 mRNA, partial cds | 0.005 | <NONE> | <NONE> | <NONE> |
| 3247 | U95098 | Xenopus laevis mitotic phosphoprotein 44 mRNA, partial cds | 2.00E-05 | 1050849 | (X83742) MAP kinase phosphatase [Xenopus laevis] | 4.5 |
| 3248 | AF084186 | Rattus norvegicus alpha-fodrin (A2A) mRNA, complete cds | 0.39 | 3123155 | HYPOTHETICAL 49.0 KD TRP-ASP REPEATS CONTAINING PROTEIN F55F8.5 IN CHROMOSOME 1 family [Caenorhabditis elegans] | 5.00E-29 |
| 3249 | U95094 | Xenopus laevis XL-INCENP (XL-INCENP) mRNA, complete cds | 5.00E-04 | 3293508 | (AF069188) NADH dehydrogenase 1 [Ephedrus laevicollis] | 0.3 |
| 3250 | U95094 | Xenopus laevis XL-INCENP (XL-INCENP) mRNA, complele cds | 3e-009 | 3243110 | (AF034976) unknown [Pilayella littoralis] | 4.6 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3251 | M77812 | Rabbit myosin heavy chain mRNA, complete cds. | 0.58 | 3876408 | (Z81069) Similarity to Yeast hypothetical 65.2 KD protein (SW:P36076); cDNA EST yk393e9.3 comes from this gene; cDNA EST yk393e9.5 comes from this gene [*Caenorhabditis elegans*] | 3.1 |
| 3252 | U95102 | *Xenopus laevis* mitotic phosphoprotein 90 mRNA, complete cds | 0.0002 | <NONE> | <NONE> | <NONE> |
| 3253 | U95094 | *Xenopus laevis* XL-INCENP (XL-INCENP) mRNA, complete cds | 7e-007 | 1351841 | ISOCITRATE LYASE (ISOCITRASE) lyase [*Lycopersicon esculentum*] | 6.00E+00 |
| 3254 | Z50144 | *R.norvegicus* mRNA for kynurenine/alpha-aminoadipate aminotransferase | 2.00E-76 | 1050752 | (Z50144) kynurenine/alpha-aminoadipate aminotransferase | 6e-033 |
| 3255 | Z50144 | *R.norvegicus* mRNA for kynurenine/alpha-aminoadipate aminotransferase | 2.00E-76 | 1050752 | (Z50144) kynurenine/alpha-aminoadipate aminotransferase | 6e-033 |
| 3256 | U95102 | *Xenopus laevis* mitotic phosphoprotein 90 mRNA, complete cds | 0.043 | 109340 | pepsin (EC 3.4.23.-) II-2/3 precursor-rabbit | 4.5 |
| 3257 | U95102 | *Xenopus laevis* mitotic phosphoprotein 90 mRNA, complete cds | 3e-007 | 3875769 | (Z35662) similar to Approximately 25 cadherin-repeats, 3 EGF domains and one Laminin G domain; cDNA EST EMBL:D27303 comes from this gene; cDNA EST EMBL:D27305 comes from this gene; cDNA EST EMBL:D27304 comes from this gene; . . . >gi\|3876224\|gnl\|PID\|e134589 | 4.20E-01 |
| 3258 | AF041059 | *Homo sapiens* WSCR4 gene, exon 7 and partial cds | 5.90E-02 | <NONE> | <NONE> | <NONE> |
| 3259 | AF054994 | *Homo sapiens* clone 23832 mRNA sequence | 0.13 | <NONE> | <NONE> | <NONE> |
| 3260 | U87266 | *Arabidopsis thaliana* 2,3-oxidosqualene-triterpenoid cyclase mRNA, complete cds | 5.60E-01 | 1175412 | HYPOTHETICAL 24.2 KD PROTEIN C13A11.03 IN CHROMOSOME 1 >gi\|984224 (Z54096) unknown | 2e-009 |
| 3261 | AL010240 | *Plasmodium* | 1.3 | 3882205 | (AB018285) | 5.00E-10 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | *falciparum* DNA *** SEQUENCING IN PROGRESS *** from contig 4–64, complete sequence | | | KIAA0742 protein [*Homo sapiens*] | |
| 3262 | L20566 | *Aspergillus niger* acid phosptase complete cds. | 3.9 | 3777583 | (AF084481) transmembrane protein [*Homo sapiens*] | 5.00E+00 |
| 3263 | U12202 | Human ribosomal protein S24 (rps24) gene, complete cds | 3.80E+00 | <NONE> | <NONE> | <NONE> |
| 3264 | U70139 | *Mus musculus* putative CCR4 protein mRNA, partial cds | 0 | 2251234 | (U70139) putative CCR4 protein [*Mus musculus*] | 6e-093 |
| 3265 | AF055666 | *Mus musculus* kinesin light chain 2 (Klc2) mRNA, complete cds | 0.53 | 3387889 | (AF070532) emb-5 [*Homo sapiens*] | 0.56 |
| 3266 | AF077618 | *Homo sapiens* p73 gene, exon 3 | 0.4 | 127709 | MYOBLAST DETERMINATION PROTEIN 1 | 7.8 |
| 3267 | AF072250 | *Homo sapiens* methyl-CpG binding protein MBD4 | e-161 | 3800809 | (AF072250) methyl-CpG binding protein MBD4 [*Homo sapiens*] | 2.00E-47 |
| 3268 | U95098 | *Xenopus laevis* mitotic phosphoprotein 44 mRNA, partial cds | 8e-009 | 886048 | (U25686) E93 [*Drosophila melanogaster*] | 1.8 |
| 3269 | AG001313 | *Homo sapiens* genomic DNA, 21q region, clone: 125H6N26 | 0.0005 | <NONE> | <NONE> | <NONE> |
| 3270 | U25846 | *Homarus americanus* clone LOB5 farnesoic acid o-methyltransferase mRNA, complete cds. | 1.40E-02 | <NONE> | <NONE> | <NONE> |
| 3271 | AF068627 | *Mus musculus* DNA cytosine-5 methyltransferase 3B2 (Dnmt3b) mRNA, alternatively spliced, complete cds | 0.0005 | 1698496 | (U53444) LW-amid and MW-amid-containing preprohormone | 4.40E+00 |
| 3272 | U60022 | *Mus musculus* antigen processing-associated transporter TAP1-k mRNA, complete cds | 3.50E+00 | 2498941 | SPLICEOSOME ASSOCIATED PROTEIN 62 spliceosome-associated protein SAP 62-human >gi\|409219 | 0.23 |
| 3273 | U95102 | *Xenopus laevis* mitotic phosphoprotein 90 mRNA, complete cds | 7e-005 | <NONE> | <NONE> | <NONE> |
| 3274 | U24676 | *Drosophila melanogaster* twinstar (tsr) gene, complete cds | 1.20E+00 | <NONE> | <NONE> | <NONE> |
| 3275 | U95098 | *Xenopus laevis* | 1.50E-02 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mitotic phosphoprotein 44 mRNA, partial cds | | | | |
| 3276 | AF054994 | Homo sapiens clone 23832 mRNA sequence | 0.13 | <NONE> | <NONE> | <NONE> |
| 3277 | AF072250 | Homo sapiens methyl-CpG binding protein MBD4 | e-161 | 3800809 | (AF072250) methyl-CpG binding protein MBD4 [Homo sapiens] | 2.00E-47 |
| 3278 | AF054994 | Homo sapiens clone 23832 mRNA sequence | 0.13 | <NONE> | <NONE> | <NONE> |
| 3279 | AF054994 | Homo sapiens clone 23832 mRNA sequence | 0.13 | <NONE> | <NONE> | <NONE> |
| 3280 | AF054994 | Homo sapiens clone 23832 mRNA sequence | 0.13 | <NONE> | <NONE> | <NONE> |
| 3281 | AF054994 | Homo sapiens clone 23832 mRNA sequence | 0.13 | <NONE> | <NONE> | <NONE> |
| 3282 | U95098 | Xenopus laevis mitotic phosphoprotein 44 mRNA, partial cds | 2e-005 | <NONE> | <NONE> | <NONE> |
| 3283 | U20281 | Gallus gallus clone pNG13 cell division cycle control protein 37 (cdc37) mRNA, complete cds. | 0.017 | 2642625 | (AF032118) intersectin [Xenopus laevis] | 1.40E+00 |
| 3284 | X65279 | pWE15 cosmid vector DNA | 2e-059 | 987050 | (X65335) lacZ gene product [unidentified cloning vector] | 3e-015 |
| 3285 | U95094 | Xenopus laevis XL-INCENP (XL-INCENP) mRNA, complete cds | 4e-012 | <NONE> | <NONE> | <NONE> |
| 3286 | D80005 | Human mRNA for KIAA0183 gene, partial cds | 0 | <NONE> | <NONE> | <NONE> |
| 3287 | U27341 | Bos taurus endothelin converting enzyme-2 Sequence 1 from U.S. Pat. No. 5736376 | 1e-096 | 2136744 | endothelin converting enzyme-2-bovine | 2e-047 |
| 3288 | M58417 | Drosophila melanogaster laminin B2 gene, complete cds. | 0.35 | 1142698 | (U26463) NADPH-dependent aldehyde reductase | 6.8 |
| 3289 | M58417 | Drosophila melanogaster laminin B2 gene, complete cds. | 0.35 | 1142698 | (U26463) NADPH-dependent aldehyde reductase | 6.8 |
| 3290 | AF020043 | Homo sapiens chromosome-associated polypeptide | 0 | 1785540 | (U82626) basement membrane-associated chondroitin proteoglycan Bamacan [Rattus norvegicus] | e-112 |
| 3291 | U57368 | Mus musculus EGF repeat transmembrane protein mRNA, | 0 | 1336628 | (U57368) EGF repeat transmembrane protein [Mus |  |

TABLE 2-continued

| SEQ | Nearest Neighbor (BlastN vs. Genbank | | | Nearest Neighbor (BlastX vs. Non-Redundant Proteins) | | |
|---|---|---|---|---|---|---|
| ID | ACCESSION | DESCRIPTION | P VALUE | ACCESSION | DESCRIPTION | P VALUE |
| | | complete cds. | | | *musculus*] | |
| 3292 | AB018323 | *Homo sapiens* mRNA for KIAA0780 protein, partial cds | 3e-041 | 3327168 | (AB014577) KIAA0677 protein [*Homo sapiens*] | 1e-021 |
| 3293 | X65279 | pWE15 cosmid vector DNA | 2e-059 | 987050 | (X65335) lacZ gene product [unidentified cloning vector] | 3e-015 |
| 3294 | X71642 | *M.musculus* GEG-154 mRNA | 3e-092 | <NONE> | <NONE> | <NONE> |
| 3295 | U95094 | *Xenopus laevis* XL-INCENP (XL-INCENP) mRNA, complete cds | 1e-009 | 3879362 | (Z81113) similar to DnaJ, prokaryotic heat shock protein, Zinc finger, C2H2 type; cDNA EST yk290e12.5 comes from this gene; cDNA EST yk290e12.3 comes from this gene; cDNA EST yk447h4.5 comes from this gene; cDNA EST yk474e4. . . | 3e-005 |
| 3296 | AB017026 | *Mus musculus* mRNA for oxysterol-binding protein, complete cds | 0 | 3551523 | (AB017026) oxysterol-binding protein | e-103 |
| 3297 | U43431 | Human DNA topoisomerase III mRNA, complete cds. | 0 | 2501242 | DNA TOPOISOMERASE III >gi\|1292912 | 6e-069 |
| 3298 | M35296 | Human tyrosine kinase arg gene mRNA. | 1.1 | 2135080 | epithelial microtubule-associated protein, 115K-human >gi\|414115 (X73882) microtubule associated protein [*Homo sapiens*] | 1.8 |
| 3299 | D50646 | Mouse mRNA for SDF2, complete cds | 1e-031 | 2136205 | stromal cell-derived factor 2-human *sapiens*] | 4e-014 |
| 3300 | L34732 | *Homo sapiens* T-cell receptor beta (TCRB) mRNA | 0.35 | 3875664 | (Z83104) predicted using Genefinder | 3e-005 |
| 3301 | AF030558 | *Rattus norvegicus* phosphatidylinositol 5-phosphate 4-kinase gamma mRNA, complete cds | 1e-013 | <NONE> | <NONE> | <NONE> |
| 3302 | X03100 | Human HLA-SB(DP) alpha gene | 2e-018 | <NONE> | <NONE> | <NONE> |
| 3303 | U95094 | *Xenopus laevis* XL-INCENP (XL-INCENP) mRNA, complete cds | 2e-006 | 2950243 | (Z98204) extensin [*Hordeum vulgare*] | 2e-005 |
| 3304 | Y13631 | *Clostridium botulinum* P-21, P-47 ntnh, bonT genes | 1 | <NONE> | <NONE> | <NONE> |
| 3305 | Y13631 | *Clostridium botulinum* P-21, P-47 ntnh, bonT genes | 1 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3306 | U95102 | *Xenopus laevis* mitotic phosphoprotein 90 mRNA, complete cds | 3e-011 | 1655830 | (U59446) myrosinase-binding protein related protein | 0.01 |
| 3307 | X17538 | *Butyrivibrio fibrisolvens* end1 gene for endoglucanase | 0.12 | 1001811 | (D64005) hypothetical protein | 5.2 |
| 3308 | D42053 | Human mRNA for KIAA0091 gene, complete cds | 0 | 577309 | (D42053) KIAA0091 gene product is related to subtilisin. [*Homo sapiens*] | e-127 |
| 3309 | L81800 | *Homo sapiens* (subclone 2_g9 from P1 H31) DNA sequence | 2e-006 | <NONE> | <NONE> | <NONE> |
| 3310 | L81800 | *Homo sapiens* (subclone 2_g9 from P1 H31) DNA sequence | 2e-006 | <NONE> | <NONE> | <NONE> |
| 3311 | K01641 | Mouse Ig kappa active V-region from 70Z/3 cells. | 3.1 | <NONE> | <NONE> | <NONE> |
| 3312 | K01641 | Mouse Ig kappa active V-region from 70Z/3 cells. | 3.1 | <NONE> | <NONE> | <NONE> |
| 3313 | U09954 | Human ribosomal protein L9 gene, 5' region and complete cds. | e-114 | 2136121 | ribosomal protein L9-human >gi|607793 | 3e-027 |
| 3314 | M19735 | *Homo sapiens* beta-hexosaminidase beta chain mRNA, complete cds. | 0 | 179462 | (M13519) N-acetyl-beta-glucosaminidase prepro-polypeptide | 4e-075 |
| 3315 | M31760 | Human chromosome 9 t(9;22) breakpoint DNA. | 2e-016 | 2981631 | (AB012223) ORF2 [*Canis familiaris*] | 0.018 |
| 3316 | U95094 | *Xenopus laevis* XL-INCENP (XL-INCENP) mRNA, complete cds | 4e-013 | 495696 | (U00067) *C. elegans* PAR-3 cell polarity protein | 2.5 |
| 3317 | U61084 | Human phorbolin 3 mRNA, complete cds | 0 | 4097433 | (U61084) phorbolin 3 [*Homo sapiens*] | 7e-099 |
| 3318 | X95161 | *H.sapiens* brca2 gene exon 11 > :: emb|A62786|A62 786 Sequence 27 from Patent WO9719110 | 5e-024 | 244126 | uroporphyrinogen III synthase, UROIIIS [human, Peptide Mutant, 265 aa] | 0.12 |
| 3319 | U95094 | *Xenopus laevis* XL-INCENP (XL-INCENP) mRNA, complete cds | 2e-013 | 2072296 | (U95098) mitotic phosphoprotein 44 [*Xenopus laevis*] | 3.9 |
| 3320 | U95102 | *Xenopus laevis* mitotic phosphoprotein 90 mRNA, complete cds | 8e-008 | 2143490 | LGL-1-mouse >gi|1041889|bbs|1 69033 267 aa] [*Mus* sp.] | 7.2 |
| 3321 | U76112 | *Mus musculus* translation repressor NAT1 mRNA, complete cds | 1e-013 | 729818 | EUKARYOTIC INITIATION FACTOR 4F SUBUNIT P130 (EIF-4F) (MRNA CAP-BINDING PROTEIN COMPLEX | 1.9 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | SUBUNIT P130) >gi\|539297\|pir\|\|B4 8086 translation initiation factor eIF-4F TIF4632-yeast (*Saccharomyces cerevisiae*) >gi\|295677 (L16924) p130 [*Saccharomyces cerevisiae* | |
| 3322 | U95094 | *Xenopus laevis* XL-INCENP (XL-INCENP) mRNA, complete cds | 3e-009 | 2072296 | (U95098) mitotic phosphoprotein 44 [*Xenopus laevis*] | 5.2 |
| 3323 | U95094 | *Xenopus laevis* XL-INCENP (XL-INCENP) mRNA, complete cds | 4e-013 | 495696 | (U00067) *C. elegans* PAR-3 cell polarity protein | 2.5 |
| 3324 | U43626 | Human chromosome 15q11-q13 putative DNA replication origin in the g-aminobutyric acid receptor b3 and a5 gene cluster | 2e-018 | 2197085 | (AF003535) ORF2-like protein [*Homo sapiens*] | 0.0002 |
| 3325 | U95102 | *Xenopus laevis* mitotic phosphoprotein 90 mRNA, complete cds | 2e-010 | <NONE> | <NONE> | <NONE> |
| 3326 | Z48561 | *E.coli* perA, perB, perC and perD genes | 0.38 | 2576325 | (Y12239) env [porcine endogenous retrovirus] | 7.4 |
| 3327 | Z48561 | *E.coli* perA, perB, perC and perD genes | 0.38 | 2576325 | (Y12239) env [porcine endogenous retrovirus] | 7.4 |
| 3328 | U95102 | *Xenopus laevis* mitotic phosphoprotein 90 mRNA, complete cds | 0.002 | 2576325 | (Y12239) env [porcine endogenous retrovirus] | 7.4 |
| 3329 | U95102 | *Xenopus laevis* mitotic phosphoprotein 90 mRNA, complete cds | 0.002 | 2576325 | (Y12239) env [porcine endogenous retrovirus] | 7.4 |
| 3330 | U95098 | *Xenopus laevis* mitotic phosphoprotein 44 mRNA, partial cds | 1e-010 | 1362915 | protein-tyrosine kinase (EC 2.7.1.112) STK-1 precursor-human | 0.5 |
| 3331 | X65319 | Cloning vector pCAT-Enhancer | 3e-081 | 987050 | (X65335) lacZ gene product [unidentified cloning vector] | 3e-015 |
| 3332 | AB018304 | *Homo sapiens* mRNA for KIAA0761 protein, partial cds | 0 | 3882243 | (AB018304) KIAA076 1 protein [*Homo sapiens*] | 8e-098 |
| 3333 | Y08460 | *Mus musculus* mRNA for Mdes transmembrane protein | 1e-085 | 2225941 | (Y08460) Mdes protein [*Mus musculus*] | 8e-071 |
| 3334 | U95102 | *Xenopus laevis* mitotic | 8e-009 | 2072296 | (U95098) mitotic phosphoprotein 44 | 5.1 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | phosphoprotein 90 mRNA, complete cds | | | [Xenopus laevis] | |
| 3335 | <NONE> | <NONE> | <NONE> | <NONE> | <NONE> | <NONE> |
| 3336 | U95102 | Xenopus laevis mitotic phosphoprotein 90 mRNA, complete cds | 2e-007 | 2687928 | (AE001118) P115 protein [Borrelia burgdorferi] | 5.2 |
| 3337 | U94831 | Homo sapiens multispanning membrane protein mRNA, complete cds | 0 | 2276460 | (U94831) multispanning membrane protein [Homo sapiens] | 5e-087 |
| 3338 | U14972 | Human ribosomal protein S10 mRNA, complete cds. | 2e-059 | 133715 | 40S RIBOSOMAL PROTEIN S10 | 0.0002 |
| 3339 | K01254 | Human gastrin gene, complete cds. | 5e-005 | <NONE> | <NONE> | <NONE> |
| 3340 | U08469 | Glycine max 3-methylcrotonyl-CoA carboxylase mRNA, biotin-carrier domain, partial cds. | 3e-051 | 3876562 | (Z81074) Similarity to Soybean 3-methylcrotonyl-CoA carboxylase (TR:Q42777); cDNA EST EMBL:M75819 comes from this gene; cDNA EST EMBL:M89099 comes from this gene; cDNA EST EMBL:D32737 comes from this gene; cDNA EST EMBL:D327... | 1e-073 |
| 3341 | AB011139 | Homo sapiens mRNA for KIAA0567 protein, partial cds | 0 | 3043658 | (AB011139) KIAA0567 protein [Homo sapiens] | e-123 |
| 3342 | U07615 | Rattus norvegicus mucin mRNA, partial cds. | 2e-006 | 2506877 | MUCIN 2 PRECURSOR (INTESTINAL MUCIN 2) >gi\|454154 (L21998) mucin [Homo sapiens] | 0.0007 |
| 3343 | AF061749 | Homo sapiens tumorous imaginal discs protein Tid56 homolog (T1D1) mRNA, complete cds | e-154 | 3372677 | (AF061749) tumorous imaginal discs protein Tid56 homolog | 4e-060 |
| 3344 | U95098 | Xenopus laevis mitotic phosphoprotein 44 mRNA, partial cds | 0.001 | 2984587 | (AC004472) P1.11659_3 [Homo sapiens] | 3e-008 |
| 3345 | U45998 | Onchocerca volvulus MRS3/MRS4 class mitochondrial solute carrier mRNA, complete cds | 2e-008 | 3880433 | (Z66521) similar to mitochondrial RNA splicing MSR4 like protein; cDNA EST EMBL:C09217 comes from this gene [Caenorhabditis elegans] | 2e-051 |
| 3346 | U43626 | Human | 2e-018 | 2197085 | (AF003535) | 0.0002 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | chromosome 15q11-q13 putative DNA replication origin in the g-aminobutyric acid receptor b3 and a5 gene cluster | | | ORF2-like protein [Homo sapiens] | |
| 3347 | U95094 | Xenopus laevis XL-INCENP (XL-INCENP) mRNA, complete cds | 3e-009 | 2072296 | (U95098) mitotic phosphoprotein 44 [Xenopus laevis] | 5.2 |
| 3348 | U14972 | Human ribosomal protein S10 mRNA, complete cds. | 2e-059 | 133715 | 40S RIBOSOMAL PROTEIN S10 | 0.0002 |
| 3349 | M80198 | Human FKBP-12 pseudogene, clone lambda-512, 5' flank and complete cds. | 1.00E-10 | 2315521 | (AF016452) similar to the beta transducin family | 1e-022 |
| 3350 | AB011180 | Homo sapiens mRNA for KIAA0608 protein, partial cds | 5e-077 | 3043740 | (AB011180) KIAA0608 protein [Homo sapiens] | 8e-071 |
| 3351 | U45858 | Zea mays glyceraldehyde-3-phosphate dehydrogenase | 4.2 | <NONE> | <NONE> | <NONE> |
| 3352 | U45858 | Zea mays glyceraldehyde-3-phosphate dehydrogenase | 4.2 | <NONE> | <NONE> | <NONE> |
| 3353 | AF035940 | Homo sapiens MAGOH mRNA, complete cds | e-141 | 2330011 | (AF007862) mm-Mago [Mus musculus] >gi\|2909828 (AF035939) similar to mago nashi [Mus musculus] >gi\|2909830 | 1e-075 |
| 3354 | AF035940 | Homo sapiens MAGOH mRNA, complete cds | e-141 | 2330011 | (AF007862) mm-Mago [Mus musculus] >gi\|2909828 (AF035939) similar to mago nashi [Mus musculus] >gi\|2909830 | 1e-075 |
| 3355 | M24486 | Human prolyl 4-hydroxylase alpha subunit mRNA, complete cds, clone PA-11. | e-147 | 3876769 | (Z69637) Similarity to Human Prolyl 4-hydroxylase alpha subunit (SW:P4HA_HUMAN); cDNA EST yk219g12.5 comes from this gene; cDNA EST yk319d8.5 comes from this gene; cDNA EST yk339d11.5 comes from this gene; cDNA EST yk371c9.3. . . | 4e-012 |
| 3356 | Z50144 | R.norvegicus mRNA for kynurenine/alpha-aminoadipate | 3.00E-93 | 1050752 | (Z50144) kynurenine/alpha-aminoadipate aminotransferase | 2e-043 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3357 | M24486 | aminotransferase Human prolyl 4-hydroxylase alpha subunit mRNA, complete cds, clone PA-11. | e-147 | 3876769 | (Z69637) Similarity to Human Prolyl 4-hydroxylase alpha subunit (SW:P4HA_HUMAN); cDNA EST yk219g12.5 comes from this gene; cDNA EST yk319d8.5 comes from this gene; cDNA EST yk339d11.5 comes from this gene; cDNA EST yk371c9.3... | 4e-012 |
| 3358 | U83981 | *Homo sapiens* apoptosis associated protein (GADD34) mRNA, complete cds | 0 | 3258618 | (U83981) apoptosis associated protein [*Homo sapiens*] | 8.00E-24 |
| 3359 | U30817 | *Bos taurus* very-long-chain acyl-CoA dehydrogenase mRNA, nuclear gene encoding mitochondrial protein, complete cds. | 1e-010 | 2765125 | (Y11770) very-long-chain acyl-CoA dehydrogenase [*Mus musculus*] | 4e-013 |
| 3360 | Z35094 | *H.sapiens* mRNA for SURF-2 | 5e-097 | 2498974 | SURFEIT LOCUS PROTEIN 2 | 4e-046 |
| 3361 | Z35094 | *H.sapiens* mRNA for SURF-2 | 5e-097 | 2498974 | SURFEIT LOCUS PROTEIN 2 | 4e-046 |
| 3362 | Z35094 | *H.sapiens* mRNA for SURF-2 | 5e-097 | 2498974 | SURFEIT LOCUS PROTEIN 2 | 4e-046 |
| 3363 | Z63829 | *H.sapiens* CpG DNA, clone 90 h2, forward read cpg90h2.ft1a | 5e-022 | 1050411 | (L43146) nuclear factor I-B1 [*Xenopus laevis*] | 5.4 |
| 3364 | AF052573 | *Homo sapiens* DNA polymerase eta (POLH) mRNA, complete cds | 0 | 3510695 | (AF052573) DNA polymerase eta [*Homo sapiens*] | 4e-011 |
| 3365 | AF092564 | *Homo sapiens* chromosome-associated protein-C | 0 | 3851586 | (AF092564) chromosome-associated protein-C [*Homo sapiens*] | 6e-052 |
| 3366 | AF031924 | *Homo sapiens* homeobox transcription factor barx2 | 2.00E-90 | <NONE> | <NONE> | <NONE> |
| 3367 | U95102 | *Xenopus laevis* mitotic phosphoprotein 90 mRNA, complete cds | 4e-011 | 419712 | probable transposase (insertion sequence IS1138)-Mycoplasma pulmonis (SGC3) | 2.6 |
| 3368 | U95102 | *Xenopus laevis* mitotic phosphoprotein 90 mRNA, complete cds | 4e-011 | 419712 | probable transposase (insertion sequence IS1138)-Mycoplasma pulmonis (SGC3) | 2.6 |
| 3369 | M24487 | Human prolyl 4-hydroxylase alpha subunit mRNA, complete cds, clone PA-15. | e-125 | 2507090 | PROLYL 4-HYDROXYLASE ALPHA SUBUNIT PRECURSOR >gi|66338|pir||DA | 1e-007 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3370 | M24487 | Human prolyl 4-hydroxylase alpha subunit mRNA, complete cds, clone PA-15. | e-125 | 2507090 | PROLYL 4-HYDROXYLASE ALPHA SUBUNIT PRECURSOR >gi\|66338\|pir\|\|DA HUA2 procollagen-proline dioxygenase (EC 1.14.11.2) alpha chain precursor, splice form 2-human >gi\|602675 (U14620) alpha-subunit of prolyl 4-hydroxylase [*Homo sapiens*] | 1e-007 |
| 3371 | U45858 | *Zea mays* glyceraldehyde-3-phosphate dehydrogenase | 4.2 | <NONE> | <NONE> | <NONE> |
| 3372 | U95102 | *Xenopus laevis* mitotic phosphoprotein 90 mRNA, complete cds | 7e-006 | <NONE> | <NONE> | <NONE> |
| 3373 | D50930 | Human mRNA for KIAA0140 gene, complete cds | 2e-046 | <NONE> | <NONE> | <NONE> |
| 3374 | X06461 | *Herpes simplex* virus type I immediate early (IE) gene 3 for transcriptional activator IE175 (=ICP 4) | 3.00E-04 | 2924449 | (AL022022) PE_PGRS [*Mycobacterium tuberculosis*] | 4.00E-05 |
| 3375 | X06461 | *Herpes simplex* virus type I immediate early (IE) gene 3 for transcriptional activator IE175 (=ICP 4) | 3.00E-04 | 2924449 | (AL022022) PE_PGRS [*Mycobacterium tuberculosis*] | 4.00E-05 |
| 3376 | X85753 | *Homo sapiens* mRNA for CDK8 protein kinase > :: emb\|A61243\|A61 243 Sequence 1 from Patent WO9709432 | 7e-059 | <NONE> | <NONE> | <NONE> |
| 3377 | X76192 | *Mycoplasma sp.* munIM, munIC and munIR genes. | 1.2 | <NONE> | <NONE> | <NONE> |
| 3378 | U95102 | *Xenopus laevis* mitotic phosphoprotein 90 mRNA, complete cds | 0.0002 | <NONE> | <NONE> | <NONE> |
| 3379 | M24486 | Human prolyl 4-hydroxylase | e-147 | 3876769 | (Z69637) Similarity to | 4e-012 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | alpha subunit mRNA, complete cds, clone PA-11. | | | Human Prolyl 4-hydroxylase alpha subunit (SW:P4HA_HUMAN); cDNA EST yk219g12.5 comes from this gene; cDNA EST yk319d8.5 comes from this gene; cDNA EST yk339d11.5 comes from this gene; cDNA EST yk371c9.3... | |
| 3380 | U95102 | Xenopus laevis mitotic phosphoprotein 90 mRNA, complete cds | 7e-006 | <NONE> | <NONE> | <NONE> |
| 3381 | U95094 | Xenopus laevis XL-INCENP (XL-INCENP) mRNA, complete cds | 1e-010 | 2119163 | collagen alpha 1(III) chain precursor-mouse | 0.005 |
| 3382 | AB009357 | Homo sapiens mRNA for TGF-beta activated kinase 1b, complete cds | 0 | 1167506 | (D76446) TAK1 (TGF-beta-activated kinase) [Mus musculus] | 2e-033 |
| 3383 | D38112 | Human mitochondrial DNA, complete sequence | 5e-052 | 14016 | (X55654) cytochrome C oxidase II subunit [Homo sapiens] | 1e-014 |
| 3384 | Z96177 | H.sapiens telomeric DNA sequence, clone 10QTEL040, read 10QTELOO040.seq | 7e-038 | 987050 | (X65335) lacZ gene product [unidentified cloning vector] | 0.035 |
| 3385 | Z96177 | H.sapiens telomeric DNA sequence, clone 10QTEL040, read 10QTELOO040.seq | 7e-038 | 987050 | (X65335) lacZ gene product [unidentified cloning vector] | 0.035 |
| 3386 | U95094 | Xenopus laevis XL-INCENP (XL-INCENP) mRNA, complete cds | 4e-011 | 2384956 | (AF022985) No definition line found [Caenorhabditis elegans] | 6e-029 |
| 3387 | AF010484 | Homo sapiens ICI YAC 9IA12, right end sequence | 3e-010 | <NONE> | <NONE> | <NONE> |
| 3388 | U95094 | Xenopus laevis XL-INCENP (XL-INCENP) mRNA, complete cds | 5e-013 | 113667 | !!!! ALU CLASS B WARNING ENTRY !!!! | 0.68 |
| 3389 | AJ009761 | Homo sapiens mRNA for putative dimethyladenosine transferase, partial | 0 | 4050050 | (AF102147) putative dimethyladenosine transferase [Homo sapiens] | 4.00E-46 |
| 3390 | U95102 | Xenopus laevis mitotic phosphoprotein 90 mRNA, complete cds | 0.048 | <NONE> | <NONE> | <NONE> |
| 3391 | U95102 | Xenopus laevis mitotic phosphoprotein | 0.048 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3392 | AL022579 | 90 mRNA, complete cds Homo sapiens DNA sequence from clone 47K8 on chromosome Xp11.21–11.23, complete sequence [Homo sapiens] | 1e-070 | <NONE> | <NONE> | <NONE> |
| 3393 | U37454 | Human Down Syndrome region of chromosome 21 genomic sequence, clone A31D6-1H7. | 0.12 | <NONE> | <NONE> | <NONE> |
| 3394 | AF058954 | Homo sapiens GTP-specific succinyl-CoA synthetase beta subunit (SCS) mRNA, partial cds | 0 | 3766199 | (AF058954) GTP-specific succinyl-CoA synthetase beta subunit [Homo sapiens] | e-122 |
| 3395 | U95102 | Xenopus laevis mitotic phosphoprotein 90 mRNA, complete cds | 3e-009 | 3043582 | (AB011101) KIAA0529 protein [Homo sapiens] | 2e-012 |
| 3396 | Z23090 | H.sapiens mRNA for 28 kDa heat shock protein. | 3e-079 | 1709972 | 60S RIBOSOMAL PROTEIN L10A (CSA-19) | 2e-025 |
| 3397 | D14657 | Human mRNA for KIAA0101 gene, complete cds | 0 | 3183216 | HYPOTHETICAL PROTEIN KIAA0101 sapiens] | 2e-026 |
| 3398 | D17577 | Mouse mRNA for kinesin-like protein (Kif1b), complete cds | e-121 | 2497524 | KINESIN-LIKE PROTEIN KIF1B mouse >gi\|407339\|gnl\|PID\|d1005029 (D17577) Kif1b [Mus musculus] | 1e-048 |
| 3399 | AF091078 | Homo sapiens clone 559 unknown mRNA, complete sequence | 0 | 4050050 | (AF102147) putative dimethyladenosine transferase [Homo sapiens] | 1e-048 |
| 3400 | AC000043 | Homo sapiens Chromosome 22q13 Cosmid Clone p74a8, complete sequence [Homo sapiens] | 7e-006 | <NONE> | <NONE> | <NONE> |
| 3401 | AC000043 | Homo sapiens Chromosome 22q13 Cosmid Clone p74a8, complete sequence [Homo sapiens] | 7e-006 | <NONE> | <NONE> | <NONE> |
| 3402 | AF031924 | Homo sapiens homeobox transcription factor barx2 | e-156 | <NONE> | <NONE> | <NONE> |
| 3403 | AF031924 | Homo sapiens homeobox transcription factor barx2 | e-157 | 3882305 | (AB018335) KIAA0792 protein [Homo sapiens] | 4.5 |
| 3404 | L22473 | Human Bax alpha mRNA, complete cds. | 0 | 728945 | APOPTOSIS REGULATOR BAX, MEMBRANE | 9e-075 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3405 | U04709 | Human adenine phosphoribosyl-transferase (APRT) gene, 3' flanking region | e-151 | 113668 | ISOFORM ALPHA >gi\|539664\|pir\|\|A47538 bcl-2-associated protein bax alpha splice form-human >gi\|388166 !!!! ALU CLASS C WARNING ENTRY !!!! | 0.91 |
| 3406 | U95094 | Xenopus laevis XL-INCENP (XL-INCENP) mRNA, complete cds | 3e-008 | 3064146 | (AF036408) mucin-like protein [Trypanosoma cruzi] | 7.6 |
| 3407 | AF093268 | Rattus norvegicus homer-1c mRNA, complete cds | e-171 | 1913909 | (U92079) GLGF-domain protein Homer [Rattus norvegicus] | 4e-046 |
| 3408 | U47322 | Cloning vector DNA, complete sequence. | 2.00E-38 | 987050 | (X65335) lacZ gene product [unidentified cloning vector] | 3.00E-03 |
| 3409 | U78109 | Mus musculus prepro-neurturin mRNA, complete cds | 1.2 | 2506998 | STANNIOCALCIN (STC) (CORPUSCLES OF STANNIUS PROTEIN) (CS) (HYPOCALCIN) (TELEOCALCIN) | 1.2 |
| 3410 | Z96177 | H.sapiens telomeric DNA sequence, clone 10QTEL040, read 10QTELOO040.seq | 5e-013 | <NONE> | <NONE> | <NONE> |
| 3411 | D50930 | Human mRNA for KIAA0140 gene, complete cds | 0.00E+00 | 1235974 | (X96713) collagen [Globodera pallida] | 5.8 |
| 3412 | D50930 | Human mRNA for KIAA0140 gene, complete cds | 2e-046 | <NONE> | <NONE> | <NONE> |
| 3413 | U95102 | Xenopus laevis mitotic phosphoprotein 90 mRNA, complete cds | 1e-010 | <NONE> | <NONE> | <NONE> |
| 3414 | L01777 | Yersinia pseudotuberculosis (group IIA) rfb gene cluster | 1.20E-01 | <NONE> | <NONE> | <NONE> |
| 3415 | D17577 | Mouse mRNA for kinesin-like protein (Kif1b), complete cds | e-130 | 2497524 | KINESIN-LIKE PROTEIN KIF1B mouse >gi\|407339\|gnl\|PID\|d1005029 (D17577) Kif1b [Mus musculus] | 1e-049 |
| 3416 | AB014597 | Homo sapiens mRNA for KIAA0697 protein, partial cds | 2e-067 | 3327208 | (AB014597) KIAA0697 protein [Homo sapiens] | 6e-050 |
| 3417 | U95094 | Xenopus laevis XL-INCENP (XL-INCENP) mRNA, complete cds | 1.00E-11 | <NONE> | <NONE> | <NONE> |
| 3418 | U95102 | Xenopus laevis | 0.0002 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3419 | U95102 | Xenopus laevis mitotic phosphoprotein 90 mRNA, complete cds | 0.0002 | <NONE> | <NONE> | <NONE> |
| 3420 | AB014597 | Homo sapiens mRNA for KIAA0697 protein, partial cds | 2e-067 | 3327208 | (AB014597) KIAA0697 protein [Homo sapiens] | 6e-050 |
| 3421 | U95102 | Xenopus laevis mitotic phosphoprotein 90 mRNA, complete cds | 5e-014 | 2072296 | (U95098) mitotic phosphoprotein 44 [Xenopus laevis] | 5.5 |
| 3422 | U95094 | Xenopus laevis XL-INCENP (XL-INCENP) mRNA, complete cds | 8.00E-08 | 1176456 | (S79774) bile salt-dependent lipase, BSDL {EC 3.1.1.-} [human, fetal pancreas, Peptide Partial, 720 aa] [Homo sapiens] | 9.4 |
| 3423 | AF100661 | Caenorhabditis elegans cosmid H20E11 | 0.39 | <NONE> | <NONE> | <NONE> |
| 3424 | U95098 | Xenopus laevis mitotic phosphoprotein 44 mRNA, partial cds | 2.00E-04 | <NONE> | <NONE> | <NONE> |
| 3425 | U95102 | Xenopus laevis mitotic phosphoprotein 90 mRNA, complete cds | 9.00E-10 | <NONE> | <NONE> | <NONE> |
| 3426 | U95102 | Xenopus laevis mitotic phosphoprotein 90 mRNA, complete cds | 9.00E-10 | <NONE> | <NONE> | <NONE> |
| 3427 | U95094 | Xenopus laevis XL-INCENP (XL-INCENP) mRNA, complete cds | 2.00E-05 | 3056592 | (AC004255) T1F9.13 [Arabidopsis thaliana] | 10 |
| 3428 | U89676 | Candida albicans putative membrane protein (CSP37) gene, complete cds | 0.12 | <NONE> | <NONE> | <NONE> |
| 3429 | U95102 | Xenopus laevis mitotic phosphoprotein 90 mRNA, complete cds | 5e-014 | 2072296 | (U95098) mitotic phosphoprotein 44 [Xenopus laevis] | 5.5 |
| 3430 | <NONE> | <NONE> | <NONE> | <NONE> | <NONE> | <NONE> |
| 3431 | U95094 | Xenopus laevis XL-INCENP (XL-INCENP) mRNA, complete cds | 2.00E-07 | <NONE> | <NONE> | <NONE> |
| 3432 | U95094 | Xenopus laevis XL-INCENP (XL-INCENP) mRNA, complete cds | 2.00E-07 | <NONE> | <NONE> | <NONE> |
| 3433 | U95094 | Xenopus laevis XL-INCENP (XL-INCENP) | 2.00E-07 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3434 | U95102 | mRNA, complete cds<br>*Xenopus laevis* mitotic phosphoprotein 90 mRNA, complete cds | 4.00E−13 | <NONE> | <NONE> | <NONE> |
| 3435 | U95102 | *Xenopus laevis* mitotic phosphoprotein 90 mRNA, complete cds | 4.00E−13 | <NONE> | <NONE> | <NONE> |
| 3436 | AB014597 | *Homo sapiens* mRNA for KIAA0697 protein, partial cds | 2e−067 | 3327208 | (AB014597) KIAA0697 protein [*Homo sapiens*] | 6e−050 |
| 3437 | U95094 | *Xenopus laevis* XL-INCENP (XL-INCENP) mRNA, complete cds | 2.00E−06 | 1360669 | collagen alpha 1(V) chain precursor - human *sapiens*] | 1.8 |
| 3438 | U65297 | *Geomys breviceps* cytochrome b (cytb) gene, mitochondrial gene encoding mitochondrial protein, complete cds | 3.50E+00 | <NONE> | <NONE> | <NONE> |
| 3439 | U95094 | *Xenopus laevis* XL-INCENP (XL-INCENP) mRNA, complete cds | 2.00E−06 | 3914965 | TOXIN BMK-X PRECURSOR (BMK10) (BMK M10) (NEUROTOXIN M10) >gi\|3138981 (AF062563) neurotoxin M10 precursor [*Mesobuthus martensii*] | 4 |
| 3440 | U95094 | *Xenopus laevis* XL-INCENP (XL-INCENP) mRNA, complete cds | 2.00E−06 | 3914965 | TOXIN BMK-X PRECURSOR (BMK10) (BMK M10) (NEUROTOXIN M10) >gi\|3138981 (AF062563) neurotoxin M10 precursor [*Mesobuthus martensii*] | 4 |
| 3441 | U95102 | *Xenopus laevis* mitotic phosphoprotein 90 mRNA, complete cds | 3e−011 | 3413900 | (AB007938) KIAA0469 protein [*Homo sapiens*] | 1.40E−02 |
| 3442 | U95094 | *Xenopus laevis* XL-INCENP (XL-INCENP) mRNA, complete cds | 1.00E−11 | 2072296 | (U95098) mitotic phosphoprotein 44 [*Xenopus laevis*] | 4.20E+00 |
| 3443 | U95094 | *Xenopus laevis* XL-INCENP (XL-INCENP) mRNA, complete cds | 1.00E−11 | 2072296 | (U95098) mitotic phosphoprotein 44 [*Xenopus laevis*] | 4.20E+00 |
| 3444 | U95094 | *Xenopus laevis* XL-INCENP (XL-INCENP) mRNA, complete cds | 8.00E−08 | 1176456 | (S79774) bile salt-dependent lipase, BSDL {EC 3.1.1.—} (human, fetal pancreas, Peptide Partial, 720 aa] | 9.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3445 | U95102 | *Xenopus laevis* mitotic phosphoprotein 90 mRNA, complete cds | 4.00E−13 | <NONE> | [*Homo sapiens*] <NONE> | <NONE> |
| 3446 | U91543 | *Homo sapiens* zinc-finger helicase (hZFH) mRNA, complete cds | 1.00E−61 | 2961557 | (AF050199) putative peroxisome microbody protein 175.1 | 3.70E+00 |
| 3447 | X75258 | *H. sapiens* DNA from recombination area | 1.40E−02 | 1143020 | (U28974) ORF1 [Spiroplasma virus] | 9.5 |
| 3448 | U95098 | *Xenopus laevis* mitotic phosphoprotein 44 mRNA, partial cds | 8.00E−08 | <NONE> | <NONE> | <NONE> |
| 3449 | U95094 | *Xenopus laevis* XL-INCENP (XL-INCENP) mRNA, complete cds | 2.00E−07 | 631089 | bat2 protein - human | 0.055 |
| 3450 | AL022321 | *Homo sapiens* DNA sequence from PAC 2008 on chromosome 22q12.1–12.3. Contains exons 13 and 14 of the SLC5A1 (SGLT1) gene for solute carrier family 5 Sodium-Glucose Cot . . . | 1.10E+00 | 3063453 | (AC003981) F22O13.15 [*Arabidopsis thaliana*] | 7.2 |
| 3451 | AF060798 | *Homo sapiens* myristilated and palmitylated serine-threonine kinase MPSK (MPSK1) mRNA, complete cds | 0.00E+00 | 3372666 | (AF060798) myristilated and palmitylated serine-threonine kinase MPSK [*Homo sapiens*] | 2e−067 |
| 3452 | AF080399 | *Drosophila melanogaster* mitotic checkpoint control protein kinase BUB1 (Bub1) mRNA, complete cds | 1.1 | 3184082 | (AL023781) N-terminal acetyltransferase 1 [*Schizosaccharomyces pombe*] | 1e−033 |
| 3453 | AF041259 | *Homo sapiens* breast cancer putative transcription factor (ZABC1) mRNA, complete cds | 0.00E+00 | 3879065 | (Z81576) R10E8.3 [*Caenorhabditis elegans*] | 9.7 |
| 3454 | U95094 | *Xenopus laevis* XL-INCENP (XL-INCENP) mRNA, complete cds | 3.70E−01 | 549359 | MINOR CAPSID PROTEIN L2 type 26 >gi|396962 (X74472) late protein [*Human papillomavirus type 26*] | 0.097 |
| 3455 | U95102 | *Xenopus laevis* mitotic phosphoprotein 90 mRNA, complete cds | 2.00E−06 | 2746890 | (AF040655) No definition line found [*Caenorhabditis elegans*] | 9.1 |
| 3456 | U95102 | *Xenopus laevis* mitotic phosphoprotein | 2e−005 | 3874316 | (Z81470) predicted using Genefinder | 6.8 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3457 | V01399 | 90 mRNA, complete cds Defective Semliki forest virus RNA. Derived by serial undiluted passaging of the virus in baby hamster kidney cells > :: gb\|L00017\|SFVD IB semliki forest virus defective interfering (18s di) rna di309. | 0.98 | 2496616 | HYPOTHETICAL 38.5 KD PROTEIN Y4EE | 2.1 |
| 3458 | U95094 | *Xenopus laevis* XL-INCENP (XL-INCENP) mRNA, complete cds | 4.60E−02 | <NONE> | <NONE> | <NONE> |
| 3459 | U95094 | *Xenopus laevis* XL-INCENP (XL-INCENP) mRNA, complete cds | 6.00E−06 | <NONE> | <NONE> | <NONE> |
| 3460 | U95102 | *Xenopus laevis* mitotic phosphoprotein 90 mRNA, complete cds | 0.014 | 630844 | NADH dehydrogenase chain 2 - fruit fly dehydrogenase subunit 2 [*Drosophila erecta*] | 7.3 |
| 3461 | L49035 | Gorilla gorilla ABC-transporter (TAP2) mRNA, complete cds | 4.70E−01 | 2058691 | (U94836) ERPROT 213–21 [*Homo Sapiens*] | 4.3 |
| 3462 | U67524 | *Methanococcus jannaschii* section 66 of 150 of the complete genome | 4.10E−02 | 140229 | HYPOTHETICAL 82 KD A VIRULENCE PROTEIN IN A VRBS3 REGION >gi\|77844\|pir\|\|JQ0 317 hypothetical 82 K protein - *Xanthomonas campestris* pv. *vesicatoria* | 7.3 |
| 3463 | U95102 | *Xenopus laevis* mitotic phosphoprotein 90 mRNA, complete cds | 4.00E−12 | <NONE> | <NONE> | <NONE> |
| 3464 | U65297 | *Geomys breviceps* cytochrome b (cytb) gene, mitochondrial gene encoding mitochondrial protein, complete cds | 3.50E+00 | <NONE> | <NONE> | <NONE> |
| 3465 | <NONE> | <NONE> | <NONE> | <NONE> | <NONE> | <NONE> |
| 3466 | U36266 | Human beta-prime-adaptin (BAM22) gene, exons 18 and 19 | 1.20E+00 | <NONE> | <NONE> | <NONE> |
| 3467 | AB018327 | *Homo sapiens* mRNA for KIAA0784 protein, partial cds | 0 | 3882289 | (AB018327) KIAA0784 protein [*Homo sapiens*] | e−103 |
| 3468 | AB018327 | *Homo sapiens* mRNA for | 0 | 3882289 | (AB018327) KIAA0784 protein | e−103 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | KIAA0784 protein, partial cds | | | [Homo sapiens] | |
| 3469 | U66789 | Human laminin alpha 2 chain (LAMA2) gene, exon 57 | 4.80E−02 | 3873753 | (Z66519) similar to phytoene synthase precursor; cDNA EST yk340f7.3 comes from this gene; cDNA EST yk240f7.5 comes from this gene [Caenorhabditis elegans] | 3e−006 |
| 3470 | AB018327 | Homo sapiens mRNA for KIAA0784 protein, partial cds | 9.00E−88 | 3882289 | (AB018327) KIAA0784 protein [Homo sapiens] | 9e−022 |
| 3471 | U95098 | Xenopus laevis mitotic phosphoprotein 44 mRNA, partial cds | 0.0002 | <NONE> | <NONE> | <NONE> |
| 3472 | U67524 | Methanococcus jannaschii section 66 of 150 of the complete genome | 4.10E−02 | 140229 | HYPOTHETICAL 82 KD A VIRULENCE PROTEIN IN A VRBS3 REGION >gi\|77844\|pir\|\|JQ0 317 hypothetical 82 K protein - Xanthomonas campestris pv. vesicatoria | 7.3 |
| 3473 | L13972 | Homo sapiens beta-galactoside alpha-2,3-sialyltransferase (SIAT4A) mRNA, complete cds | 0.005 | <NONE> | <NONE> | <NONE> |
| 3474 | L13972 | Homo sapiens beta-galactoside alpha-2,3-sialyltransferase (SIAT4A) mRNA, complete cds | 0.005 | <NONE> | <NONE> | <NONE> |
| 3475 | AL031222 | Caenorhabditis elegans cosmid 6R55, complete sequence [Caenorhabditis elegans] | 1.10E−01 | <NONE> | <NONE> | <NONE> |
| 3476 | AF070529 | Homo sapiens clone 24525 mRNA sequence | 0 | 3879532 | (Z49130) cDNA EST EMBL:D74028 comes from this gene; cDNA EST EMBL:D71354 comes from this gene; cDNA EST EMBL:D76320 comes from this gene; cDNA EST yk486c7.3 comes from this gene; cDNA EST yk486c7.5 comes from this gene; cDNA . . . | 1.56E+00 |
| 3477 | U02567 | Mus musculus | 1.30E−01 | 2414601 | (Z99295) | 5e−005 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | BALB/c T-cell antigen 4-1BB gene, complete cds. | | | phosphatidyl synthase | |
| 3478 | AB018327 | Homo sapiens mRNA for KIAA0784 protein, partial cds | 9.00E−88 | 3882289 | (AB018327) KIAA0784 protein [Homo sapiens] | 9e−022 |
| 3479 | U95102 | Xenopus laevis mitotic phosphoprotein 90 mRNA, complete cds | 1e−011 | 2315521 | (AF016452) similar to the beta transducin family | 2e−006 |
| 3480 | U95094 | Xenopus laevis XL-INCENP (XL-INCENP) mRNA, complete cds | 9e−010 | 2072296 | (U95098) mitotic phosphoprotein 44 [Xenopus laevis] | 5.5 |
| 3481 | Y09077 | H. sapiens mRNA for atr gene > :: gb|U76308|HSU76308 Human protein kinase ATR mRNA, complete cds > :: emb|A61385|A61385 Sequence 1 from Patent WO9709433 | 0 | 1235902 | (U49844) FRAP-related protein [Homo sapiens] | 3e−051 |
| 3482 | Z48633 | H. sapiens mRNA for retrotransposon | e−165 | 1177607 | (X92485) pva1 [Plasmodium vivax] | 1.9 |
| 3483 | U95102 | Xenopus laevis mitotic phosphoprotein 90 mRNA, complete cds | 5e−013 | 111978 | mucin-rat | 2.6 |
| 3484 | U95102 | Xenopus laevis mitotic phosphoprotein 90 mRNA, complete cds | 3e−010 | 2072296 | (U95098) mitotic phosphoprotein 44 [Xenopus laevis] | 5.4 |
| 3485 | X77335 | A. thaliana gene for methyltransferase | 0.13 | 1401051 | (U24160) similar to Dvl-1 product encoded by GenBank Accession Number U10115; dishevelled segment polarity protein homolog [Mus musculus] | 3.5 |
| 3486 | AF038660 | Homo sapiens chromosome 1p33-p34 beta-1,4-galactosyltransferase mRNA, complete cds | e−144 | 2995442 | (Y12510) UDPGal:GlcNAc b1,4 galactosyltransferase [Homo sapiens] | 9e−005 |
| 3487 | U65960 | Human kinase substrate HASPP28 gene, 5' flanking region and partial cds | 1e−021 | 2120084 | reverse transcriptase - mouse >gi|558908 | 9.7 |
| 3488 | AF058907 | Homo sapiens pleiotrophin (PTN) gene, exons UV3, UV2 and UV1 | 8e−060 | 120806 | GAG POLYPROTEIN (CONTAINS: CORE PROTEIN P15; INNER COAT PROTEIN P12; CORE SHELL PROTEIN P30) | 5e−005 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3489 | U95094 | *Xenopus laevis* XL-INCENP (XL-INCENP) mRNA, complete cds | 4e−011 | 3123086 | >gi\|74562\|pir\|\|FOVDA gag polyprotein - avian spleen necrosis virus (fragment) >gi\|61758 (V01200) reading frame (gag?) [Spleen necrosis virus] HYPOTHETICAL PROTEIN MJ1050 *Methanococcus jannaschii* >gi\|2499895 (U67548) conserved hypothetical protein [*Methanococcus jannaschii*] | 2.5 |
| 3490 | AF035940 | *Homo sapiens* MAGOH mRNA, complete cds | 5e−096 | 3879018 | (Z81108) similar to MAGO NASHI PROTEIN; cDNA ESTyk415g7.3 comes from this gene; cDNA EST yk425g2.3 comes from this gene; cDNA EST yk425g2.5 comes from this gene; cDNA EST yk415g7.5 comes from this gene; cDNA EST yk376g9.3 c . . . | 5e−027 |
| 3491 | U95102 | *Xenopus laevis* mitotic phosphoprotein 90 mRNA, complete cds | 5e−013 | 3201662 | (AF042191) paraxial protocadherin; PAPC [*Danio rerio*] | 3.5 |
| 3492 | S80107 | membrane-associated diazepam binding inhibitor | e−113 | 244503 | (S80107) membrane-associated diazepam binding inhibitor, MA-DB1 [cattle, brain, Peptide, 552 aa] [*Bos taurus*] | 2e−030 |
| 3493 | U95102 | *Xenopus laevis* mitotic phosphoprotein 90 mRNA, complete cds | 4.00E−12 | <NONE> | <NONE> | <NONE> |
| 3494 | U95094 | *Xenopus laevis* XL-INCENP (XL-INCENP) mRNA, complete cds | 6e−015 | 728834 | !!!! ALU SUBFAMILY SB2 WARNING ENTRY | 0.29 |
| 3495 | U32794 | *Haemophilus influenzae* Rd section 109 of 163 of the complete genome | 1.3 | 2369865 | (Y14131) RNA polymerase [grapevine leafroll-associated virus 2] | 5.1 |
| 3496 | AF030558 | *Rattus norvegicus* phosphatidylinositol 5-phosphate 4-kinase gamma mRNA, complete cds | 1e−013 | <NONE> | <NONE> | <NONE> |
| 3497 | D17577 | Mouse mRNA for kinesin-like | e−121 | 2497524 | KINESIN-LIKE PROTEIN KIF1B | 1e−048 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | protein (Kif1b), complete cds | | | mouse >gi\|407339\|gnl\|PID\|d1005029 (D17577) Kif1b [*Mus musculus*] | |
| 3498 | U95102 | *Xenopus laevis* mitotic phosphoprotein 90 mRNA, complete cds | 6e−005 | 3881824 | (Z73899) ZK829.5 [*Caenorhabditis elegans*] | 1.5 |
| 3499 | L35657 | *Homo sapiens* (subclone H8 5_a10 from P1 35 H5 C8) DNA sequence. | 2e−018 | 2072296 | (U95098) mitotic phosphoprotein 44 [*Xenopus laevis*] | 3.2 |
| 3500 | U95094 | *Xenopus laevis* XL-INCENP (XL-INCENP) mRNA, complete cds | 1e−009 | 2072296 | (U95098) mitotic phosphoprotein 44 [*Xenopus laevis*] | 5.6 |
| 3501 | U95094 | *Xenopus laevis* XL-INCENP (XL-INCENP) mRNA, complete cds | 1e−009 | 2072296 | (U95098) mitotic phosphoprotein 44 [*Xenopus laevis*] | 5.6 |
| 3502 | U95094 | *Xenopus laevis* XL-INCENP (XL-INCENP) mRNA, complete cds | 9e−010 | 2072296 | (U95098) mitotic phosphoprotein 44 [*Xenopus laevis*] | 5.5 |
| 3503 | U95094 | *Xenopus laevis* XL-INCENP (XL-INCENP) mRNA, complete cds | 2e−006 | 2661842 | (Y15732) DNA polymerase beta [*Xenopus laevis*] | 4e−016 |
| 3504 | U65960 | Human kinase substrate HASPP28 gene, 5' flanking region and partial cds | 1e−021 | 2120084 | reverse transcriptase - mouse >gi\|558908 | 9.7 |
| 3505 | L19031 | *Rattus norvegicus* organic anion transporter | 3e−030 | 1171883 | SODIUM-INDEPENDENT ORGANIC ANION TRANSPORTER (ORGANIC ANION TAANSPORTING POLYPEPTIDE) anion - rat >gi\|410311 (L19031) oatp [*Rattus norvegicus*] | 2e−025 |
| 3506 | U60337 | *Homo sapiens* beta-mannosidase mRNA, complete cds | 0 | 3024091 | BETA-MANNOSIDASE PRECURSOR beta-mannosidase [*Homo sapiens*] | 2e−085 |
| 3507 | X92841 | *H. sapiens* MICA gene | 1e−055 | 106322 | hypothetical protein (L1H 3' region) - human | 1e−009 |
| 3508 | U50535 | Human BRCA2 region, mRNA sequence CG006 | 4e−012 | 728831 | !!!! ALU SUBFAMILY J WARNING ENTRY | 4.2 |
| 3509 | AF029984 | *Lycopersicon esculentum* COP1 homolog (COP1) mRNA, complete cds | 5e−035 | 3121867 | COP1 REGULATORY PROTEIN *sativum*] | 9e−052 |
| 3510 | Z59258 | *H. sapiens* CpG DNA, clone 13d2, reverse | 2e−046 | 3219914 | HYPOTHETICAL 16.8 KD PROTEIN | 2e−009 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | read cpg13d2.rt1c | | | C30D10.04 IN CHROMOSOME II >gi|2276353|gnl|PID|e330328 *pombe*] | |
| 3511 | U95094 | *Xenopus laevis* XL-INCENP (XL-INCENP) mRNA, complete cds | 3e−008 | <NONE> | <NONE> | <NONE> |
| 3512 | AF004161 | *Oryctolagus cuniculus* peroxisomal Ca-dependent solute carrier mRNA, complete cds | 9e−030 | 2352427 | (AF004161) peroxisomal Ca-dependent solute carrier | 1e−025 |
| 3513 | U15643 | *Drosophila melanogaster* ribosomal protein DL11 mRNA, complete cds | 0.13 | <NONE> | <NONE> | <NONE> |
| 3514 | U15643 | *Drosophila melanogaster* ribosomal protein DL11 mRNA, complete cds | 0.13 | <NONE> | <NONE> | <NONE> |
| 3515 | X87212 | *H. sapiens* mRNA for cathepsin C | e−103 | 1705632 | DIPEPTIDYL-PEPTIDASE I PRECURSOR TRANSFERASE) >gi|2146949|pir||S66504 dipeptidyl - peptidase I (EC 3.4.14.1) precursor - human *sapiens*] | 3e−034 |
| 3516 | U28789 | *Mus musculus* p53-associated cellular protein PACT mRNA, partial cds | e−101 | <NONE> | <NONE> | <NONE> |
| 3517 | U95102 | *Xenopus laevis* mitotic phosphoprotein 90 mRNA, complete cds | 1e−009 | 127112 | MAK16 PROTEIN >gi|73269|pir||BVBYK6 MAK16 protein - yeast (*Saccharomyces cerevisiae*) cerevisiae] >gi|595561 (U12980) Mak16p: putative nuclear protein [*Saccharomyces cerevisiae*] | 5e−022 |
| 3518 | U95102 | *Xenopus laevis* mitotic phosphoprotein 90 mRNA, complete cds | 9e−009 | <NONE> | <NONE> | <NONE> |
| 3519 | U95094 | *Xenopus laevis* XL-INCENP (XL-INCENP) mRNA, complete cds | 3e−010 | 2650142 | (AE001070) *A. fulgidus* predicted coding region AF0495 | 0.38 |
| 3520 | U95094 | *Xenopus laevis* XL-INCENP (XL-INCENP) mRNA, complete cds | 1e−012 | 2500418 | 40S RIBOSOMAL PROTEIN S5 >gi|1203905 | 1.6 |
| 3521 | AF004161 | *Oryctolagus cuniculus* peroxisomal Ca-dependent solute carrier mRNA, | 9e−030 | 2352427 | (AF004161) peroxisomal Ca-dependent solute carrier | 1e−025 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3522 | U95102 | Xenopus laevis mitotic phosphoprotein 90 mRNA, complete cds | 0.002 | 121743 | GTPASE-ACTIVATING PROTEIN (GAP) (RAS P21 PROTEIN ACTIVATOR) (P120GAP) (RASGAP) human >gi\|182972 (M23379) GTPase-activating protein activating protein [Homo sapiens] | 2.8 |
| 3523 | Z46372 | R. norvegicus RNA for DNA topoisomerase II. | e−131 | 3876360 | (Z68315) Similarity to Human MAP kinase phosphatase-1 (SW:PTN7_HUMAN) [Caenorhabditis elegans] | 3e−011 |
| 3524 | X85060 | B. taurus cosmid-derived microsatellite DNA | 1e−051 | 2072972 | (U93572) putative p150 [Homo sapiens] | 1e−019 |
| 3525 | D86407 | Homo sapiens DNA for apoER2, complete cds, and exon 19 | 0 | 3322933 | (AE001238) DNA ligase (lig) [Treponema pallidum] | 7.5 |
| 3526 | D17577 | Mouse mRNA for kinesin-like protein (Kif1b), complete cds | e−130 | 2497524 | KINESIN-LIKE PROTEIN KIF1B mouse >gi\|407339\|gnl\|PID\|d1005029 (D17577) Kif1b [Mus musculus] | 1e−049 |
| 3527 | U95094 | Xenopus laevis XL-INCENP (XL-INCENP) mRNA, complete cds | 2e−007 | 2414623 | (Z99259) putative phosphotransferase | 4e−009 |
| 3528 | U95760 | Drosophila melanogaster strawberry notch (sno) mRNA, complete cds | 1e−075 | 2076895 | (AF002197) F20H11.2 gene product [Caenorhabditis elegans] | 8e−057 |
| 3529 | X54326 | H. sapiens mRNA for glutaminyl-tRNA synthetase | 0 | 135104 | MULTIFUNCTIONAL AMINOACYL-TRNA SYNTHETASE (CONTAINS: GLUTAMYL-TRNA SYNTHETASE glutamyl-prolyl-tRNA synthetase - human >gi\|31958 | 3e−032 |
| 3530 | Z73360 | Human DNA sequence from cosmid 92M18, BRCA2 gene region chromosome 13q12–13. | 3e−039 | 2072955 | (U93566) p40 [Homo sapiens] | 7.8 |
| 3531 | Z73360 | Human DNA sequence from cosmid 92M18, BRCA2 gene region chromosome | 3e−039 | 2072955 | (U93566) p40 [Homo sapiens] | 7.8 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3532 | Z73360 | 13q12–13. Human DNA sequence from cosmid 92M18, BRCA2 gene region chromosome 13q12–13. | 1e–040 | 2072955 | (U93566) p40 [Homo sapiens] | 0.012 |
| 3533 | Z73360 | Human DNA sequence from cosmid 92M18, BRCA2 gene region chromosome 13q12–13. | 1e–040 | 2072955 | (U93566) p40 [Homo sapiens] | 0.012 |
| 3534 | U95094 | Xenopus laevis XL-INCENP (XL-INCENP) mRNA, complete cds | 1e–009 | 3808228 | (AF039080) RNA dependent RNA polymerase [Sphaeropsis sapinea RNA virus 2] | 1.5 |
| 3535 | U95102 | Xenopus laevis mitotic phosphoprotein 90 mRNA1 complete cds | 2e–005 | <NONE> | <NONE> | <NONE> |
| 3536 | U95760 | Drosophila melanogaster strawberry notch (sno) mRNA, complete cds | 3e–060 | 2078282 | (U95760) Sno [Drosophila melanogaster] | 1e–042 |
| 3537 | U95098 | Xenopus laevis mitotic phosphoprotein 44 mRNA, partial cds | 0.13 | 2832777 | (AL021086) 1-evidence = predicted by match; 1-match_accession = A202870; 1-match_description = LD03215.5prime LD Drosophila melanogaster embryo BlueScript Drosophila melanogaster cDNA clone LD03215 5prime.; 1-match_species = Drosop . . . | 4e–018 |
| 3538 | U95760 | Drosophila melanogaster strawberry notch (sno) mRNA, complete cds | 1e–075 | 2076895 | (AF002197) F20H11.2 gene product [Caenorhabditis elegans] | 8e–057 |
| 3539 | Z57610 | H. sapiens CpG DNA, clone 187a10, reverse read cpg187a10.rt1a. | 9e–061 | 913042 | hepatocyte nuclear factor 3 beta, HNF3 beta | 2e–014 |
| 3540 | X83416 | H. sapiens PrP gene, exon 2 | e–169 | 1172651 | PROTEASE PRTH >gi\|440338 (L27483) neutral protease large subunit [Porphyromonas gingivalis] | 6.2 |
| 3541 | AF061016 | Homo sapiens UDP-glucose dehydrogenase (UGDH) mRNA, complete cds | 0 | 2072296 | (U95098) mitotic phosphoprotein 44 [Xenopus laevis] | 3.4 |
| 3542 | X07290 | Human HF.12 gene mRNA | 7e–080 | 1127843 | (U41164) Cys2/His2 zinc finger protein [Rattus | 1e–034 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3543 | U95102 | Xenopus laevis mitotic phosphoprotein 90 mRNA, complete cds | 4.00E−12 | <NONE> | norvegicus] <NONE> | <NONE> |
| 3544 | U95760 | Drosophila melanogaster strawberry notch (sno) mRNA, complete cds | 3e−060 | 2078282 | (U95760) Sno [Drosophila melanogaster] | 1e−042 |
| 3546 | U95094 | Xenopus laevis XL-INCENP (XL-INCENP) mRNA, complete cds | 0.002 | 1255409 | (U53153) similar to mouse bullous pemphigoid antigen, BPAG2 (PIR:A46053) [Caenorhabditis elegans] | 7.3 |
| 3547 | U95102 | Xenopus laevis mitotic phosphoprotein 90 mRNA, complete cds | 8e−008 | 2072296 | (U95098) mitotic phosphoprotein 44 [Xenopus laevis] | 9.9 |
| 3548 | U95094 | Xenopus laevis XL-INCENP (XL-INCENP) mRNA, complete cds | 2e−005 | <NONE> | <NONE> | <NONE> |
| 3549 | U95094 | Xenopus laevis XL-INCENP (XL-INCENP) mRNA, complete cds | 0.0002 | 84605 | glycine-rich protein GRP33 - brine shrimp | 4.4 |
| 3550 | X83212 | H. sapiens tryptophan hydroxylase gene, promoter region | 5e−013 | 807677 | (M13101) unknown protein [Rattus norvegicus] | 0.39 |
| 3551 | U95102 | Xenopus laevis mitotic phosphoprotein 90 mRNA, complete cds | 0.005 | <NONE> | <NONE> | <NONE> |
| 3552 | U95094 | Xenopus laevis XL-INCENP (XL-INCENP) mRNA, complete cds | 4e−012 | 310622 | (L20249) homologous to Saccharopolyspora erythraea beta-ketoacyl synthase [Streptomyces coriofaciens] | 0.4 |
| 3553 | U95102 | Xenopus laevis mitotic phosphoprotein 90 mRNA, complete cds | 7e−007 | <NONE> | <NONE> | <NONE> |
| 3554 | U95094 | Xenopus laevis XL-INCENP (XL-INCENP) mRNA, complete cds | 8e−007 | 2996640 | (AC004500) GDF-9 [Homo sapiens] | 8.2 |
| 3555 | Z35928 | S. cerevisiae chromosome II reading frame ORF YBR059c | 0.043 | 2384728 | (AF015883) hydroxyproline-rich glycoprotein gas28p precursor [Chlamydomonas reinhardtii] | 0.23 |
| 3556 | Z30174 | M. domesticus (C57B1/6J) mRNA for zinc finger protein 30 | 2e−037 | 543345 | zinc finger protein 30 - mouse domesticus] | 1e−020 |
| 3557 | U95102 | Xenopus laevis mitotic phosphoprotein 90 mRNA, complete cds | 0.002 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3558 | M36072 | Human ribosomal protein L7a (surf 3) large subunit mRNA, complete cds. | 1e−054 | 133014 | 60S RIBOSOMAL PROTEIN L7A (PLA-X POLYPEPTIDE) (SURF-3) >gi\|71116\|pir\|\|R5H U7A ribosomal protein L7a - human >gi\|71117\|pir\|\|R5R T7A ribosomal protein L7a - rat >gi\|34203 (X52138) L7a protein [Homo sapiens] >gi\|35512 (X06705) PLA-X polypeptide [Homo sapiens] | 0.019 |
| 3559 | U84720 | Homo sapiens mRNA export protein (RAE1) mRNA, complete cds | 2e−037 | <NONE> | <NONE> | <NONE> |
| 3560 | AE001054 | Archaeoglobus filgidus section 53 of 172 of the complete genome | 1.2 | <NONE> | <NONE> | <NONE> |
| 3561 | U34683 | Human glutathione synthetase mRNA, complete cds | 3e−052 | 1346191 | GLUTATHIONE SYNTHETASE (GLUTATHIONE SYNTHASE) (GSH SYNTHETASE) (GSH-S) sapiens] >gi\|1236350 (U34683) glutathione synthetase | 1e−014 |
| 3562 | U95102 | Xenopus laevis mitotic phosphoprotein 90 mRNA, complete cds | 6e−015 | 1825695 | (U88180) similar to molybdenum cofactor biosynthesis protein E [Caenorhabditis elegans] | 4e−012 |
| 3563 | AE001421 | Plasmodium falciparum chromosome 2, section 58 of 73 of the complete sequence | 0.005 | <NONE> | <NONE> | <NONE> |
| 3564 | D10871 | Human h NAT allele 2—2 gene for arylamine N-acetyltransferase | 5e−016 | 3915580 | ZINC FINGER PROTEIN 186 finger protein [Homo sapiens] | 0.96 |
| 3565 | M32251 | Cat LINE-1 DNA sequence region 1. | 2e−026 | 87765 | hypothetical L1 protein (third intron of gene TS) - human >gi\|364964\|prf\|\|15 10254A L1 repetitive element ORF [Homo sapiens] | 2e−011 |
| 3566 | Y12773 | H. sapiens TRIDENT/HFH11 gene, promoter sequence | 3e−008 | <NONE> | <NONE> | <NONE> |
| 3567 | U95102 | Xenopus laevis mitotic phosphoprotein 90 mRNA, | 3e−010 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3568 | U95102 | *Xenopus laevis* mitotic phosphoprotein 90 mRNA, complete cds | 1e-010 | <NONE> | <NONE> | <NONE> |
| 3569 | U95094 | *Xenopus laevis* XL-INCENP (XL-INCENP) mRNA, complete cds | 9e-009 | 136821 | HYPOTHETICAL PROTEIN UL13 precursor - human cytomegalovirus (strain AD169) | 6 |
| 3570 | AF039210 | *Homo sapiens* caspase-activated nuclease mRNA, complete cds | e-104 | 3347857 | (AF064019) DNA fragmentation factor 40 kDa subunit [*Homo sapiens*] >gi\|3410909\|gnl\|PID\|d1033212 (AB013918) CAD | 1e-024 |
| 3571 | U95102 | *Xenopus laevis* mitotic phosphoprotein 90 mRNA, complete cds | 4e-012 | 2132458 | probable membrane protein YDL211c - yeast | 7.5 |
| 3572 | U95094 | *Xenopus laevis* XL-INCENP (XL-INCENP) mRNA, complete cds | 4e-011 | 2072296 | (U95098) mitotic phosphoprotein 44 [*Xenopus laevis*] | 0.39 |
| 3573 | U22233 | Human methylthioadenosine phosphorylase (MTAP) mRNA, complete cds. | 2e-015 | 2494053 | 5'-METHYLTHIO-ADENOSINE PHOSPHORYLASE (MTA PHOSPHORYLASE) (MTAPASE) phosphorylase (EC 2.4.2.28) - human >gi\|847724 (U22233) methylthioadenosine phosphorylase [*Homo sapiens*] | 0.02 |
| 3574 | X76122 | *A. majus* cyclin-1 mRNA. | 3.2 | 2135633 | MHC cell surface glycoprotein - human sapiens] | 9 |
| 3575 | U95102 | *Xenopus laevis* mitotic phosphoprotein 90 mRNA, complete cds | 1e-009 | 699508 | (U20542) lethal(1)1Bi protein [*Drosophila melanogaster*] | 0.64 |
| 3576 | D13391 | Human CYP19 gene for aromatase cytochrome P-450, promoter region (containing two cis-acting transcriptional regulatory elements) | 2e-018 | <NONE> | <NONE> | <NONE> |
| 3577 | U95102 | *Xenopus laevis* mitotic phosphoprotein 90 mRNA, complete cds | 0.0002 | 532806 | (U13875) C26E6.5 gene product [*Caenorhabditis elegans*] | 5e-045 |
| 3578 | X63735 | *H. sapiens* TRE5 and TRE18 sequence of the tre oncogene | 4e-033 | 728831 | !!!! ALU SUBFAMILY J WARNING ENTRY | 9e-006 |
| 3579 | AC004497 | *Homo sapiens* chromosome 21, P1 clone | 0.0005 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3580 | AB003095 | LBNL#6 Fruitfly strain S1259 mitochondrial DNA, A + T-rich region, partial sequence | 0.12 | <NONE> | <NONE> | <NONE> |
| 3581 | Z36019 | S. cerevisiae chromosome II reading frame ORF YBR150c | 3.2 | 4107113 | (AB007462) Pax-2/5/8 [Ephydatia fluviatilis] | 5.3 |
| 3582 | Z56421 | H. sapiens CpG DNA, clone 117c7, reverse read cpg117c7.rt1a. | 1e–033 | 3876101 | (Z75536) similar to DnaJ domain; cDNA EST yk398h12.5 comes from this gene; cDNA EST yk250d6.5 comes from this gene [Caenorhabditis elegans] | 1e–040 |
| 3583 | U36499 | Human lymphoid-specific SP100 homolog (LYSP100-A) mRNA, complete cds | 5e–015 | 1362890 | phosphoprotein 75 - human >gi|402148 | 1e–008 |
| 3584 | U95098 | Xenopus laevis mitotic phosphoprotein 44 mRNA, partial cds | 5e–005 | <NONE> | <NONE> | <NONE> |
| 3585 | U95102 | Xenopus laevis mitotic phosphoprotein 90 mRNA, complete cds | 0.002 | 1045228 | (X92429) Synthetase [Streptomyces anulatus] | 0.84 |
| 3586 | D86963 | Human mRNA for KIAA0208 gene, complete cds | 0.04 | <NONE> | <NONE> | <NONE> |
| 3587 | U95094 | Xenopus laevis XL-INCENP (XL-INCENP) mRNA, complete cds | 1e–012 | <NONE> | <NONE> | <NONE> |
| 3588 | AB012113 | Homo sapiens gene for CC chemokine PARC precursor, complete cds | 0.0002 | 1723187 | 112.3 KD PROTEIN IN PYK1-SNC1 INTERGENIC REGION >gi|2131258|pir||S 70292 FUN12 protein Fun12p: 97 kDa protein, function unknown [Saccharomyces cerevisiae] | 4.2 |
| 3589 | U95094 | Xenopus laevis XL-INCENP (XL-INCENP) mRNA, complete cds | 3e–007 | <NONE> | <NONE> | <NONE> |
| 3590 | U95098 | Xenopus laevis mitotic phosphoprotein 44 mRNA, partial cds | 0.002 | <NONE> | <NONE> | <NONE> |
| 3591 | U95098 | Xenopus laevis mitotic phosphoprotein 44 mRNA, partial cds | 6e–005 | <NONE> | <NONE> | <NONE> |
| 3592 | U95094 | Xenopus laevis | 1e–009 | 2072296 | (U95098) mitotic | 2.8 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | XL-INCENP (XL-INCENP) mRNA, complete cds | | | phosphoprotein 44 [Xenopus laevis] | |
| 3593 | U95094 | Xenopus laevis XL-INCENP (XL-INCENP) mRNA, complete cds | 3e−006 | <NONE> | <NONE> | <NONE> |
| 3594 | M80938 | Oryza sativa 16.9 kDa heat shock protein gene, complete cds. | 1.5 | <NONE> | <NONE> | <NONE> |
| 3595 | U95094 | Xenopus laevis XL-INCENP (XL-INCENP) mRNA, complete cds | 5e−014 | <NONE> | <NONE> | <NONE> |
| 3596 | U95094 | Xenopus laevis XL-INCENP (XL-INCENP) mRNA, complete cds | 1e−012 | <NONE> | <NONE> | <NONE> |
| 3597 | X67813 | C. familiaris SRP72 mRNA for signal recognition particle | 4e−083 | 2072296 | (U95098) mitotic phosphoprotein 44 [Xenopus laevis] | 6.2 |
| 3598 | AB007930 | Homo sapiens mRNA for KIAA0461 perotein, partial cds | 3e−038 | 3413884 | (AB007930) KIAA0461 perotein [Homo sapiens] | 3e−016 |
| 3599 | U95098 | Xenopus laevis mitotic phosphoprotein 44 mRNA, partial cds | 8e−007 | 3093586 | (AF018165) amyloid precursor protein [Tetraodon fluviatilis] | 2.7 |
| 3600 | Z35102 | H. sapiens mRNA for Ndr protein kinase > :: emb\|A52140\|A52140 Sequence 6 from Patent WO9619579 | e−126 | 2135799 | Ndr protein kinase - human >gi\|854170 | 9e−086 |
| 3601 | U95102 | Xenopus laevis mitotic phosphoprotein 90 mRNA, complete cds | 2e−005 | <NONE> | <NONE> | <NONE> |
| 3602 | X51544 | Synthetic hamster-human hybrid cell (HCH-1) HSAG-2 gene Alu repeat region. | 0.13 | 1706266 | SULFATE ADENYLATE TRANSFERASE SUBUNIT 2 (ATP-SULFURYLASE) >gi\|1322409\|gnl\|PID\|e243270 | 5.8 |
| 3603 | Z98237 | H. sapiens DNA for exon trapped sequence | 3e−051 | 3979947 | (AL034393) Y18D10A.15 [Caenorhabditis elegans] | 6e−005 |
| 3604 | U95098 | Xenopus laevis mitotic phosphoprotein 44 mRNA, partial cds | 7e−005 | <NONE> | <NONE> | <NONE> |
| 3605 | M57465 | N. crassa phytoene dehydrogenase (a1-1) gene, complete cds. | 0.29 | <NONE> | <NONE> | <NONE> |
| 3606 | U95102 | Xenopus laevis mitotic | 0.0002 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3607 | S71335 | phosphoprotein 90 mRNA, complete cds Aox1 = alternative oxidase {alternative pathway} suspension cells, mRNA, 1408 nt] | 1.1 | <NONE> | <NONE> | <NONE> |
| 3608 | U95098 | *Xenopus laevis* mitotic phosphoprotein 44 mRNA, partial cds | 0.005 | 2621440 | (AE000823) O-antigen transporter related protein | 5.7 |
| 3609 | U36199 | *Caenorhabditis elegans* CeMef-2 (mef-2) gene, complete cds. | 1.1 | 259519 | (S48091) NSM [tomato spotted wilt virus TSWV, Peptide, 302 aa] [Tomato spotted wilt virus] | 4.1 |
| 3610 | U95102 | *Xenopus laevis* mitotic phosphoprotein 90 mRNA, complete cds | 0.35 | 3399767 | (U76298) uclacyanin I [*Arabidopsis thaliana*] >gi|3831466 | 0.35 |
| 3611 | AF000590 | *Homo sapiens* chromosome 21q11-q21 genomic clone SA-292 | 7e−026 | <NONE> | <NONE> | <NONE> |
| 3612 | U64195 | HIV-1 isolate ZP36 from Australia, reverse transcriptase (pol) gene, partial cds. | 1.2 | <NONE> | <NONE> | <NONE> |
| 3613 | AB015331 | *Homo sapiens* HRIHFB2017 mRNA, partial cds | 1e−094 | 3970852 | (AB015331) HRIHFB2017 [*Homo sapiens*] | 0.0001 |
| 3614 | <NONE> | <NONE> | <NONE> | <NONE> | <NONE> | <NONE> |
| 3615 | U95102 | *Xenopus laevis* mitotic phosphoprotein 90 mRNA, complete cds | 1e−009 | 1743885 | (U79716) Human Reelin [*Homo sapiens*] | 9.5 |
| 3616 | U95094 | *Xenopus laevis* XL-INCENP (XL-INCENP) mRNA, complete cds | 3e−006 | <NONE> | <NONE> | <NONE> |
| 3617 | <NONE> | <NONE> | <NONE> | 2338034 | (AF005370) putative immediate early protein [Alcelaphine herpesvirus 1) | 2e−008 |
| 3618 | U95094 | *Xenopus laevis* XL-INCENP (XL-INCENP) mRNA, complete cds | 0.006 | 2707286 | (AF036316) cyclin [*Prorocentrum minimum*] | 1.2 |
| 3619 | X79810 | *R. norvegicus* CYP2C13 gene | 0.049 | 2916892 | (AL022004) PE_PGRS [*Mycobacterium tuberculosis*] | 1 |
| 3620 | AJ224516 | *Gallus gallus* IL-2 gene | 1.4 | <NONE> | <NONE> | <NONE> |
| 3621 | Z79044 | *H. sapiens* flow-sorted chromosome 6 HindIII fragment, SC6pA21C9 | 0.42 | <NONE> | <NONE> | <NONE> |
| 3622 | U39357 | *Ovis aries* beta actin mRNA, | 2e−024 | 2072296 | (U95098) mitotic phosphoprotein 44 | 1.3 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3623 | U39357 | complete cds *Ovis aries* beta actin mRNA, complete cds | 1e–043 | 940346 | [*Xenopus laevis*] (U20963) ORF1; late mRNA [Suid herpesvirus 1] | 5.6 |
| 3624 | U95098 | *Xenopus laevis* mitotic phosphoprotein 44 mRNA, partial cds | 3e–008 | 2702361 | (AF036706) No definition line found [*Caenorhabditis elegans*] | 0.22 |
| 3625 | U95098 | *Xenopus laevis* mitotic phosphoprotein 44 mRNA, partial cds | 0.041 | 244874 | Glvr-1 product [mice, Peptide, 681 aa] | 1.9 |
| 3626 | U95094 | *Xenopus laevis* XL-INCENP (XL-INCENP) mRNA, complete cds | 0.002 | <NONE> | <NONE> | <NONE> |
| 3627 | U95094 | *Xenopus laevis* XL-INCENP (XL-INCENP) mRNA, complete cds | 0.002 | 1730141 | FRAGILE X MENTAL RETARDATION SYNDROME RELATED PROTEIN 2 >gi\|2135129\|pir\|\|S60173 fragile X mental retardation syndrome related protein - human >gi\|1098637 (U31501) fragile X mental retardation syndrome related protein [*Homo sapiens*] | 9.4 |
| 3628 | U95094 | *Xenopus laevis* XL-INCENP (XL-INCENP) mRNA, complete cds | 8e–008 | <NONE> | <NONE> | <NONE> |
| 3629 | U95094 | *Xenopus laevis* XL-INCENP (XL-INCENP) mRNA, complete cds | 6e–006 | <NONE> | <NONE> | <NONE> |
| 3630 | D87671 | Rat mRNA for TIP120, complete cds | 0 | 1799570 | (D87671) TIP120 [*Rattus norvegicus*] | e–112 |
| 3631 | D87671 | Rat mRNA for TIP120, complete cds | 0 | 1799570 | (D87671) TIP120 [*Rattus norvegicus*] | e–110 |
| 3632 | <NONE> | <NONE> | <NONE> | <NONE> | <NONE> | <NONE> |
| 3633 | D88349 | Chicken mRNA for tyrosinase, complete cds | 0.12 | 2144081 | luteinizing hormone/chorionic gonadotropin receptor - rat >gi\|252167\|bbs\|109910 (S40803) luteinizing hormone/chorionic gonadotropin receptor, LH/CG receptor {alternatively spliced, clone rLHR1834} | 9.3 |
| 3634 | X17206 | Human mRNA for LLRep3 | 3e–025 | 2920827 | (U92697) ribosomal protein S2 [*Rattus norvegicus*] | 0.0003 |
| 3635 | U95102 | *Xenopus laevis* mitotic | 4e–011 | 2072296 | (U95098) mitotic phosphoprotein 44 | 3.3 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | phosphoprotein 90 mRNA, complete cds | | | [Xenopus laevis] | |
| 3636 | X69878 | H. sapiens Flt4 mRNA for transmembrane tyrosine kinase | 2e−088 | <NONE> | <NONE> | <NONE> |
| 3637 | X69878 | H. sapiens Flt4 mRNA for transmembrane tyrosine kinase | 2e−088 | <NONE> | <NONE> | <NONE> |
| 3638 | X15509 | Human gene for thymidine kinase, 5' region (EC 2.7.1.21) | 4e−011 | <NONE> | <NONE> | <NONE> |
| 3639 | U89744 | Rattus norvegicus putative cell surface antigen mRNA, complete cds | 0.39 | 1085432 | mucin (clone PGM-2A) - pig | 0.0006 |
| 3640 | L29252 | Human (clone D13-2) L-iditol-2 dehydrogenase gene, exon 4, exon 5, exon 6 and exon 7. | 3e−006 | 83981 | NADH dehydrogenase (ubiquinone) (EC 1.6.5.3) chain 4 - Sauroleishmania tarentolae mitochondrion | 2.4 |
| 3641 | Z35286 | H. sapiens MDR3 gene, exon1, exon2 | 0.016 | <NONE> | <NONE> | <NONE> |
| 3642 | M11373 | Simian T-cell leukemia virus, pol-env-pX-3' LTR region. | 0.39 | 2773324 | (AF040381) carbonic anhydrase [Erwinia carotovora] | 5.9 |
| 3643 | M11373 | Simian T-cell leukemia virus, pol-env-pX-3' LTR region. | 0.39 | 2773324 | (AF040381) carbonic anhydrase [Erwinia carotovora] | 5.9 |
| 3644 | Z11763 | O. granulifera gene for alpha-tubulin | 0.39 | 2138321 | (U89012) dentin matrix acidic phosphoprotein 1 [Homo sapiens] | 2.6 |
| 3645 | <NONE> | <NONE> | <NONE> | 1352944 | HYPOTHETICAL 118.4 KD PROTEIN IN BAT2-DAL5 INTERGENIC REGION PRECURSOR YJR151c - yeast (Saccharomyces cerevisiae) >gi\|1015903 | 3.9 |
| 3646 | U18351 | Drosophila melanogaster insulin receptor gene, complete cds | 0.005 | 1468983 | (U64830) protein tyrosine kinase [Dictyostelium discoideum] | 4e−012 |
| 3647 | M28458 | Human growth hormone receptor gene, exon 2. | 1.2 | 2648877 | (AE000987) A. fulgidus predicted coding region AF1681 | 8.1 |
| 3648 | AF069139 | HIV-1 isolate DH12 clone 5 from the USA, vpr protein (vpr) gene, partial cds; tat protein (tat) and rev protein (rev) genes, complete cds; vpu pseudogene, | 0.13 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | complete sequence; envelope glycoprotein (env) and nef protein (n . . . | | | | |
| 3649 | U42627 | *Rattus norvegicus* tyrosine phosphatase mRNA, complete cds. | 0.41 | 1070602 | collagen alpha 1(II) chain precursor - human | 0.55 |
| 3650 | Y12851 | *Homo sapiens* P2X7 gene, exon 1 and joined CDS | 0.005 | <NONE> | <NONE> | <NONE> |
| 3651 | U39706 | *Mycoplasma genitalium* section 28 of 51 of the complete genome | 0.39 | 465542 | HYPOTHETICAL 20.0 KD PROTEIN IN TRNP 5'REGION (ORF160) >gi\|625956\|pir\|\|S38599 hypothetical protein 160 (rpl20 5' region) - euglenid (*Astasia longa*) plastid | 2 |
| 3652 | Z80361 | *H. sapiens* HLA-DRB pseudogene, repeat region; | 2e–048 | <NONE> | <NONE> | <NONE> |
| 3653 | U12171 | *Oryza sativa* IR54 anther specific (RTS2) gene, complete cds. | 3.5 | <NONE> | <NONE> | <NONE> |
| 3654 | AG001163 | *Homo sapiens* genomic DNA, 21q region, clone: Q94A10X26 | 5e–014 | 728831 | !!!! ALU SUBFAMILY J WARNING ENTRY | 0.004 |
| 3655 | X04780 | Human tRNA-Tyr-pseudogene (clone pHtT2) | 4.6 | <NONE> | <NONE> | <NONE> |
| 3656 | AF086264 | *Homo sapiens* full length insert cDNA clone ZD43A10 | 0.002 | <NONE> | <NONE> | <NONE> |
| 3657 | AB011118 | *Homo sapiens* mRNA for KIAA0546 protein, partial cds | 0.002 | 1588661 | tryptase [*Bos taurus*] | 1.3 |
| 3658 | Z46379 | *Homo sapiens* mRNA for anti-Sm antibody VH chain | 0.13 | <NONE> | <NONE> | <NONE> |
| 3659 | Y12930 | *H. rustica* CHD-W gene, intron | 0.39 | 3861232 | (AJ235272) PROBABLE TRANSPORT ATP-BINDING PROTEIN MSBA (msbA2) [*Rickettsia prowazekii*] | 1.2 |
| 3660 | AF093267 | *Rattus norvegicus* homer-1b mRNA, complete cds | 0.005 | <NONE> | <NONE> | <NONE> |
| 3661 | M34057 | Human transforming growth factor-beta 1 binding protein mRNA, complete cds. | 0.043 | <NONE> | <NONE> | <NONE> |
| 3662 | X75418 | *H. sapiens* TCR V Beta 13.2 gene (allele a). | 0.4 | <NONE> | <NONE> | <NONE> |
| 3663 | Z68758 | Human DNA sequence from | 2e–025 | 3399771 | (AF041839) Smad6 [*Xenopus* | 0.39 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | cosmid cN85E10 on chromosome 22q11.2-qter | | | laevis] | |
| 3664 | U95102 | Xenopus laevis mitotic phosphoprotein 90 mRNA, complete cds | 2e−005 | 2078282 | (U95760) Sno [Drosophila melanogaster] | 0.0006 |
| 3665 | Z75032 | S. cerevisiae chromosome XV reading frame ORF YOR124c | 0.14 | <NONE> | <NONE> | <NONE> |
| 3666 | U28831 | Human protein immuno-reactive with anti-PTH polyclonal antibodies mRNA, partial cds. > :: gb\|I40055\|I40055 Sequence 1 from U.S. Pat. No. 5618695 | 0 | 896065 | (U28831) protein that is immuno-reactive with anti-PTH polyclonal antibodies [Homo sapiens] | e−100 |
| 3667 | U95098 | Xenopus laevis mitotic phosphoprotein 44 mRNA, partial cds | 0.04 | <NONE> | <NONE> | <NONE> |
| 3668 | <NONE> | <NONE> | <NONE> | <NONE> | <NONE> | <NONE> |
| 3669 | Z96359 | H. sapiens telomeric DNA sequence, clone 17QTEL013, read 17QTELOO013.seq | 7e−006 | 2921609 | (AF039037) 980219 -this used to be part of R02C2.4 but was split into two genes based on protein similarities | 7.7 |
| 3670 | U95098 | Xenopus laevis mitotic phosphoprotein 44 mRNA, partial cds | 8e−008 | 3342730 | (AC005331) R31341_1 [Homo sapiens] | 2e−019 |
| 3671 | U22460 | Ictalurus punctatus heat shock protein 70 (CF Hsp70) mRNA, complete cds. | 1.2 | 2143951 | Ras-related protein - rat >gi\|498257 | 5e−009 |
| 3672 | Y12259 | R. norvegicus mRNA for Kir3.1 protein | 0.005 | 135213 | TYPE IIS RESTRICTION ENZYME EC057I METHYLTRANS FERASE ACTIVITY >gi\|281976\|pir\|\|S26426 type II site-specific deoxyribonuclease (EC 3.1.21.4) Eco57I endonuclease [Escherichia coli] | 9.9 |
| 3673 | U95094 | Xenopus laevis XL-INCENP (XL-INCENP) mRNA, complete cds | 8e−008 | 3006154 | (AL022299) putative cytochrome c1, heme protein precursor [Schizosaccharomyces pombe] | 4.5 |
| 3674 | U95102 | Xenopus laevis mitotic phosphoprotein 90 mRNA, complete cds | 6e−006 | 3915503 | HYPOTHETICAL OXIDOREDUCTASE IN CHEV-MOBA INTERGENIC | 2e−021 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3675 | U71363 | Human zinc finger protein zfp6 (ZF6) mRNA, partial cds | 3e-070 | 2689441 | REGION >gi\|2632227\|gnl\|PID\|e1181911 1-dehydrogenase [*Bacillus subtilis*] (AC003682) F18547_1 [*Homo sapiens*] | 4e-029 |
| 3676 | AF042275 | *Oryza sativa* anther-specific protein gene, complete cds | 0.39 | <NONE> | <NONE> | <NONE> |
| 3677 | M34601 | *P. berghei* telomeric repeat region subfragment alpha DNA. | 0.13 | <NONE> | <NONE> | <NONE> |
| 3678 | U09368 | Human zinc finger protein ZNF140 | 6e-047 | 3445181 | (AC005498) R31665_2 [*Homo sapiens*] | 4e-027 |
| 3679 | D90345 | Rat t complex polypeptide 1 (Tcp-1) mRNA | 0.13 | <NONE> | <NONE> | <NONE> |
| 3680 | AE000758 | *Aquifex aeolicus* section 90 of 109 of the complete genome | 0.38 | 134134 | RYANODINE RECEPTOR, SKELETAL MUSCLE muscle - rabbit >gi\|1710 (X15750) ryanodine receptor (AA 1-5037) [*Oryctolagus cuniculus*] >gi\|1714 (X15209) ryanodine receptor [*Oryctolagus cuniculus*] | 9.8 |
| 3681 | X60280 | Vector plasmid pLTRpoly DNA | 3e-040 | 2981631 | (AB012223) ORF2 [*Canis familiaris*] | 0.87 |
| 3682 | U95102 | *Xenopus laevis* mitotic phosphoprotein 90 mRNA, complete cds | 3e-010 | 2072296 | (U95098) mitotic phosphoprotein 44 [*Xenopus laevis*] | 5.8 |
| 3683 | L81683 | *Homo sapiens* (subclone 1_d11 from P1 H54) DNA sequence | 3e-019 | 113668 | !!!! ALU CLASS C WARNING ENTRY !!!! | 2 |
| 3684 | U95102 | *Xenopus laevis* mitotic phosphoprotein 90 mRNA, complete cds | 1e-012 | 2072296 | (U95098) mitotic phosphoprotein 44 [*Xenopus laevis*] | 9.7 |
| 3685 | U95102 | *Xenopus laevis* mitotic phosphoprotein 90 mRNA, complete cds | 2e-012 | 2072296 | (U95098) mitotic phosphoprotein 44 [*Xenopus laevis*] | 6.8 |
| 3686 | X78261 | *H. sapiens* mRNA for TRE17 5' extremity and unnamed adjacent to TRE17, locus tre-1. | 3e-010 | 728836 | !!!! ALU SUBFAMILY SP WARNING ENTRY | 4.4 |
| 3687 | AF093204 | *Gallus gallus* clone Ocya1 unknown mRNA | 1e-011 | 3694883 | (AF093204) unknown [*Gallus gallus*] | 0.097 |
| 3688 | L35664 | *Homo sapiens* (subclone H8 8_f5 from P1 35 H5 C8) DNA | 3e-031 | 2072966 | (U93570) p40 [*Homo sapiens*] | 8e-006 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3689 | <NONE> | sequence.<br><NONE> | <NONE> | <NONE> | <NONE> | <NONE> |
| 3690 | L10111 | *Octopus dofleini* beta-tubulin mRNA, complete cds. | 0.14 | <NONE> | <NONE> | <NONE> |
| 3691 | S83333 | CYP27 = sterol 27-hydroxylase/ cerebrotendinous xanthomatosis candidate gene {3' region, intron 6 to intron 8} [human, Genomic, 1725 nt, segment 4 of 4] | 3.5 | <NONE> | <NONE> | <NONE> |
| 3692 | U95102 | *Xenopus laevis* mitotic phosphoprotein 90 mRNA, complete cds | 4e–011 | 2072296 | (U95098) mitotic phosphoprotein 44 [*Xenopus laevis*] | 5.9 |
| 3693 | U95102 | *Xenopus laevis* mitotic phosphoprotein 90 mRNA, complete cds | 9e–009 | 220578 | (D00570) open reading frame (251 AA) | 1.1 |
| 3694 | U95102 | *Xenopus laevis* mitotic phosphoprotein 90 mRNA, complete cds | 1e–010 | 416563 | INTESTINAL MEMBRANE A4 PROTEIN A4 differentiation-dependent protein [*Homo sapiens*] | 0.021 |
| 3695 | AB018374 | *Mus musculus* GARP34 mRNA, complete cds | 4e–074 | 3724364 | (AB018374) GARP34 [*Mus musculus*] | 2e–017 |
| 3696 | AB018374 | *Mus musculus* GARP34 mRNA, complete cds | 4e–074 | 3724364 | (AB018374) GARP34 [*Mus musculus*] | 2e–017 |
| 3697 | AB013721 | *Oryctolagus cuniculus* mRNA for mitsugumin 23, complete cds | 4e–038 | <NONE> | <NONE> | <NONE> |
| 3698 | U33147 | Human mammaglobin mRNA, complete cds > :: gb\|I65735\|I65735 Sequence I from U.S. Pat. No. 5668267 | 1.1 | 1946371 | (U93215) regulatory protein Viviparous-1 isolog | 2.5 |
| 3699 | U95098 | *Xenopus laevis* mitotic phosphoprotein 44 mRNA, partial cds | 0.0006 | 2132981 | probable membrane protein YPL105c - yeast | 5.1 |
| 3700 | U08802 | HIV-1 sample 026 clone 06 from Thailand partial cds. | 0.47 | 3880139 | (Z68121) Similarity to Yeast nitrogen regulatory protein GLN3 (PIR Acc. No. S22280) | 7.3 |
| 3701 | U95094 | *Xenopus laevis* XL-INCENP (XL-INCENP) mRNA, complete cds | 2e–011 | <NONE> | <NONE> | <NONE> |
| 3702 | U95102 | *Xenopus laevis* mitotic phosphoprotein 90 mRNA, complete cds | 0.002 | <NONE> | <NONE> | <NONE> |
| 3703 | U95094 | *Xenopus laevis* | 1e–011 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | XL-INCENP (XL-INCENP) mRNA, complete cds | | | | |
| 3704 | Z56740 | H. sapiens CpG DNA, clone 13b5, reverse read cpg13b5.rt1c. | 4e−043 | 2465332 | (U92819) unnamed HERV-H protein [Homo sapiens] | 0.007 |
| 3705 | U95094 | Xenopus laevis XL-INCENP (XL-INCENP) mRNA, complete cds | 1e−008 | <NONE> | <NONE> | <NONE> |
| 3706 | U95094 | Xenopus laevis XL-INCENP (XL-INCENP) mRNA, complete cds | 3e−009 | 1293790 | (U56248) Similar to polyketide synthase. [Caenorhabditis briggsae] | 2.9 |
| 3707 | AF023283 | Chikungunya virus S27 3'UTR | 0.39 | 3560261 | (AL031535) RNA binding protein | 4.5 |
| 3708 | U95102 | Xenopus laevis mitotic phosphoprotein 90 mRNA, complete cds | 2e−006 | <NONE> | <NONE> | <NONE> |
| 3709 | AF030944 | Brugia malayi microfilarial sheath protein SHP3a | 0.12 | <NONE> | <NONE> | <NONE> |
| 3710 | AE000700 | Aquifex aeolicus section 32 of 109 of the complete genome | 0.15 | <NONE> | <NONE> | <NONE> |
| 3711 | AJ001050 | Homo sapiens mRNA for thioredoxin reductase | 4e−042 | 1843434 | (D88687) KM-102-derived reductase-like factor [Homo sapiens] | 3e−038 |
| 3712 | U95098 | Xenopus laevis mitotic phosphoprotein 44 mRNA, partial cds | 0.002 | 625090 | (U19464) outer arm dynein beta heavy chain [Paramecium tetraurelia] >gi\|1588498\|prf\|2 208428A dynein:SUBUNIT = heavy chain [Paramecium tetraurelia] | 2.7 |
| 3713 | AG001414 | Homo sapiens genomic DNA, 21q region, clone: 9H11X4 | 0.46 | <NONE> | <NONE> | <NONE> |
| 3714 | AB007930 | Homo sapiens mRNA for KIAA0461 perotein, partial cds | 0 | 3413884 | (AB007930) KIAA0461 perotein [Homo sapiens] | 2e−068 |
| 3715 | U95102 | Xenopus laevis mitotic phosphoprotein 90 mRNA, complete cds | 9e−007 | <NONE> | <NONE> | <NONE> |
| 3716 | Y09999 | H. sapiens CHOP gene, intron 1 | 2e−007 | <NONE> | <NONE> | <NONE> |
| 3717 | AF023461 | Homo sapiens FRA3B region sequence | 0.13 | 2501500 | ECDYSTEROID UDP-GLUCOSYL-TRANSFERASE PRECURSOR >gi\|1563727\|gnl\|PI D\|e267373 (Y08294) ecdysteroid UDP- | 5.6 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3718 | U95094 | Xenopus laevis XL-INCENP (XL-INCENP) mRNA, complete | 2e−005 | 2330794 | glucosyltransferase [Lacanobia oleracea granulovirus] (Z98601) hypothetical protein | 0.004 |
| 3719 | U95102 | Xenopus laevis mitotic phosphoprotein 90 mRNA, complete cds | 7e−007 | 1363246 | TIFI protein - mouse >gi\|998815\|bbs\|167126 | 5e−007 |
| 3720 | U95102 | Xenopus laevis mitotic phosphoprotein 90 mRNA, complete cds | 6e−006 | 1314732 | (U54640) 185 kDa silk protein [Chironomus pallidivittatus] | 0.17 |
| 3721 | U09933 | Human urokinase-type plasminogen receptor, exon 3 | 5e−025 | 3523099 | (AF016271) Ksp-cadherin [Mus musculus] | 7.6 |
| 3722 | M30187 | S. cerevisiae mitochondrion Tyr-tRNA gene. | 0.13 | 218437 | (D90352) myo-inositol transporter | 7.3 |
| 3723 | X79703 | O. aries gene for beta-casein | 0.043 | 141103 | HYPOTHETICAL PROTEIN ORF-1137 mouse | 4.5 |
| 3724 | U95094 | Xenopus laevis XL-INCENP (XL-INCENP) mRNA, complete cds | 9e−009 | 2132008 | hypothetical protein YOL072w - yeast | 9.9 |
| 3725 | L39210 | Homo sapiens inosine monophosphate dehydrogenase type II gene, complete cds | 2e−078 | 2224711 | (AB002383) KIAA0385 [Homo sapiens] | 2e−018 |
| 3726 | U52832 | Homo sapiens Cri-du-chat region mRNA, clone CSC3 | 2e−005 | <NONE> | <NONE> | <NONE> |
| 3727 | AF015043 | Homo sapiens EH-binding protein mRNA, partial cds | e−169 | 2072296 | (U95098) mitotic phosphoprotein 44 [Xenopus laevis] | 3.4 |
| 3728 | D28485 | Human MSMB gene for beta-microseminoprotein (MSP), promoter region and exon1 | 4e−011 | <NONE> | <NONE> | <NONE> |
| 3729 | M33027 | Human vasoactive intestinal peptide/PHM-27 gene, exons 1–6. | 0.043 | <NONE> | <NONE> | <NONE> |
| 3730 | X15377 | Human gene for the light and heavy chains of myeloperoxidase | 2e−024 | 1346141 | GLYCEROL KINASE (ATP:GLYCEROL 3-PHOSPHOTRANS-FERASE) (GLYCERO-KINASE)(GK) Mycoplasma genitalium (SGC3) >gi\|3844648 (U39683) glycerol kinase (glpK) [Mycoplasma genitalium] | 3e−011 |
| 3731 | X57103 | Human h-lys | 0.0005 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3732 | U95102 | gene for lysozyme (upstream region) Xenopus laevis mitotic phosphoprotein 90 mRNA, complete cds | 3e−010 | 3319482 | (AF077546) No definition line found [Caenorhabditis elegans] | 9.8 |
| 3733 | U95102 | Xenopus laevis mitotic phosphoprotein 90 mRNA, complete cds | 1e−012 | 2072296 | (U95098) mitotic phosphoprotein 44 [Xenopus laevis] | 5.5 |
| 3734 | U83857 | Human Aac11 (aac11) mRNA, complete cds | 2e−027 | 2623755 | (U35846) unknown [Mus musculus] | 3e−005 |
| 3735 | U95102 | Xenopus laevis mitotic phosphoprotein 90 mRNA, complete cds | 1e−013 | 2072296 | (U95098) mitotic phosphoprotein 44 [Xenopus laevis] | 2.5 |
| 3736 | U09367 | Human zinc finger protein ZNF136 | 1e−065 | 1731412 | ZINC FINGER PROTEIN 136 human >gi|487785 (U09367) zinc finger protein ZNF136 | 7e−060 |
| 3737 | U95102 | Xenopus laevis mitotic phosphoprotein 90 mRNA, complete cds | 6e−006 | 2507475 | PAIRED AMPHIPATHIC HELIX PROTEIN | 5.8 |
| 3738 | U95102 | Xenopus laevis mitotic phosphoprotein 90 mRNA, complete cds | 0.002 | 3702452 | (X80031) type IV collagen alpha 3 chain | 1.5 |
| 3739 | AF086022 | Homo sapiens full length insert cDNA clone YW23E02 | 3.5 | <NONE> | <NONE> | <NONE> |
| 3740 | U95102 | Xenopus laevis mitotic phosphoprotein 90 mRNA, complete cds | 0.0002 | 2960225 | (AL022120) PPE [Mycobacterium tuberculosis] | 7.4 |
| 3741 | U95102 | Xenopus laevis mitotic phosphoprotein 90 mRNA, complete cds | 2e−006 | <NONE> | <NONE> | <NONE> |
| 3742 | AJ005866 | Homo sapiens mRNA for putative Sqv-7-like protein, partial | e−177 | 4008517 | (AJ005866) Sqv-7-like protein [Homo sapiens] | 9e−045 |
| 3743 | AF043231 | Emericella nidulans cAMP-dependent protein kinase regulatory subunit (pkaR) gene, complete cds | 1.1 | <NONE> | <NONE> | <NONE> |
| 3744 | AB002319 | Human mRNA for KIAA0321 gene, partial cds | 5e−066 | 2224583 | (AB002319) KIAA0321 [Homo sapiens] | 2e−024 |
| 3745 | M33132 | Human proliferating cell nucleolar protein P120 gene, exons 1–15. | 8e−018 | 113668 | !!!! ALU CLASS C WARNING ENTRY !!!! | 0.077 |
| 3746 | U95102 | Xenopus laevis mitotic phosphoprotein | 9e−009 | 2394463 | (AF024498) No definition line found | 1.2 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3747 | Z69944 | 90 mRNA, complete cds S. pombe chromosome I cosmid c1F12. | 4.4 | <NONE> | [Caenorhabditis elegans] <NONE> | <NONE> |
| 3748 | Z81014 | Human DNA sequence from cosmid U65A4, between markers DXS366 and DXS87 on chromosome X * | 4e−022 | 896065 | (U28831) protein that is immuno-reactive with anti-PTH polyclonal antibodies [Homo sapiens] | 0.075 |
| 3749 | U95102 | Xenopus laevis mitotic phosphoprotein 90 mRNA, complete cds | 0.0002 | 3877203 | (Z70780) similar to initiation factor IF-2; cDNA EST CEMSD25F comes from this gene | 4.4 |
| 3750 | U95094 | Xenopus laevis XL-INCENP (XL-INCENP) mRNA, complete cds | 2e−007 | <NONE> | <NONE> | <NONE> |
| 3751 | U95102 | Xenopus laevis mitotic phosphoprotein 90 mRNA, complete cds | 3e−008 | 2065210 | (Y12713) Pro-Pol-dUTPase polyprotein | 2 |
| 3752 | M36072 | Human ribosomal protein L7a (surf 3) large subunit mRNA, complete cds. | 1e−054 | 133014 | 60S RIBOSOMAL PROTEIN L7A (PLA-X POLYPEPTIDE) (SURF-3) >gi\|71116\|pir\|\|R5H U7A ribosomal protein L7a-human >gi\|71117\|pir\|\|R5R T7A ribosomal protein L7a - rat >gi\|34203 (X52138) L7a protein [Homo sapiens] >gi\|35512 (X06705) PLA-X polypeptide [Homo sapiens] | 0.019 |
| 3753 | AB001615 | Homo sapiens DNA for cGMP-binding cGMP-specific phosphodiesterase (PDE5), exon 1 | 6e−006 | <NONE> | <NONE> | <NONE> |
| 3754 | X57103 | Human h-lys gene for lysozyme (upstream region) | 5e−015 | 113670 | !!!! ALU CLASS E WARNING ENTRY !!!! | 3.3 |
| 3755 | L09708 | Homo sapiens complement component 2 (C2) gene allele b, exons 10 through 18 and complete cds | 6e−005 | 1143705 | (X89760) Hox2a gene product [Zea mays] | 9.7 |
| 3756 | X73685 | C. aethiops hsp70 mRNA | 2e−088 | 1322309 | (U55176) heat shock cognate 70.II [Xenopus laevis] | 2e−025 |
| 3757 | Z57594 | H. sapiens CpG DNA, clone 186c5, reverse read cpg186c5.rt1b. | 0.002 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3758 | AF095927 | *Rattus norvegicus* protein phosphatase 2C mRNA, complete cds | e−117 | 3777604 | (AF095927) protein phosphatase 2C [*Rattus norvegicus*] | 4e−040 |
| 3759 | U30788 | *Rattus norvegicus* Tclone4 mRNA | 5e−024 | 135576 | LARGE TEGUMENT PROTEIN (VIRION PROTEIN UL36) >gi\|73851\|pir\|\|WMBEH6 UL36 protein - human herpesvirus 1 (strain 17) >gi\|59536\|gnl\|PID\|e312351 1] | 1.6 |
| 3760 | Z96177 | *H. sapiens* telomeric DNA sequence, clone 10QTEL040, read 10QTELOO040.seq | 3e−009 | 1082626 | myosin heavy chain VA - human (fragment) | 5.8 |
| 3761 | M37463 | *E. gracilis* chloroplast ribosomal protein genes rpl23, rpl2, rps19, rpl22, and rps3, complete cds. | 0.38 | 2734883 | (U75311) pyruvate decarboxylase 2 [*Pichia stipitis*] | 3.4 |
| 3762 | AF086241 | *Homo sapiens* full length insert cDNA clone ZD29F04 | 4e−064 | 3702137 | (AL031393) dJ733D15.1 (Zinc-finger protein) [*Homo sapiens*] | 1e−040 |
| 3763 | AF086241 | *Homo sapiens* full length insert cDNA clone ZD29F04 | 4e−064 | 3702137 | (AL031393) dJ733D15.1 (Zinc-finger protein) [*Homo sapiens*] | 1e−040 |
| 3764 | AF008227 | *Drosophila melanogaster* odd Oz product (odz) gene, exons 3, 4, 5, 6, 7, and complete cds | 3.6 | 2661842 | (Y15732) DNA polymerase beta [*Xenopus laevis*] | 2e−020 |
| 3765 | AF039688 | *Homo sapiens* antigen NY—CO-3 (NY—CO-3) mRNA, partial cds | 0 | 3170176 | (AF039688) antigen NY—CO-3 [*Homo sapiens*] | 2e−073 |
| 3766 | AF037332 | *Homo sapiens* Eph-like receptor tyrosine kinase hEpbB1b (EphB1) mRNA, complete cds | 0.37 | 1255919 | (X96511) MAFB protein [*Coturnix japonica*] | 5.6 |
| 3767 | U95094 | *Xenopus laevis* XL-INCENP (XL-INCENP) mRNA, complete cds | 6e−006 | <NONE> | <NONE> | <NONE> |
| 3768 | U95102 | *Xenopus laevis* mitotic phosphoprotein 90 mRNA, complete cds | 0.005 | <NONE> | <NONE> | <NONE> |
| 3769 | U95094 | *Xenopus laevis* XL-INCENP (XL-INCENP) mRNA, complete cds | 3e−010 | <NONE> | <NONE> | <NONE> |
| 3770 | X57103 | Human h-lys gene for lysozyme (upstream region) | 5e−015 | 113670 | !!!! ALU CLASS E WARNING ENTRY !!!! | 3.3 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3771 | U95102 | *Xenopus laevis* mitotic phosphoprotein 90 mRNA, complete cds | 0.0002 | 2947096 | (U81032) TniQ [*Pseudomonas stutzeri*] | 0.86 |
| 3772 | U95102 | *Xenopus laevis* mitotic phosphoprotein 90 mRNA, complete cds | 0.0002 | 2947096 | (U81032) TniQ [*Pseudomonas stutzeri*] | 0.86 |
| 3773 | M84326 | Human ADP-ribosylation factor 1 mRNA, complete cds | 0 | 283748 | collagen alpha 2(I) chain homolog - sea urchin (*Strongylocentrotus purpuratus*) >gi\|161436 purpuratus] | 0.14 |
| 3774 | X82575 | *G. gallus* mRNA for Cnot | 0.39 | 3327136 | (AB014561) KIAA0661 protein [*Homo sapiens*] | 3e-033 |
| 3775 | L43001 | *Bos taurus* guanylyl cyclase-activating protein 2 | 3e-072 | 1730238 | GUANYLATE CYCLASE ACTIVATING PROTEIN 2 (GCAP 2) (RETINAL GUANYLYL CYCLASE ACTIVATOR PROTEIN P24) >gi\|2136762\|pir\|\|A57604 guanylate cyclase-activating protein 2 - bovine >gi\|1002750 cyclase-activating protein 2 [*Bos taurus*] | 1e-030 |
| 3776 | U47322 | Cloning vector DNA, complete sequence. | 7e-007 | 3335349 | (AC004512) Similar to gb\|U46691 putative chromatin structure regulator (SUPT6H) from *Homo sapiens*. ESTs gb\|T42908, gb\|AA586170 and gb\|AA395125 come from this gene. [*Arabidopsis thaliana*] | 9.2 |
| 3777 | L09647 | *Rattus norvegicus* hepatocyte nuclear factor 3a | 2e-069 | 404764 | (L10409) fork head related protein [*Mus musculus*] | 3e-031 |
| 3778 | U72756 | *Lycianthes heteroclita* NADH dehydrogenase subunit protein, partial cds | 0.37 | <NONE> | <NONE> | <NONE> |
| 3779 | M94314 | *Homo sapiens* ribosomal protein L30 mRNA, complete cds | 1e-073 | 3876073 | (Z81505) similar to Zinc finger, C3HC4 type (RING finger); cDNA EST EMBL:D28025 comes from this gene; cDNA EST EMBL:D28024 comes from this gene; cDNA EST EMBL:D33210 comes from this | 1.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3780 | AF053315 | Reporter vector pNFkB-Luc, complete sequence | 9e-019 | 987050 | gene; cDNA EST EMBL:D33441 comes from this . . . (X65335) lacZ gene product [unidentified cloning vector] | 0.3 |
| 3781 | U95094 | *Xenopus laevis* XL-INCENP (XL-INCENP) mRNA, complete cds | 4e-011 | 2072296 | (U95098) mitotic phosphoprotein 44 [*Xenopus laevis*] | 4.5 |
| 3782 | U95094 | *Xenopus laevis* XL-INCENP (XL-INCENP) mRNA, complete cds | 1e-013 | 1695957 | (U78693) NADH dehydrogenase [*Holmskioldia sanguinea*] | 1.9 |
| 3783 | AF074990 | *Homo sapiens* full length insert cDNA YH85A11 | 0.005 | 1881709 | (U89517) polyprotein [Dengue virus type 2] | 9.6 |
| 3784 | U95102 | *Xenopus laevis* mitotic phosphoprotein 90 mRNA, complete cds | 9e-009 | <NONE> | <NONE> | <NONE> |
| 3785 | AF020038 | *Homo sapiens* NADP-dependent isocitrate dehydrogenase (IDH) mRNA, complete cds | 4e-011 | 3647352 | (Z97348) MAL3P1.11 [*Plasmodium falciparum*] | 9.6 |
| 3786 | Z75199 | *S. cerevisiae* chromosome XV reading frame ORF YOR291 w | 8e-028 | 3880560 | (Z70271) Similarity to Yeast E1-E2 ATPase (SW:YED1_YEAST); cDNA EST EMBL:D37634 comes from this gene; cDNA EST EMBL:D34653 comes from this gene; cDNA EST EMBL:D34527 comes from this gene; cDNA EST EMBL:D32311 comes from this . . . | 7e-048 |
| 3787 | U95102 | *Xenopus laevis* mitotic phosphoprotein 90 mRNA, complete cds | 3e-008 | <NONE> | <NONE> | <NONE> |
| 3788 | M86400 | Human phospholipase A2 mRNA, complete cds. > :: gb\|I34404\|I34404 Sequence 8 from U.S. Pat. No. 5597719 | 5e-088 | <NONE> | <NONE> | <NONE> |
| 3789 | X03100 | Human HLA-SB(DP) alpha gene | 0.47 | 3941737 | (AF109719) BAT2 [*Mus musculus*] | 2.4 |
| 3790 | U95094 | *Xenopus laevis* XL-INCENP (XL-INCENP) mRNA, complete cds | 5e-015 | 3043662 | (AB011141) KIAA0569 protein [*Homo sapiens*] | 9.6 |
| 3791 | U95094 | *Xenopus laevis* XL-INCENP (XL-INCENP) mRNA, complete cds | 2e-014 | 2072296 | (U95098) mitotic phosphoprotein 44 [*Xenopus laevis*] | 0.29 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3792 | U95102 | *Xenopus laevis* mitotic phosphoprotein 90 mRNA, complete cds | 4e−012 | 345555 | Ig light chain - rainbow trout (fragment) | 1.1 |
| 3793 | U95094 | *Xenopus laevis* XL-INCENP (XL-INCENP) mRNA, complete cds | 5e−014 | 2072296 | (U95098) mitotic phosphoprotein 44 [*Xenopus laevis*] | 5.6 |
| 3794 | AF064104 | *Homo sapiens* Cdc14B1 phosphatase mRNA, complete cds | 3e−030 | 2662463 | (AF023158) tyrosine phosphatase [*Homo sapiens*] | 1e−008 |
| 3795 | U29348 | *Salmonella enterica* strain s2978 invasion protein SpaO (spaO), SpaP (spaP) and SpaQ (spaQ) genes, complete cds | 0.0005 | 2291118 | (AF016414) No definition line found [*Caenorhabditis elegans*] | 9.6 |
| 3796 | U95102 | *Xenopus laevis* mitotic phosphoprotein 90 mRNA, complete cds | 6e−016 | 2072296 | (U95098) mitotic phosphoprotein 44 [*Xenopus laevis*] | 5.6 |
| 3797 | U95094 | *Xenopus laevis* XL-INCENP (XL-INCENP) mRNA, complete cds | 3e−010 | 1168719 | C6.1A PROTEIN | 0.004 |
| 3798 | U95094 | *Xenopus laevis* XL-INCENP (XL-INCENP) mRNA, complete cds | 2e−006 | 481236 | hypothetical protein - Madagascar periwinkle roseus] | 3.4 |
| 3799 | U95094 | *Xenopus laevis* XL-INCENP (XL-INCENP) mRNA, complete cds | 3e−008 | 423157 | finger protein ZNF33A - human (fragment) | 4.3 |
| 3800 | U95102 | *Xenopus laevis* mitotic phosphoprotein 90 mRNA, complete cds | 4e−012 | 2072296 | (U95098) mitotic phosphoprotein 44 [*Xenopus laevis*] | 5.5 |
| 3801 | U61950 | *Caenorhabditis elegans* cosmid C45E5 | 1.2 | <NONE> | <NONE> | <NONE> |
| 3802 | U95102 | *Xenopus laevis* mitotic phosphoprotein 90 mRNA, complete cds | 3e−008 | 1703028 | CLATHRIN COAT ASSEMBLY PROTEIN AP47 HOMOLOG 2 (CLATHRIN COAT ASSOCIATED PROTEIN AP47 HOMOLOG 2) (GOLGI ADAPTOR AP-1 47 KD PROTEIN HOMOLOG 2) (HA1 47 KD SUBUNIT HOMOLOG 2) (CLATHRIN ASSEMBLY PROTEIN ASSEMBLY PROTEIN COMPL . . . | 9.6 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3803 | M31651 | *Homo sapiens* sex hormone-binding globulin (SHBG) gene, complete cds | 7e−017 | <NONE> | >gi\|2134919\|pir\|A57170 clathri <NONE> | <NONE> |
| 3804 | D00596 | *Homo sapiens* gene for thymidylate synthase, exons 1, 2, 3, 4, 5, 6, 7, complete cds | 6e−038 | <NONE> | <NONE> | <NONE> |
| 3805 | U95102 | *Xenopus laevis* mitotic phosphoprotein 90 mRNA, complete cds | 3e−010 | 2072296 | (U95098) mitotic phosphoprotein 44 [*Xenopus laevis*] | 3.7 |
| 3806 | D45906 | Human mRNA for LIMK-2, complete cds | 4e−096 | <NONE> | <NONE> | <NONE> |
| 3807 | U95098 | *Xenopus laevis* mitotic phosphoprotein 44 mRNA, partial cds | 2e−006 | <NONE> | <NONE> | <NONE> |
| 3808 | U95102 | *Xenopus laevis* mitotic phosphoprotein 90 mRNA, complete cds | 0.004 | <NONE> | <NONE> | <NONE> |
| 3809 | AF045798 | *Xenopus laevis* gremlin mRNA, complete cds | 0.36 | 3551167 | (AB012131) Ich1 [*Coprinus cinereus*] | 4.1 |
| 3810 | D78275 | Human mRNA for proteasome subunit p42, complete cds | 8e−019 | 1709804 | 26S PROTEASE REGULATORY SUBUNIT S10B (P44) (CONSERVED ATPASE DOMAIN PROTEIN 44) 26S proteasome regulatory subunit [*Homo sapiens*] | 0.001 |
| 3811 | U95094 | *Xenopus laevis* XL-INCENP (XL-INCENP) mRNA, complete cds | 4e−009 | <NONE> | <NONE> | <NONE> |
| 3812 | U95102 | *Xenopus laevis* mitotic phosphoprotein 90 mRNA, complete cds | 3e−009 | <NONE> | <NONE> | <NONE> |
| 3813 | U95102 | *Xenopus laevis* mitotic phosphoprotein 90 mRNA, complete cds | 9e−014 | 3193162 | (AF067618) No definition line found [*Caenorhabditis elegans*] | 1e−027 |
| 3814 | AF085858 | *Homo sapiens* full length insert cDNA clone YN49B07 | 1e−017 | 3329465 | (AF064553) NSD1 protein [*Mus musculus*] | 4e−007 |
| 3815 | U95102 | *Xenopus laevis* mitotic phosphoprotein 90 mRNA, complete cds | 3e−005 | <NONE> | <NONE> | <NONE> |
| 3816 | U95094 | *Xenopus laevis* XL-INCENP (XL-INCENP) mRNA, complete cds | 0.0003 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3817 | U95102 | *Xenopus laevis* mitotic phosphoprotein 90 mRNA, complete cds | 1e-006 | <NONE> | <NONE> | <NONE> |
| 3818 | U95094 | *Xenopus laevis* XL-INCENP (XL-INCENP) mRNA, complete cds | 2 | <NONE> | <NONE> | <NONE> |
| 3819 | U95094 | *Xenopus laevis* XL-INCENP (XL-INCENP) mRNA, complete cds | 4e-006 | 416673 | ATP SYNTHASE A CHAIN (PROTEIN 6) 3.6.1.34) protein 6 - liverwort (*Marchantia polymorpha*) mitochondrion >gi\|786191 (M68929) atp6 [*Marchantia polymorpha*] | 1.3 |
| 3820 | L14684 | *Rattus norvegicus* nuclear-encoded mitochondrial elongation factor G mRNA, complete cds. | e-115 | 585084 | ELONGATION FACTOR G, MITOCHONDRIAL PRECURSOR (MEF-G) >gi\|543383\|pir\|\|S40780 translation elongation factor G, mitochondrial - rat >gi\|310102 | 5e-038 |
| 3821 | U95094 | *Xenopus laevis* XL-INCENP (XL-INCENP) mRNA, complete cds | 2e-012 | 2072296 | (U95098) mitotic phosphoprotein 44 [*Xenopus laevis*] | 2.2 |
| 3822 | U95094 | *Xenopus laevis* XL-INCENP (XL-INCENP) mRNA, complete cds | 7e-012 | 1665789 | (D87450) Similar to *D. melanogaster* parallel sister chromatids protein [*Homo sapiens*] | 8.5 |
| 3823 | U95094 | *Xenopus laevis* XL-INCENP (XL-INCENP) mRNA, complete cds | 2e-009 | <NONE> | <NONE> | <NONE> |
| 3824 | U95102 | *Xenopus laevis* mitotic phosphoprotein 90 mRNA, complete cds | 3e-015 | 2072296 | (U95098) mitotic phosphoprotein 44 [*Xenopus laevis*] | 2.2 |
| 3825 | L48489 | *Homo sapiens* N-acetylglucosaminyltransferase III | 1e-038 | 728831 | !!!! ALU SUBFAMILY J WARNING ENTRY | 1e-008 |
| 3826 | U95102 | *Xenopus laevis* mitotic phosphoprotein 90 mRNA, complete cds | 8e-008 | <NONE> | <NONE> | <NONE> |
| 3827 | U95102 | *Xenopus laevis* mitotic phosphoprotein 90 mRNA, complete cds | 1e-014 | 2072296 | (U95098) mitotic phosphoprotein 44 [*Xenopus laevis*] | 2.9 |
| 3828 | U95102 | *Xenopus laevis* mitotic phosphoprotein 90 mRNA, complete cds | 1e-011 | 2072296 | (U95098) mitotic phosphoprotein 44 [*Xenopus laevis*] | 1.4 |
| 3829 | AB012162 | *Homo sapiens* mRNA for APC 2 protein, complete | 1e-017 | 3894265 | (AB012162) APC 2 protein [*Homo sapiens*] | 0.45 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3830 | U95094 | *Xenopus laevis* XL-INCENP (XL-INCENP) mRNA, complete cds | 6e-010 | 1723680 | HYPOTHETICAL 14.1 KD PROTEIN IN UPF3-SMD1 INTERGENIC REGION >gi\|2132599\|pir\|\|S 64368 probable membrane protein YGR073c - yeast (*Saccharomyces cerevisiae*) >gi\|1323101\|gnl\|PI D\|e243468 (Z72858) ORF YGR073c [*Saccharomyccs cerevisiae*] | 1.3 |
| 3831 | S54914 | bup = 5' of bmi-1 proviral insertion locus [mice, Genomic/mRNA, 2022 nt] | e-140 | 265569 | (S54914) bup = 5' of bmi-1 proviral insertion locus [mice, Peptide, 195 aa] [*Mus* sp.] | 2e-059 |
| 3832 | U95102 | *Xenopus laevis* mitotic phosphoprotein 90 mRNA, complete cds | 2e-009 | <NONE> | <NONE> | <NONE> |
| 3833 | U95094 | *Xenopus laevis* XL-INCENP (XL-INCENP) mRNA, complete cds | 2e-012 | <NONE> | <NONE> | <NONE> |
| 3834 | U95102 | *Xenopus laevis* mitotic phosphoprotein 90 mRNA, complete cds | 1e-015 | 2072296 | (U95098) mitotic phosphoprotein 44 [*Xenopus laevis*] | 2.9 |
| 3835 | U95094 | *Xenopus laevis* XL-INCENP (XL-INCENP) mRNA, complete cds | 4e-007 | 1805270 | (U81983) endothelial PAS domain protein 1 [*Mus musculus*] | 6.6 |
| 3836 | <NONE> | <NONE> | <NONE> | <NONE> | <NONE> | <NONE> |
| 3837 | X92814 | *H. sapiens* mRNA for rat HREV107-like protein | 1e-032 | 1709969 | H-REV 107 PROTEIN | 3e-013 |
| 3838 | U95094 | *Xenopus laevis* XL-INCENP (XL-INCENP) mRNA, complete cds | 1e-011 | 2183251 | (AF002227) putative polyprotein [border disease virus strain C413] | 0.015 |
| 3839 | U95102 | *Xenopus laevis* mitotic phosphoprotein 90 mRNA, complete cds | 1e-009 | 1142660 | (U23502) POM1 [*Plasmodium chabaudi chabaudi*] | 7.3 |
| 3840 | U95102 | *Xenopus laevis* mitotic phosphoprotein 90 mRNA, complete cds | 4e-012 | 2072296 | (U95098) mitotic phosphoprotein 44 [*Xenopus laevis*] | 3.3 |
| 3841 | U47322 | Cloning vector DNA, complete sequence. | 2e-058 | 224398 | ORF [Simian virus 40] | 4e-005 |
| 3842 | U95094 | *Xenopus laevis* XL-INCENP (XL-INCENP) mRNA, complete cds | 2e-012 | 2072296 | (U95098) mitotic phosphoprotein 44 [*Xenopus laevis*] | 2.9 |
| 3843 | U95102 | *Xenopus laevis* mitotic phosphoprotein | 1e-011 | 2072296 | (U95098) mitotic phosphoprotein 44 [*Xenopus laevis*] | 3.3 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3844 | Y15059 | 90 mRNA, complete cds *Homo sapiens* hng/RC3 gene, exons 2, 3 & 4 | 0.053 | <NONE> | <NONE> | <NONE> |
| 3845 | X99330 | *R. norvegicus* mRNA for IP63 protein | 2e-027 | <NONE> | <NONE> | <NONE> |
| 3846 | AF100303 | *Caenorhabditis elegans* cosmid Y7G10A | 0.53 | <NONE> | <NONE> | <NONE> |
| 3847 | <NONE> | <NONE> | <NONE> | <NONE> | <NONE> | <NONE> |
| 3848 | AF040094 | *Mus musculus* inositol polyphosphate 5-phosphatase II (INPP5P) mRNA, complete cds | 0.15 | <NONE> | <NONE> | <NONE> |
| 3849 | Y15724 | *Homo sapiens* SERCA3 gene, exons 1-7 (and joined CDS) | 2e-013 | <NONE> | <NONE> | <NONE> |
| 3850 | AB011144 | *Homo sapiens* mRNA for KIAA0572 protein, partial cds | 0 | 3043668 | (AB011144) KIAA0572 protein [*Homo sapiens*] | 1e-080 |
| 3851 | AF020762 | *Homo sapiens* clone 1400 unknown protein mRNA, partial cds | 0 | 2738927 | (AF020762) unknown protein [*Homo sapiens*] | 2.8 |
| 3852 | Z99706 | Human DNA sequence from cosmid U226D1 on chromosome X. Contains STS, complete sequence [*Homo sapiens*] | 0.0002 | <NONE> | <NONE> | <NONE> |
| 3853 | M73700 | Human neutrophil lactoferrin mRNA, complete cds and 5' promoter region. | 0.0002 | <NONE> | <NONE> | <NONE> |
| 3854 | D31793 | Human CD40 ligand (CD40L) gene, 5' flanking region and exon 1 | 0.046 | <NONE> | <NONE> | <NONE> |
| 3855 | U16300 | Human lysyl hydroxylase (PLOD) gene, intron 9, complete sequence. | 0.0002 | 126363 | LAMININ ALPHA-1 CHAIN PRECURSOR precursor - human | 0.18 |
| 3856 | U61241 | *Homo sapiens* p47-phox pseudogene, clone P41, exon 1 | 0.14 | <NONE> | <NONE> | <NONE> |
| 3857 | D37791 | Mouse mRNA for beta-1,4-galactosyltransferase | e-105 | 3880102 | (Z93390) similar to FYVE zinc finger; cDNA EST yk26564.5 comes from this gene; cDNA EST yk359g9.5 comes from this gene; cDNA EST yk319c2.5 comes from this gene [*Caenorhabditis elegans*] zinc finger; cDNA EST | 3e-021 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | yk26564.5 comes from this gene; cDNA EST yk359g9 | |
| 3858 | Z57667 | *H. sapiens* CpG DNA, clone 18a8, reverse read cpg18a8.rt1b. | 1.2 | <NONE> | <NONE> | <NONE> |
| 3859 | U95102 | *Xenopus laevis* mitotic phosphoprotein 90 mRNA, complete cds | 2e-014 | 2879809 | (AJ223320) trp-like protein [*Loligo forbesi*] | 1.5 |
| 3860 | U22296 | *Rattus norvegicus* casein kinase 1 gamma 1 isoform mRNA, complete cds | e-126 | 3024053 | CASEIN KINASE I, GAMMA 1 ISOFORM kinase 1 gamma 1 isoform [*Rattus norvegicus*] | 1e-061 |
| 3861 | U95094 | *Xenopus laevis* XL-INCENP (XL-INCENP) mRNA, complete cds | 5e-014 | 113669 | !!!! ALU CLASS D WARNING ENTRY !!!! | 2.6 |
| 3862 | U95102 | *Xenopus laevis* mitotic phosphoprotein 90 mRNA, complete cds | 3e-009 | <NONE> | <NONE> | <NONE> |
| 3864 | U95102 | *Xenopus laevis* mitotic phosphoprotein 90 mRNA, complete cds | 1e-010 | <NONE> | <NONE> | <NONE> |
| 3865 | U95102 | *Xenopus laevis* mitotic phosphoprotein 90 mRNA, complete cds | 1e-011 | 3182957 | CGMP-INHIBITED 3',5'-CYCLIC PHOSPHODIEST ERASE B (CYCLIC GMP INHIBITED PHOSPHODIEST ERASE B) (CGI-PDE B) (CGIPDE1). phophodiesterase-human >gi\|1145302 (U38178) cyclic nucleotide phophodiesterase [*Homo sapiens*] 3B [*Homo sapiens*] | 4.4 |
| 3866 | AF099004 | *Caenorhabditis elegans* cosmid C07D2 | 0.2 | <NONE> | <NONE> | <NONE> |
| 3867 | Z23091 | *H. sapiens* GPV gene encoding platelet glycoprotein V precursor | 5e-013 | 728836 | !!!! ALU SUBFAMILY SP WARNING ENTRY | 0.82 |
| 3868 | U95094 | *Xenopus laevis* XL-INCENP (XL-INCENP) mRNA, complete cds | 3e-007 | 2291255 | (AF016430) weak similarity to *Bacillus subtillis* spore coat protein precursor (GB: L42066) and *Dictyostelium discoideum* calcium binding protein (NID: g426313) in proline-rich | 8.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3869 | U58739 | *Caenorhabditis elegans* cosmid F28C10. | 0.33 | <NONE> | regions [*Caenorhabditis elegans*] <NONE> | <NONE> |
| 3870 | L48473 | *Homo sapiens* (subclone7_e11 from PI H16) DNA sequence. | 3e-008 | <NONE> | <NONE> | <NONE> |
| 3871 | U95097 | *Xenopus laevis* mitotic phosphoprotein 43 mRNA, partial cds | 0.015 | <NONE> | <NONE> | <NONE> |
| 3872 | Z73360 | Human DNA sequence from cosmid 92M18, BRCA2 gene region chromosome 13q12-13. | 4e-020 | <NONE> | <NONE> | <NONE> |
| 3873 | Z71572 | *O. aries* DNA for immunoglobulin joining regions | 1.2 | 1699130 | (U80027) weak similarity to *Arabadopsis thaliana* phytochrome E (PIR: S41912) [*Caenorhabditis elegans*] | 6.1 |
| 3874 | U95102 | *Xenopus laevis* mitotic phosphoprotein 90 mRNA, complete cds | 6e-010 | 2072296 | (U95098) mitotic phosphoprotein 44 [*Xenopus laevis*] | 1.7 |
| 3875 | AB018263 | *Homo sapiens* mRNA for KIAA0720 protein, partial cds | 1.2 | 107240 | oncogene 1 (tre-2 locus) (clone 210) - human | 0.049 |
| 3876 | U87998 | *Mus musculus* cyclin G1 gene, partial cds | 0.14 | <NONE> | <NONE> | <NONE> |
| 3877 | AE001408 | *Plasmodium falciparum* chromosome 2, section 45 of 73 of the complete sequence | 1.8 | <NONE> | <NONE> | <NONE> |
| 3878 | AF061244 | *Agrocybe aegerita* B type DNA polymerase (Mtpol) gene, complete cds; tRNA-Asn gene, complete sequence; and unknown genes, mitochondrial genes for mitochondrial products | 0.16 | 3153241 | (AF053004) class I cytokine receptor [*Homo sapiens*] | 5.8 |
| 3879 | M73047 | *Homo sapiens* tripeptidyl peptidase II mRNA, complete cds. | 3e-028 | 136107 | TRIPEPTIDYL-PEPTIDASE II (TPP II) tripeptidyl-peptidase II (EC 3.4.14.10) - human *sapiens*] | 0.35 |
| 3880 | AB011393 | *Suncus murinus* mitochondrial DNA, D-loop region, partial sequence, isolate | 0.17 | 107422 | proline-rich protein PRB3S (cys) - human | 0.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3881 | X69951 | TKU-M205 *H. sapiens* gene for casein kinase II alpha subunit> subunit alpha [human, Genomic, 18862 nt] | 1e-008 | 113668 | !!!! ALU CLASS C WARNING ENTRY !!!! | 0.54 |
| 3882 | U54558 | Human translation initiation factor eIF3 p66 subunit mRNA, complete cds | 3e-018 | <NONE> | <NONE> | <NONE> |
| 3883 | AB012259 | *Homo sapiens* DNA, anonymous heat-stable fragment RP12-8 | 5e-012 | <NONE> | <NONE> | <NONE> |
| 3884 | U44130 | *Xenopus laevis* p58mRNA, partial cds | 0.15 | 3873716 | (Z74026) similar to 1-aminocyclopropane-1-carboxylate synthase; cDNA EST EMBL: D34239 comes from this gene; cDNA EST EMBL: D35575 comes from this gene; cDNA EST EMBL: D64242 comes from this gene; cDNA EST EMBL: D67126 comes from . . . 1-aminocyclopropane-1-carbo | 5.3 |
| 3885 | AB007917 | *Homo sapiens* mRNA for KIAA0448 protein, complete cds | 0.006 | <NONE> | <NONE> | <NONE> |
| 3886 | AJ223824 | *Lycopersicon esculentum* cv Red River unknown sequence PCR random amplified RAPD band 9 | 0.045 | <NONE> | <NONE> | <NONE> |
| 3887 | U47322 | Cloning vector DNA, complete sequence. | 3e-008 | 2183251 | (AF002227) putative polyprotein [border disease virus strain C413] | 0.67 |
| 3888 | U95102 | *Xenopus laevis* mitotic phosphoprotein 90 mRNA, complete cds | 4e-006 | <NONE> | <NONE> | <NONE> |
| 3889 | U67564 | *Methanococcus jannaschii* section 106 of 150 of the complete genome | 1.3 | 2920535 | (AF018081) type XVIII collagen [*Homo sapiens*] | 0.73 |
| 3890 | AE000720 | *Aquifex aeolicus* section 52 of 109 of the complete genome | 1.3 | <NONE> | <NONE> | <NONE> |
| 3891 | AB011230 | *Zaglossus bruijni* mitochondrial gene for NADH dehydrogenase subunit 1, partial cds | 3.6 | <NONE> | <NONE> | <NONE> |
| 3892 | Z96177 | *H. sapiens* | 1e-042 | 987050 | (X65335) lacZ | 0.0001 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | telomeric DNA sequence, clone 10QTEL040, read 10QTELOO040.seq | | | gene product [unidentified cloning vector] | |
| 3893 | AF067646 | Cloning vector pCMV-scriptEX, complete sequence | 3e-029 | 987050 | (X65335) lacZ gene product [unidentified cloning vector] | 0.001 |
| 3894 | Z69919 | Human DNA sequence from cosmid 91K3, Huntington's Disease Region, chromosome 4p16.3 contains CpG island. | 3.8 | <NONE> | <NONE> | <NONE> |
| 3895 | X75757 | *G. gallus* cycB3 mRNA. | 6e-036 | 729112 | G2/MITOTIC-SPECIFIC CYCLIN B3 | 4e-013 |
| 3896 | L27833 | *Bos taurus* pregnancy-associated glycoprotein-1 | 0.48 | 854348 | (X87336) DNA endonuclease [*Peperomia polybotrya*] | 7.5 |
| 3897 | U95102 | *Xenopus laevis* mitotic phosphoprotein 90 mRNA, complete cds | 0.14 | 3169059 | (AL023704) weak similarity to *B. subtilis* spore outgrowth factor B [*Schizosaccharomyces pombe*] | 5e-052 |
| 3898 | X64123 | *H. sapiens* PVR gene for poliovirus receptor (exon 8) | 7e-006 | 2444416 | (AF020484) NADH debydrogenase-like protein [*Gleditsia fera*] | 0.55 |
| 3899 | Z81043 | *Caenorhabditis elegans* cosmid C29F3, complete sequence [*Caenorhabditis elegans*] | 0.44 | 266459 | P-SELECTIN PRECURSOR (GRANULE MEMBRANE PROTEIN 140) (GMP-140) (PADGEM) (CD62P) mouse >gi|200553 (M87861) P-selectin [*Mus musculus*] | 1.8 |
| 3900 | AJ001235 | *Papio hamadryas* ERV-9 like LTR insertion | 3e-050 | 3126961 | (AF061747) cell division protein FtsZ homolog | 1.2 |
| 3901 | AE001314 | *Chlamydia trachomatis* section 41 of 87 of the complete genome | 1.2 | <NONE> | <NONE> | <NONE> |
| 3902 | X82895 | *H. sapiens* mRNA for DLG2 | 2e-048 | 3659505 | (AC005084) similar to mouse mCASK-A; similar to e1288039 | 1e-054 |
| 3903 | U95094 | *Xenopus laevis* XL-INCENP (XL-INCENP) mRNA, complete cds | 2c-006 | <NONE> | <NONE> | <NONE> |
| 3904 | U95102 | *Xenopus laevis* mitotic phosphoprotein 90 mRNA, complete cds | 9e-009 | 436923 | (U01849) ORF1 [*Trypanosoma brucei*] | 0.08 |
| 3905 | D88982 | *Clostridium botulinum* DNA for C2 toxin component-I and | 0.38 | 1082769 | RNA helicase A - human | 5.6 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3906 | D50418 | component-II, complete cds Mouse mRNA for AREC3, partial cds | 1e-041 | 2137398 | homeotic protein AREC3 (clone SM) - mouse | 0.044 |
| 3907 | U95094 | *Xenopus laevis* XL-INCENP (XL-INCENP) mRNA, complete cds | 6e-005 | <NONE> | <NONE> | <NONE> |
| 3908 | U95102 | *Xenopus laevis* mitotic phosphoprotein 90 mRNA, complete cds | 2e-007 | 2314677 | (AE000648) cation-transporting ATPase, P-type (copA) | 0.36 |
| 3909 | U72745 | *Dictyostelium discoideum* cysteine proteinase | 0.014 | <NONE> | <NONE> | <NONE> |
| 3910 | AJ011972 | *Homo sapiens* mRNA for histone deacetylase-like protein (JM21) | 3e-081 | <NONE> | <NONE> | <NONE> |
| 3911 | U95094 | *Xenopus laevis* XL-INCENP (XL-INCENP) mRNA, complete cds | 3e-011 | <NONE> | <NONE> | <NONE> |
| 3912 | U95102 | *Xenopus laevis* mitotic phosphoprotein 90 mRNA, complete cds | 0.002 | <NONE> | <NONE> | <NONE> |
| 3913 | AC001032 | *Homo sapiens* (subclone 2_c211 from P1 H48) DNA sequence | 9e-009 | 130402 | RETROVIRUS-RELATED POL POLYPROTEIN | 3.2 |
| 3914 | J04830 | *S. cerevisiae* CBP3 protein gene, complete cds. | 3.3 | <NONE> | <NONE> | <NONE> |
| 3915 | D78572 | House mouse; *Musculus domesticus* mRNA for membrane glycoprotein, complete cds > :: dbj\|E12950\|E12950 cDNA GA3-43 encoding novel polypeptide which appear when differentiate from embryo-tumor cell P19 to nerve cell | 4e-044 | 1545807 | (D78572) membrane glycoprotein [*Mus musculus*] | 1e-020 |
| 3916 | U95094 | *Xenopus laevis* XL-INCENP (XL-INCENP) mRNA, complete cds | 1e-012 | 2072296 | (U95098) mitotic phosphoprotein 44 [*Xenopus laevis*] | 1.1 |
| 3917 | U29923 | Human AMP deaminase (AMPD3) gene, intron 1a and promoter 1b. | 0.04 | 3256504 | (AP000001) 115aa long hypothetical protein [*Pyrococcus horikoshii*] | 0.094 |
| 3918 | Z68327 | Human DNA sequence from cosmid U25D11, between markers DXS366 and | 5e-015 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3919 | U95094 | DXS87 on chromosome X. *Xenopus laevis* XL-INCENP (XL-INCENP) mRNA, complete cds | 1e-013 | <NONE> | <NONE> | <NONE> |
| 3920 | M89955 | Human 5-HTID-type serotonin receptor gene, complete cds. | 0 | 112819 | 5-HYDROXYTRYPTAMINE ID RECEPTOR human >gi\|177772 (M89955) 5-HTID-type serotonin receptor receptor: ISOTYPE = ID-alpha [*Homo sapiens*] | 3e-053 |
| 3921 | U95094 | *Xenopus laevis* XL-INCENP (XL-INCENP) mRNA, complete cds | 2e-008 | 3879698 | (Z78065) predicted using Genefinder | 9.1 |
| 3922 | U95094 | *Xenopus laevis* XL-INCENP (XL-INCENP) mRNA, complete cds | 0.002 | 3184285 | (AC004136) hypothetical protein [*Arabidopsis thaliana*] | 9.5 |
| 3923 | U95094 | *Xenopus laevis* XL-INCENP (XL-INCENP) mRNA, complete cds | 0.005 | 139805 | XFIN PROTEIN >gi\|65234 (X06021) Xfin protein (AA 1-1350) [*Xenopus laevis*] | 1.9 |
| 3924 | U95094 | *Xenopus laevis* XL-INCENP (XL-INCENP) mRNA, complete cds | 4e-012 | <NONE> | <NONE> | <NONE> |
| 3925 | AF013711 | *Homo sapiens* 22 kDa actin-binding protein | 1e-020 | 103509 | I factor 2 (transposon) - fruit fly protein [*Drosophila teissieri*] | 5.5 |
| 3926 | S83526 | red photopigment gene {Alu repeat region, long intron 1} [human, peripheral blood leucocytes, Genomic, 1987 nt] | 7e-006 | <NONE> | <NONE> | <NONE> |
| 3927 | AB011542 | *Homo sapiens* mRNA for MEGF9, partial cds | 0 | 3449310 | (AB011542) MEGF9 [*Homo sapiens*] | 2e-095 |
| 3928 | U95102 | *Xenopus laevis* mitotic phosphoprotein 90 mRNA, complete cds | 2e-006 | <NONE> | <NONE> | <NONE> |
| 3929 | X67312 | *P. pijperi* mitochondrion DNA for Vaccinia virus-like terminal loop structure | 6e-006 | <NONE> | <NONE> | <NONE> |
| 3930 | U95094 | *Xenopus laevis* XL-INCENP (XL-INCENP) mRNA, complete cds | 3e-010 | 3080474 | (AL022602) cell divisin protein FtsW | 1.2 |
| 3931 | U95102 | *Xenopus laevis* mitotic | 4e-006 | 3769486 | (AF074946) DNA polymerase | 1.3 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | phosphoprotein 90 mRNA, complete cds | | | [hemorrhagic enteritis virus] | |
| 3932 | U95102 | *Xenopus laevis* mitotic phosphoprotein 90 mRNA, complete cds | 3e-010 | <NONE> | <NONE> | <NONE> |
| 3933 | U95102 | *Xenopus laevis* mitotic phosphoprotein 90 mRNA, complete cds | 3e-008 | 1890266 | (U88585) NADH-dehydrogenase subunit 1 [*Quedius mesomelinus*] | 4.2 |
| 3934 | Z12112 | pWE15A cosmid vector DNA | 1e-051 | 987050 | (X65335) lacZ gene product [unidentified cloning vector] | 4e-009 |
| 3935 | AF023180 | *Listeria monocytogenes* low temperature requirement A protein (ltrA) gene, complete cds | 0.005 | <NONE> | <NONE> | <NONE> |
| 3936 | D10856 | *D. melanogaster* cyclin A gene | 0.37 | 2315521 | (AF016452) similar to the beta transducin family | 1e-028 |
| 3937 | U95102 | *Xenopus laevis* mitotic phosphoprotein 90 mRNA, complete cds | 9e-009 | 3687507 | (AL031788) C2H2 type zinc finger protein [*Schizosaccharomyces pombe*] | 7.3 |
| 3938 | Z80361 | *H. sapiens* HLA-DRB pseudogene, repeat region; | 2e-078 | <NONE> | <NONE> | <NONE> |
| 3939 | L22551 | *Plasmodium yoelii yoelii* merozoite surface protein 1 gene, 5' end. | 1.2 | <NONE> | <NONE> | <NONE> |
| 3940 | X74178 | *B. taurus* microsatellite DNA INRA153 | 0.005 | 2291118 | (AF016414) No definition line found [*Caenorhabditis elegans*] | 2.5 |
| 3941 | U95094 | *Xenopus laevis* XL-INCENP (XL-INCENP) mRNA, complete cds | 9e-010 | 1354361 | (U52008) Mrp50 [*Streptococcus pyogenes*] | 0.48 |
| 3942 | U41635 | Human OS-9 precurosor mRNA, complete cds | 0.12 | <NONE> | <NONE> | <NONE> |
| 3943 | U95102 | *Xenopus laevis* mitotic phosphoprotein 90 mRNA, complete cds | 1e-011 | <NONE> | <NONE> | <NONE> |
| 3944 | M37470 | Human beta-N-acetylhexosaminidase (HEXB) gene, deletion junction. | 5e-025 | 728832 | !!!! ALU SUBFAMILY SB WARNING ENTRY | 4.3 |
| 3945 | U95094 | *Xenopus laevis* XL-INCENP (XL-INCENP) mRNA, complete cds | 6e-006 | 97885 | salivary agglutinin receptor precursor - *Streptococcus sanguis* | 0.84 |
| 3946 | U95102 | *Xenopus laevis* mitotic phosphoprotein 90 mRNA, complete cds | 3e-010 | 140550 | HYPOTHETICAL 259 KD PROTEIN (ORF 2136) >gi|81341|pir||A05037 hypothetical | 2.5 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | protein 2136 - liverwort (*Marchantia polymorpha*) chloroplast >gi\|11665 | |
| 3947 | L13176 | *Papio anubis* apolipoprotein C-1 gene, partail mRNA. | 0.0005 | <NONE> | <NONE> | <NONE> |
| 3948 | U95102 | *Xenopus laevis* mitotic phosphoprotein 90 mRNA, complete cds | 7e-006 | 580702 | (X74410) fixP gene product [*Azorhizobium caulinodans*] | 2.9 |
| 3949 | X92987 | *B. primigenius* mRNA for coat protein gamma-cop | 2e-036 | 1706000 | COATOMER GAMMA SUBUNIT (GAMMA-COAT PROTEIN) (GAMMA-COP) >gi\|1066165 (X92987) coat protein gamma-cop [*Bos primigenius*] | 2e-008 |
| 3950 | U95102 | *Xenopus laevis* mitotic phosphoprotein 90 mRNA, complete cds | 8e-008 | 223232 | protein src [*Avian sarcoma* virus] | 0.37 |
| 3951 | AF037350 | *Rattus norvegicus* NF-E2-related factor 2 mRNA, complete cds | 1e-013 | 3004573 | (AC004520) similar to NFE2-related transcription factors; similar to I48694 (PID:g2137676) [*Homo sapiens*] | 8e-073 |
| 3952 | AJ011972 | *Homo sapiens* mRNA for histone deacetylase-like protein (JM21) | 8e-092 | <NONE> | <NONE> | <NONE> |
| 3953 | U95094 | *Xenopus laevis* XL-INCENP (XL-INCENP) mRNA, complete cds | 3e-009 | <NONE> | <NONE> | <NONE> |
| 3954 | U95094 | *Xenopus laevis* XL-INCENP (XL-INCENP) mRNA, complete cds | 3e-009 | <NONE> | <NONE> | <NONE> |
| 3955 | U95094 | *Xenopus laevis* XL-INCENP (XL-INCENP) mRNA, complete cds | 3e-009 | 630444 | CR5 protein - *Trypanosoma brucei* >gi\|468424 | 4.3 |
| 3956 | U95094 | *Xenopus laevis* XL-INCENP (XL-INCENP) mRNA, complete cds | 3e-009 | 630444 | CR5 protein - *Trypanosoma brucei* >gi\|468424 | 4.3 |
| 3957 | AF086172 | *Homo sapiens* full length insert cDNA clone ZB89E10 | 9e-062 | 1172991 | 60S RIBOSOMAL PROTEIN L21 sapiens] >gi\|984143 (X89401) ribosomal protein L21 [*Homo sapiens*] >gi\|1096939\|prf\|2 | 9e-024 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3958 | D42084 | Human mRNA for KIAA0094 gene, partial cds | 2e-058 | 1703270 | 113200B ribosomal protein L21 PUTATIVE METHIONINE AMINOPEPTIDASE I (METAP I) (PEPTIDASE M 1) (KIAA0094) product is related to *S. cerevisiae* methionine aminopeptidase. [*Homo sapiens*] | 1e-016 |
| 3959 | AF634755 | *Homo sapiens* microphthalmia-associated transcription factor (MITF) gene, promoter region and partial cds | 2e-005 | <NONE> | <NONE> | <NONE> |
| 3960 | Z96177 | *H. sapiens* telomeric DNA sequence, clone 10QTEL040, read 10QTELOO040.seq | 3e-011 | <NONE> | <NONE> | <NONE> |
| 3961 | U95094 | *Xenopus laevis* XL-INCENP (XL-INCENP) mRNA, complete cds | 1e-012 | 141028 | NADH-UBIQUINONE OXIDOREDUCTASE CHAIN 5 >gi|76351|pir||QQUTC5 NADH dehydrogenase (ubiquinone) | 1.1 |
| 3962 | U93237 | Human menin (MEN1) gene, complete cds | 0.37 | 134853 | TRANSCRIPTION INITIATION PROTEIN SPT5 yeast (*Saccharomyces cerevisiae*) >gi|172680 (M62882) SPT5 protein [*Saccharomyces cerevisiae*] >gi|854480 (Z49810) Spt5p [*Saccharomyces cerevisiae*] | 0.49 |
| 3963 | Z93782 | *Caenorhabditis elegans* cosmid R12G8, complete sequence [*Caenorhabditis elegans*] | 0.008 | 1171084 | A/G-SPECIFIC ADENINE GLYCOSYLASE | 6.5 |
| 3964 | U11270 | Human antithrombin III gene, exon 1 and partial cds. | 2e-023 | 728837 | !!!! ALU SUBFAMILY SQ WARNING ENTRY | 9e-006 |
| 3965 | U951027 | *Xenopus laevis* mitotic phosphoprotein 90 mRNA, complete cds | 8e-007 | 3650488 | (AF042273) signal transducing adaptor molecule 2A [*Homo sapiens*] | 3.6 |
| 3966 | U95094 | *Xenopus laevis* XL-INCENP (XL-INCENP) mRNA, complete cds | 2e-006 | <NONE> | <NONE> | <NONE> |
| 3967 | AF086207 | *Homo sapiens* full length insert cDNA clone | 1e-009 | 1077301 | probable membrane protein YOL101c-yeast | 0.41 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | ZC48C05 | | | similarity with bee NADH-ubiquinone oxidoreductssse chain 2 [*Saccharomyces cerevisiae*] >gi\|1419955\|gnl\|PID\|e252291 | |
| 3968 | U95102 | *Xenopus laevis* mitotic phosphoprotein 90 mRNA, complete cds | 4e-011 | 2072296 | (U95098) mitotic phosphoprotein 44 [*Xenopus laevis*] | 6.2 |
| 3969 | U95094 | *Xenopus laevis* XL-INCENP (XL-INCENP) mRNA, complete cds | 2e-005 | 2274853 | (AJ000502) iron regulatory protein | 0.15 |
| 3970 | U82165 | *Cercopithecus aethiops* transmembrane glycoprotein CD99-cos7 mRNA, partial cds | 2e-015 | 2735010 | (U82166) CD99 type II-COS7 [*Cercopithecus aethiops*] | 0.011 |
| 3971 | U95094 | *Xenopus laevis* XL-INCENP (XL-INCENP) mRNA, complete cds | 0.0002 | <NONE> | <NONE> | <NONE> |
| 3972 | M87680 | Human simple repeat polymorphism. | 3e-040 | 3874946 | (Z79598) cDNA EST EMBL: D34748 comes from this gene; cDNA EST yk218e6.5 comes from this gene; cDNA EST yk244e3.5 comes from this gene; cDNA EST yk248a4.5 comes from this gene; DNA EST yk250a3.5 comes from this gene; cDNA EST . . . | 1e-008 |
| 3973 | U95094 | *Xenopus laevis* XL-INCENP (XL-INCENP) mPNA, complete cds | 3e-010 | 119396 | ENV POLYPROTEIN (COAT POLYPROTEIN) reticuloendotheliosis virus >gi\|61786 (X01455) env-protein (capsid protein) [*Reticuloendotheliosis virus*] >gi\|209712 (K02537) envelope polyprotein [*Avian reticuloendotheliosis virus A*] | 4.6 |
| 3974 | AB011143 | *Homo sapiens* mRNA for KIAA0571 protein, complete cds | e-151 | 1708199 | HSC70-INTERACTTNG PROTEIN | 4e-023 |
| 3975 | AC001050 | *Homo sapiens* (subclone 3_e9 from P1 H55) DNA sequence | 1e-019 | 728831 | !!!! ALU SUBFAMILY J WARNING ENTRY | 3e-006 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3976 | U95094 | *Xenopus laevis* XL-INCENP (XL-INCENP) mRNA, complete cds | 3e-008 | 1077543 | probable membrane protein YDR198c - yeast | 5.9 |
| 3977 | AJ00575 | *Drosophila virilis* mRNA for GAGA factor class B-isoform | 0.056 | <NONE> | <NONE> | <NONE> |
| 3978 | U95102 | *Xenopus laevis* mitotic phosphoprotein 90 mRNA, complete cds | 2e-014 | 478731 | replication protein - *Butyrivibrio fibrisolvens* plasmid pRJF1 >gi\|152515 (M94552) replication protein [Plasmid pRJF1] | 1.5 |
| 3979 | U95094 | *Xenopus laevis* XL-INCENP (XL-INCENP) mRNA, complete cds | 1e-006 | 3319480 | (AF077546) No definition tine found [*Caenorhabditis elegans*] | 6.5 |
| 3980 | U95102 | *Xenopus laevis* mitotic phosphoprotein 90 mRNA, complete cds | 9e-0114 | 2072296 | (U95098) mitotic phosphoprotein 44 [*Xenopus laevis*] | 3 |
| 3981 | AF003350 | *Mus musculus* Npc1 gene, and npc-nih intron containing the MaLR inserted sequence | 4e-007 | 1170261 | OUTER MEMBRANE USHER PROTEIN HIFC PRECURSOR | 6.4 |
| 3982 | U95102 | *Xenopus laevis* mitotic phosphoprotein 90 mRNA, complete cds | 0.001 | <NONE> | <NONE> | <NONE> |
| 3983 | U95102 | *Xenopus laevis* mitotic phosphoprotein 90 mRNA, complete cds | 1e-006 | <NONE> | <NONE> | <NONE> |
| 3984 | U95102 | *Xenopus laevis* mitotic phosphoprotein 90 mRNA, complete cds | 4e-007 | <NONE> | <NONE> | <NONE> |
| 3985 | AB007939 | *Homo sapiens* mRNA for KIAA0470 protein, complete cds | e-163 | 3413902 | (AB007939) KIAA0470 protein [*Homo sapiens*] | 2e-057 |
| 3986 | U95102 | *Xenopus laevis* mitotic phosphoprotein 90 mRNA, complete cds | 2e-010 | 2072296 | (U95098) mitotic phosphoprotein 44 [*Xenopus laevis*] | 2.9 |
| 3987 | U95102 | *Xenopus laevis* mitotic phosphoprotein 90 mRNA, complete cds | 1e-006 | <NONE> | <NONE> | <NONE> |
| 3988 | U95098 | *Xenopus laevis* mitotic phosphoprotein 44 mRNA, partial cds | 1e-006 | <NONE> | <NONE> | <NONE> |
| 3989 | U95094 | *Xenopus laevis* XL-INCENP (XL-INCENP) mRNA, complete cds | 0.008 | 2414527 | (Z99263) hypothetical protein MLCB637.01c [*Mycobacterium leprae*] | 1.3 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 3990 | U95102 | *Xenopus laevis* mitotic phosphoprotein 90 mRNA, complete cds | 0.074 | 464237 | NADH-UBIQUINONE OXIDOREDUCTASE CHAIN 4 | 2.2 |
| 3991 | U95094 | *Xenopus laevis* XL-INCENP (XL-INCENP) mRNA, complete cds | 3e-010 | 3876367 | (Z69360) Weak similarity to *Eimeria* thrombospondin (PIR Acc. No. A45517); cDNA EST EMBL: M89266 comes from this gene; cDNA EST yk295b9.5 comes from this gene [*Caenorhabditis elegans*] *Eimeria* thrombospondin (PIR Acc. No. A45517); cDNA EST EMBL: M89266 comes | 7.7 |
| 3992 | U95102 | *Xenopus laevis* mitotic phosphoprotein 90 mRNA, complete cds | 0.0002 | 400624 | SODIUM- AND CHLORIDE-DEPENDENT GABA TRANSPORTER 2 >gi\|348413\|pir\|\|A45078 gamma-aminobutyric acid transporter protein 2 - rat >gi\|202523 (M95762) GABA transporter [*Rattus norvegicus*] | 0.62 |
| 3993 | U95102 | *Xenopus laevis* mitotic phosphoprotein 90 mRNA, complete cds | 6e-015 | 2072296 | (U95098) mitotic phosphoprotein 44 [*Xenopus laevis*] | 5.9 |
| 3994 | U95102 | *Xenopus laevis* mitotic phosphoprotein 90 mRNA, complete cds | 5e-012 | 2072296 | (U95098) mitotic phosphoprotein 44 [*Xenopus laevis*] | 6.9 |
| 3995 | U95102 | *Xenopus laevis* mitotic phosphoprotein 90 mRNA, complete cds | 3e-008 | 2286159 | (AF007831) glycoprotein H [Human herpesvirus 7] | 6.3 |
| 3996 | U95102 | *Xenopus laevis* mitotic phosphoprotein 90 mRNA, complete cds | 2e-014 | <NONE> | <NONE> | <NONE> |
| 3997 | D16888 | Human HepG2 3' region cDNA, clone hmd2c03 | e-104 | <NONE> | <NONE> | <NONE> |
| 3998 | U00995 | *Rattus norvegicus* TA1 mRNA, complete cds. | 1e-031 | 3639058 | (AF077866) amino acid transporter E16 [*Homo sapiens*] | 1e-050 |
| 3999 | AF037219 | *Homo sapiens* PIX1 mRNA sequence | 5e-013 | 586863 | HYPOTHETICAL 9.2 KD PROTEIN IN RECR-BOFA INTERGENIC REGION >gi\|1075824\|pir\|\|A41869 bofA 5'-region | 2.7 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | hypothetical protein orf74-*Bacillus subtilis subtilis*]>gi\|2632289\|gn1\|PID\|e1181955 (Z99104) yaaL | |
| 4000 | U95102 | *Xenopus laevis* mitotic phosphoprotein 90 mRNA, complete cds | 1e-009 | <NONE> | <NONE> | <NONE> |
| 4001 | U95094 | *Xenopus laevis* XL-INCENP (XL-INCENP) mRNA, complete cds | 6e-015 | <NONE> | <NONE> | <NONE> |
| 4002 | U95094 | *Xenopus laevis* XL-INCENP (XL-INCENP) mRNA, complete cds | 2e-013 | 549734 | HYPOTHETICAL 105.7 KD PROTEIN IN TPK3-PIR1 INTERGENIC REGION >gi\|481105\|pir\|\|S37786 hypothetical protein YKL165c - yeast (*Saccharomyces cerevisiae*) >gi\|407483 (Z26877) unknown [*Saccharomyces cerevisiae*] >gi\|486289 (Z28165) ORF YKL165c | 3e-019 |
| 4003 | U95102 | *Xenopus laevis* mitotic phosphoprotein 90 mRNA, complete cds | 2e-014 | <NONE> | <NONE> | <NONE> |
| 4004 | U95102 | *Xenopus laevis* mitotic phosphoprotein 90 mRNA, complete cds | 9e-008 | 228110 | T cell receptor variable region: SUBUNIT = beta: ISOTYPE = 19 [*Rattus norvegicus*] | 3.6 |
| 4005 | U95094 | *Xenopus laevis* XL-INCENP (XL-INCENP) mRNA, complete cds | 2e-014 | 930045 | (X15332) alpha-1 (III) collagen [*Homo sapiens*] | 0.52 |
| 4006 | U95094 | *Xenopus laevis* XL-INCENP (XL-INCENP) mRNA, complete cds | 1e-010 | 2072296 | (U95098) mitotic phosphoprotein 44 [*Xenopus laevis*] | 6.2 |
| 4007 | U95102 | *Xenopus laevis* mitotic phosphoprotein 90 mRNA, complete cds | 2e-015 | 2960195 | (Y13051) tax [Human T-cell lymphotropic virus type 2b] | 0.68 |
| 4008 | U95102 | *Xenopus laevis* mitotic phosphoprotein 90 mRNA, complete cds | 4e-007 | 3523099 | (AF016271) Ksp-cadherin [*Mus musculus*] | 6.6 |
| 4009 | U95094 | *Xenopus laevis* XL-INCENP (XL-INCENP) mRNA, complete cds | 6e-015 | 2072296 | (U95098) mitotic phosphoprotein 44 [*Xenopus laevis*] | 5.7 |
| 4010 | U95094 | *Xenopus laevis* | 6e-015 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4011 | U95102 | XL-INCENP (XL-INCENP) mRNA, complete cds Xenopus laevis mitotic phosphoprotein 90 mRNA, complete cds | 3e-009 | 2121280 | (AF000270) lipoprotein [Borrelia burgdorferi] | 1.5 |
| 4012 | U95102 | Xenopus laevis mitotic phosphoprotein 90 mRNA, complete cds | 4e-012 | <NONE> | <NONE> | <NONE> |
| 4013 | L20489 | Zea mays NADH dehydrogenase subunit 4 (complex I) (nad4) gene, exon 4. | 3.5 | <NONE> | <NONE> | <NONE> |
| 4014 | U95094 | Xenopus laevis XL-INCENP (XL-INCENP) mRNA, complete cds | 2e-014 | <NONE> | <NONE> | <NONE> |
| 4015 | U95102 | Xenopus laevis mitotic phosphoprotein 90 mRNA, complete cds | 2e-016 | 927407 | (X89858) actin binding protein [Drosophila melanogaster] | 0.02 |
| 4016 | U05659 | Human 17beta-hydroxysteroid dehydrogenase type 3 mRNA, complete cds | 1e-092 | 1169300 | ESTRADIOL 17 BETA-DEHYDROGENA SE 3 DEHYDROGENA SE) >gi\|1085271\|pir\|\|S 43928 17-beta-hydroxysteroid dehydrogenase - human >gi\|531162 hydroxysteroid dehydrogenase: ISOTYPE = 3 [Homo sapiens] | 4e-029 |
| 4017 | U02428 | Cloning vector pDR2, complete sequence | 2e-066 | 987050 | (X65335) lacZ gene product [unidentified cloning vector] | 2e-009 |
| 4018 | U95094 | Xenopus laevis XL-INCENP (XL-INCENP) mRNA, complete cds | 8e-018 | 3979938 | (AL034393) predicted using Genefinder; cDNA EST yk343c12.5 comes from this gene; cDNA EST yk402e12.5 comes from this gene; cDNA EST yk457e8.5 comes from this gene; cDNA EST yk470f2.5 comes from this gene; cDNA EST yk281e3.5 . . . | 7e-009 |
| 4019 | U95102 | Xenopus laevis mitotic phosphoprotein 90 mRNA, complete cds | 9e-009 | <NONE> | <NONE> | <NONE> |
| 4020 | U95102 | Xenopus laevis mitotic phosphoprotein 90 mRNA, | 1e-010 | 804806 | (M13100) unknown protein [Rattus norvegicus] | 5.7 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4021 | U95094 | Xenopus laevis XL-INCENP (XL-INCENP) mRNA, complete cds complete cds | 2e-014 | <NONE> | <NONE> | <NONE> |
| 4022 | U95094 | Xenopus laevis XL-INCENP (XL-INCENP) mRNA, complete cds | 1e-011 | <NONE> | <NONE> | <NONE> |
| 4023 | U49974 | Human mariner2 transposable element, complete consensus sequence | e-124 | 1698455 | (U49974) mariner transposase [Homo sapiens] | 2e-028 |
| 4024 | L31840 | Rattus norvegicus nuclear pore complex protein NUP107 mRNA, complete cds. | e-175 | 1709212 | NUCLEAR PORE COMPLEX PROTEIN NUP107 | 3e-093 |
| 4025 | AB001632 | Homo sapiens DNA for cGMP-binding cGMP-specific phosphodiesterase (PDE5), exon 18 | 7e-007 | <NONE> | <NONE> | <NONE> |
| 4026 | X96401 | H. sapiens mRNA for ROX protein | 8e-070 | <NONE> | <NONE> | <NONE> |
| 4027 | U95102 | Xenopus laevis mitotic phosphoprotein 90 mRNA, complete cds | 0.015 | <NONE> | <NONE> | <NONE> |
| 4028 | U95094 | Xenopus laevis XL-INCENP (XL-INCENP) mRNA, complete cds | 9e-010 | 2072296 | (U95098) mitotic phosphoprotein 44 [Xenopus laevis] | 3.2 |
| 4029 | AJ006064 | Rattus norvegicus mRNA for coronin-like protein | e-124 | 3757680 | (AJ006064) coronin-like protein [Rattus norvegicus] | 2e-091 |
| 4030 | U95094 | Xenopus laevis XL-INCENP (XL-INCENP) mRNA, complete cds | 1e-009 | 1184072 | (U40766) COL-1 [Meloidogyne incognita] | 0.019 |
| 4031 | U95094 | Xenopus laevis XL-INCENP (XL-INCENP) mRNA, complete cds | 0.002 | 231721 | T-CELL SURFACE GLYCOPROTEIN CD8 ALPHA CHAIN PRECURSOR (T-LYMPHOCYTE DIFFERENTIATION ANTIGEN T8/LEU-2) >gi\|38145 (X60223) CD8 alpha chain | 5.8 |
| 4032 | U95102 | Xenopus laevis mitotic phosphoprotein 90 mRNA, complete cds | 1e-009 | <NONE> | <NONE> | <NONE> |
| 4033 | U95098 | Xenopus laevis mitotic phosphoprotein 44 mRNA, partial cds | 0.005 | <NONE> | <NONE> | <NONE> |
| 4034 | U95094 | Xenopus laevis | 4e-011 | 1020391 | (LA8340) alcohol | 1.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | XL-INCENP (XL-INCENP) mRNA, complete cds | | | dehydrogenase [*Methylobacterium extorquens*] | |
| 4035 | U95102 | *Xenopus laevis* mitotic phosphoprotein 90 mRNA, complete cds | 0.0002 | 2291282 | (AF016433) similar to *C. elegans* olfactory receptor ODR-10 (NID: g1235900) [*Caenorhabditis elegans*] | 4.4 |
| 4036 | U95094 | *Xenopus laevis* XL-INCENP (XL-INCENP) mRNA, complete cds | 1e-010 | 478993 | DNA-binding protein TAF-II 250K - fruit fly TATA-binding protein associated factor II 250, TBP associated factor II 250, TAFII250 {C-terminal} | 5e-006 |
| 4037 | U95094 | *Xenopus laevis* XL-INCENP (XL-INCENP) mRNA, complete cds | 1e-011 | 2072296 | (U95098) mitotic phosphoprotein 44 [*Xenopus laevis*] | 4.4 |
| 4038 | X03100 | Human HLA-SB(DP) alpha gene | 2e-025 | <NONE> | <NONE> | <NONE> |
| 4039 | U95094 | *Xenopus laevis* XL-INCENP (XL-INCENP) mRNA, complete cds | 8e-008 | <NONE> | <NONE> | <NONE> |
| 4040 | J03798 | Human autoantigen small nuclear ribonucleoprotein Sm-DmRNA, complete cds. | 2e-048 | 3874988 | (Z74029) Similarity to *C. elegans* alcohol dehydrogenase (WP: C17G10.8); cDNA EST EMBL: D66106 comes from this gene; cDNA EST EMBL: D69117 comes from this gene; cDNA EST EMBL: D69761 comes from this gene; cDNA EST EMBL: C12156 come . . . | 5.6 |
| 4041 | U95102 | *Xenopus laevis* mitotic phosphoprotein 90 mRNA, complete cds | 6e-006 | 2292986 | (AJ000496) cyclic nucleotide-gated channel beta subunit [*Rattus norvegicus*] | 0.5 |
| 4042 | U95102 | *Xenopus laevis* mitotic phosphoprotein 90 mRNA, complete cds | 3e-010 | 2072296 | (U95098) mitotic phosphoprotein 44 [*Xenopus laevis*] | 2.5 |
| 4043 | AF020187 | *Amblyomma americanum* ecdsyteroid receptor | 1.2 | <NONE> | <NONE> | <NONE> |
| 4044 | Z68758 | Human DNA sequence from cosmid cN85E10 on chromosome 22q11.2-qter | 2e-035 | <NONE> | <NONE> | <NONE> |
| 4045 | U95102 | *Xenopus laevis* mitotic phosphopnotein 90 mRNA, complete cds | 8e-008 | 2529632 | (L78917) virion protein [*Rubella virus*] | 4.6 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4046 | U95102 | *Xenopus laevis* mitotic phosphoprotein 90 mRNA, complete cds | 6e-005 | <NONE> | <NONE> | <NONE> |
| 4047 | AB007957 | *Homo sapiens* mRNA, chromosome I specific transcript KIAA0488 | 2e-016 | 728831 | !!!! ALU SUBFAMILY J WARNING ENTRY | 0.063 |
| 4048 | M64716 | Human ribosomal protein S25 mRNA, complete cds. | 3e-082 | 2660720 | (AF029678) PHF1 [*Homo sapiens*] | 7e-013 |
| 4049 | AB002437 | *Homo sapiens* mRNA from chromosome 5q21-22, clone: LI33 | 6e-026 | <NONE> | <NONE> | <NONE> |
| 4050 | Z74893 | *S. cerevisiae* chromosome XV reading frame ORF YOL151w | 0.13 | <NONE> | <NONE> | <NONE> |
| 4051 | U95102 | *Xenopus laevis* mitotic phosphoprotein 90 mRNA, complete cds | 7e-006 | <NONE> | <NONE> | <NONE> |
| 4052 | U43416 | Human replication control protein 1 (PARC1) mRNA, complete cds. | 2e-056 | 728831 | !!!! ALU SUBFAMILY J WARNING ENTRY | 0.007 |
| 4053 | AF042346 | *Homo Sapiens* putative phenylalanyl-tRNA synthetase beta-subunit mRNA, complete cds | 0 | 4104933 | (AF042346) putative phenylalanyl-tRNA synthetase beta-subunit; PheHB [*Homo sapiens*] | e-123 |
| 4054 | <NONE> | <NONE> | <NONE> | <NONE> | <NONE> | <NONE> |
| 4055 | <NONE> | <NONE> | <NONE> | <NONE> | <NONE> | <NONE> |
| 4056 | U95102 | *Xenopus laevis* mitotic phosphoprotein 90 mRNA, complete cds | 3e-009 | 2072296 | (U95098) mitotic phosphoprotein 44 [*Xenopus laevis*] | 5.6 |
| 4057 | U95094 | *Xenopus laevis* XL-INCENP (XL-INCENP) mRNA, complete cds | 0.0005 | 2981221 | (AF053091) eyelid [*Drosophila melanogaster*] | 2.6 |
| 4058 | U95094 | *Xenopus laevis* XL-INCENP (XL-INCENP) mRNA, complete cds | 2e-006 | <NONE> | <NONE> | <NONE> |
| 4059 | U95094 | *Xenopus laevis* XL-INCENP (XL-INCENP) mRNA, complete cds | 8e-007 | <NONE> | <NONE> | <NONE> |
| 4060 | U95094 | *Xenopus laevis* XL-INCENP (XL-INCENP) mRNA, complete cds | 3e-010 | 2072296 | (U95098) mitotic phosphoprotein 44 [*Xenopus laevis*] | 9.6 |
| 4061 | U11081 | Human type 1 vasoactive intestinal peptide receptor (VIRG) gene, exon3. | 0.43 | <NONE> | <NONE> | <NONE> |
| 4062 | X82272 | Human endogenous | 8e-081 | 1196429 | (M14123) pol/env ORF (bases 3878- | 6e-058 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | retrovirus env mRNA | | | 8257) first start codon at 4172; Xxx; putative [Homo sapiens] | |
| 4063 | S61789 | NF1 = neurofibro matosis type 1 {deletion breakpoint, tetrameric STR} [human, neurofibmsarcoma tissue, Genomic Mutant, 698 nt] | 0.0005 | 2494294 | NEUROGENIC LOCUS NOTCH 3 PROTEIN | 4.3 |
| 4064 | U95102 | Xenopus laevis mitotic phosphoprotein 90 mRNA, complete cds | 0.0005 | 3264773 | (AF072439) zinc-finger protein-37; ZFP-37 [Rattus norvegicus] | 3.3 |
| 4065 | U95102 | Xenopus laevis mitotic phosphoprotein 90 mRNA, complete cds | 3e-010 | 2072296 | (U95098) mitotic phosphoprotein 44 [Xenopus laevis] | 4.5 |
| 4066 | U47322 | Cloning vector DNA, complete sequence. | 9e-054 | 2072296 | (U95098) mitotic phosphoprotein 44 [Xenopus laevis] | 0.6 |
| 4067 | U95102 | Xenopus laevis mitotic phosphoprotein 90 mRNA, complete cds | 1e-609 | 2072296 | (U95098) mitotic phosphoprotein 44 [Xenopus laevis] | 3.4 |
| 4068 | U31557 | Ovine adenovirus IVa2 protein gene, DNA polymerase gene, terminal protein gene and 52, 55 kDa protein gene, partial cds | 0.0002 | 3002875 | (AF042104) envelope glycoprotein [Human immunodeficiency virus type 1] | 2.6 |
| 4069 | AL023973 | Human DNA sequence from clone 1033E15 on chromosome 22q13.1-13.2. Contains part of a novel gene, ESTs and a GSS, complete sequence [Homo sapiens] | 7e-017 | 728831 | !!!! ALU SUBFAMILY J WARNING ENTRY | 0.061 |
| 4070 | U95098 | Xenopus laevis mitotic phosphoprotein 44 mRNA, partial cds | 2e-005 | <NONE> | <NONE> | <NONE> |
| 4071 | X07679 | Xenopus laevis XK70A gene for type 1 keratin | 0.39 | 2281044 | (Z95636) laminin alpha 5 chain [Homo sapiens] | 0.9 |
| 4072 | X96886 | H. sapiens spcDNA, clone 2-65 | 5e-014 | <NONE> | <NONE> | <NONE> |
| 4073 | U95098 | Xenopus laevis mitotic phosphoprotein 44 mRNA, partial cds | 9e-008 | <NONE> | <NONE> | <NONE> |
| 4074 | U95098 | Xenopus laevis mitotic phosphoprotein 44 mRNA, partial cds | 6e-005 | 1079278 | activin receptor II STK3 precursor - African clawed frog >gi|260044|bbs|118656 (S49438) aclivin receptor, XAR1 [Xenopus, | 1.3 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4075 | AF097909 | Peptostreptococcus micros fibril-like structure subunit FibA (fibA) gene, complete cds; excreted protein FibB (fibB) gene, partial cds; and unknown gene | 0.046 | <NONE> | oocytes, Peptide, 510 aa] <NONE> | <NONE> |
| 4076 | U95094 | Xenopus laevis XL-INCENP (XL-INCENP) mRNA, complete cds | 4e-010 | <NONE> | <NONE> | <NONE> |
| 4077 | AL009008 | Plasmodium falciparum DNA *** SEQUENCING IN PROGRESS *** from contig 3-58, complete sequence | 0.45 | <NONE> | <NONE> | <NONE> |
| 4078 | L34686 | Serpulina hyodysenteriae flagellar protein | 0.015 | <NONE> | <NONE> | <NONE> |
| 4079 | AJ130718 | Homo sapiens mRNA for glycoprotein-associated amino acid transporter y+LAT1 | 1e-022 | 3582136 | (AB015432) LAT1 (L-1 type amino acid transporter 1) [Rattus norvegicus] | 2e-008 |
| 4080 | X51969 | Cyprinus carpio growth honnone gene | 1.2 | <NONE> | <NONE> | <NONE> |
| 4081 | U95094 | Xenopus laevis XL-INCENP (XL-INCENP) mRNA, complete cds | 3e-010 | 2072296 | (U95098) mitotic phosphoprotein 44 [Xenopus laevis] | 1.2 |
| 4082 | U95094 | Xenopus laevis XL-INCENP (XL-INCENP) mRNA, complete cds | 4e-011 | 2072296 | (U95098) mitotic phosphoprotein 44 [Xenopus laevis] | 3.4 |
| 4083 | L38961 | Human putative transmembrane protein precursor (B5) mRNA, complete cds | 1e-071 | 1174470 | OLIGOSACCHARYL TRANSFERASE STT3 SUBUNIT HOMOLOG (B5) (INTEGRAL MEMBRANE PROTEIN 1) musculus] >gi\|1588285\|prf\|2208301A integral membrane protein [Mus musculus] | 1e-008 |
| 4084 | U95102 | Xenopus laevis mitotic phosphoprotein 90 mRNA, complete cds | 2e-013 | 267449 | HYPOTHETICAL 12.5 KD PROTEIN ZK637.2 IN CHROMOSOME III >gi\|102507\|pir\|S15787 hypothetical protein 1 (cosmid ZK637) - Caenorhabditis elegans Genefinder; cDNA EST yk217b5.3 | 7e-014 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4085 | U95098 | Xenopus laevis mitotic phosphoprotein 44 mRNA, partial cds | 8e-008 | 2072296 | comes from this gene; cDNA EST yk217b5.5 comes from this gene; cDNA EST yk340g12.3 (U95098) mitotic phosphoprotein 44 [Xenopus laevis] | 3.4 |
| 4086 | X77733 | T. aestivum VDAC 1 mRNA. | 0.005 | <NONE> | <NONE> | <NONE> |
| 4087 | U95094 | Xenopus laevis XL-INCENP (XL-INCENP) mRNA, complete cds | 1e-009 | 3123172 | ZINC FINGER PROTEIN 151 (MIZ-1 PROTEIN) >gi\|2230871\|gn1\|PID\|e286602 (Y09723) Miz-1 protein [Homo sapiens] | 2e-010 |
| 4088 | U95102 | Xenopus laevis mitotic phosphoprotein 90 mRNA, complete cds | 1e-010 | 180498 | (M17517) complement H factor [Homo sapiens] | 5.8 |
| 4089 | U95102 | Xenopus laevis mitotic phosphoprotein 90 mRNA, complete cds | 8e-007 | <NONE> | <NONE> | <NONE> |
| 4090 | U24697 | Chironomus samoensis nanos homolog (Cs nos) gene, complete cds. | 0.13 | 3880999 | (AL021492) Y45F10D.11 [Caenorhabditis elegans] | 7e-022 |
| 4091 | U95094 | Xenopus laevis XL-INCENP (XL-INCENP) mRNA, complete cds | 4e-012 | 2072296 | (U95098) mitotic phosphoprotein 44 [Xenopus laevis] | 5.7 |
| 4092 | U81504 | Homo sapiens beta-3A-adaptin subunit of the AP-3 complex mRNA, complete cds | 6e-088 | 2199512 | (U81504) beta-3A-adaptin subunit of the AP-3 complex [Homo sapiens] | 0.0001 |
| 4093 | AF053304 | Homo sapiens mitotic checkpoint component Bub3 | e-108 | 3378104 | (AF047473) testis mitotic checkpoint BUB3 [Homo sapiens] | 3e-024 |
| 4094 | S70431 | type-1 angiotensin II receptor (exons 1 and 2, promoter} [human, peripheral lymphocytes, Genomic, 2853 nt, segment 1 of 2] | 4e-013 | 126295 | LINE-1 REVERSE TRANSCRIPTASE HOMOLOG | 3e-005 |
| 4095 | U95094 | Xenopus laevis XL-INCENP (XL-INCENP) mRNA, complete cds | 4e-013 | <NONE> | <NONE> | <NONE> |
| 4096 | D10355 | Human mRNA for alanine aminotransferase | 3e-082 | 111345 | alanine transaminase (EC 2.6.1.2) - rat | 4e-042 |
| 4097 | AF043252 | Homo sapiens mitochondrial outer membrane protein (Tom40) | e-167 | 3941342 | (AF043250) mitochondrial outer membrane protein [Homo | 7e-013 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | gene, nuclear gene encoding mitochondrial protein, exons 7, 8 and 9 | | | sapiens] >gi\|3941347 (AF043253) mitochondrial outer membrane protein [Homo sapiens] >gi\|4105703 (AF050154) D19S1177E [Homo sapiens] | |
| 4098 | U41668 | Human deoxyguanosine kinase mRNA, complete cds | e-125 | 2833282 | DEOXYGUANOSINE KINASE PRECURSOR sapiens] | 2e-009 |
| 4099 | AF017416 | Bacillus thuringiensis d-endotoxin gene, complete cds | 0.14 | <NONE> | <NONE> | <NONE> |
| 4100 | U95102 | Xenopus laevis mitotic phosphoprotein 90 mRNA, complete cds | 1e-008 | <NONE> | <NONE> | <NONE> |
| 4101 | AF017416 | Bacillus thuringiensis d-endotoxin gene, complete cds | 0.14 | <NONE> | <NONE> | <NONE> |
| 4102 | U95102 | Xenopus laevis mitotic phosphoprotein 90 mRNA, complete cds | 1e-008 | <NONE> | <NONE> | <NONE> |
| 4103 | AJ003081 | Homo sapiens repetitive DNA | 5e-024 | <NONE> | <NONE> | <NONE> |
| 4104 | U95102 | Xenopus laevis mitotic phosphoprotein 90 mRNA, complete cds | 8e-007 | <NONE> | <NONE> | <NONE> |
| 4105 | U95102 | Xenopus laevis mitotic phosphoprotein 90 mRNA, complete cds | 7e-006 | 1572756 | (U70848) C43G2.1 gene product [Caenorhabditis elegans] | 4e-038 |
| 4106 | U33915 | Craterostigma plantagineum myb-related transcription factor (cpm 10) gene, complete cds | 0.14 | <NONE> | <NONE> | <NONE> |
| 4107 | U46493 | Cloning vector pFlp recombinase gene, complete cds | 5e-033 | 987050 | (X65335) lacZ gene product [unidentified cloning vector] | 0.004 |
| 4108 | U95102 | Xenopus laevis mitotic phosphoprotein 90 mRNA, complete cds | 1e-009 | 3417298 | (AC002044) Alpha-fetoprotein enhancer binding protein (3' partial) [Homo sapiens] | 0.33 |
| 4109 | M16039 | Dictyostelium discoideum pst-cath gene encoding pst-cathepsin, complete cds. | 0.0002 | <NONE> | <NONE> | <NONE> |
| 4110 | D21851 | Human mRNA for KIAA0028 gene, partial cds | 6e-005 | <NONE> | <NONE> | <NONE> |
| 4111 | U95094 | Xenopus laevis XL-INCENP (XL-INCENP) mRNA, complete | 7e-007 | 1723920 | HYPOTHETICAL 37.4 KD PROTEIN IN SEC27-SSM1B | 8e-006 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | cds | | | INTERGENIC REGION >gi|2131603|pir||S64149 hypothetical protein YGL136c - yeast (*Saccharomyces cerevisiae*) >gi|1246842|gnl|PID|e210737 (X92670) G2830 | |
| 4112 | X75861 | *H. sapiens* TEGT gene | e-180 | 2072296 | (U95098) mitotic phosphoprotein 44 [*Xenopus laevis*] | 2.6 |
| 4113 | U95094 | *Xenopus laevis* XL-INCENP (XL-INCENP) mRNA, complete cds | 8e-008 | 1399962 | (U62317) choline kinase isolog 384D8_3 [*Homo sapiens*] | 0.67 |
| 4114 | Y07660 | *M. tuberculosis* accBC gene | 2e-059 | 465847 | HYPOTHETICAL 66.5 KD PROTEIN F02A9.5 IN CHROMOSOME III >gi|280542|pir||S28313 hypothetical protein F02A9.5 - *Caenorhabditis elegans* Genefinder; similar to Propionyl-CoA carboxylase beta chain; cDNA EST EMBL: M89018 comes from this gene; cDNA EST EMBL: D2806 | 4e-056 |
| 4115 | U95102 | *Xenopus laevis* mitotic phosphoprotein 90 mRNA, complete cds | 0.014 | 765086 | (D30786) feline CD9 [*Felis catus*] | 1.9 |
| 4116 | D29011 | Human mRNA for proteasome subunit X, complete cds | e-125 | 2136006 | proteasome subunit MB1 - human (fragment) MB1 = LMP7 homolog [human, JY T-cells, Peptide Partial, 215 aa] [*Homo sapiens*] | 4e-008 |
| 4117 | U95094 | *Xenopus laevis* XL-INCENP (XL-INCENP) mRNA, complete cds | 4e-012 | 2072296 | (U95098) mitotic phosphoprotein 44 [*Xenopus laevis*] | 6.2 |
| 4118 | Z11692 | *H. sapiens* mRNA for elongation factor2 | e-178 | 119172 | ELONGATION FACTOR 2 (EF-2) eEF-2 - human >gi|31106 (X51466) elongation factor 2 factor 2 [*Homo sapiens*] | 6e-054 |
| 4119 | AF070530 | *Homo sapiens* clone 24751 unknown mRNA | 0 | 3387886 | (AF070530) unknown [*Homo sapiens*] | 4e-013 |
| 4120 | D12646 | Mouse kif4 mRNA for microtubule-based motor protein KIF4, | 6e-057 | 1170659 | KINESIN-LIKE PROTEIN KIF4 *musculus*] | 2e-022 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4121 | U95094 | Xenopus laevis XL-INCENP (XL-INCENP) mRNA, complete cds | 1e-009 | <NONE> | <NONE> | <NONE> |
| 4122 | X75861 | H. sapiens TEGT gene | e-180 | 2072296 | (U95098) mitotic phosphoprotein 44 [Xenopus laevis] | 2.6 |
| 4123 | U95094 | Xenopus laevis XL-INCENP (XL-INCENP) mRNA, complete cds | 4e-012 | 630864 | LRR47 protein - fruit fly (Drosophila melanogaster) >gi\|415947 (X75760) LRR47 [Drosophila melanogaster] | 0.0002 |
| 4124 | U95102 | Xenopus laevis mitotic phosphoprotein 90 mRNA, complete cds | 5e-014 | 3876775 | (Z81077) predicted using Genefinder; Similarity to Yeast protein 8248 (TR:G587531) | 1e-015 |
| 4125 | U95102 | Xenopus laevis mitotic phosphoprotein 90 mRNA, complete cds | 2e-008 | 480516 | transposase (clone 22.5) - African malaria mosquito transposon mariner (fragment) >gi\|159600 | 2.8 |
| 4126 | U95102 | Xenopus laevis mitotic phosphoprotein 90 mRNA, complete cds | 8e-008 | <NONE> | <NONE> | <NONE> |
| 4127 | X65279 | pWE15 cosmid vector DNA | 2e-066 | 987050 | (X65335) lacZ gene product [unidentified cloning vector] | 4e-015 |
| 4128 | U95094 | Xenopus laevis XL-INCENP (XL-INCENP) mRNA, complete cds | 4e-012 | 2072296 | (U95098) mitotic phosphoprotein 44 [Xenopus laevis] | 3.8 |
| 4129 | U95094 | Xenopus laevis XL-INCENP (XL-INCENP) mRNA, complete cds | 3e-008 | <NONE> | <NONE> | <NONE> |
| 4130 | U95094 | Xenopus laevis XL-INCENP (XL-INCENP) mRNA, complete cds | 3e-008 | <NONE> | <NONE> | <NONE> |
| 4131 | X74871 | H. sapiens gene for RNA pol II largest subunit, exons 20–22 | 1.1 | 1182038 | (Z69368) unknown [Schizosaccharomyces pombe] | 0.86 |
| 4132 | M64983 | Human fibrinogen beta chain gene, complete mRNA. > gb\|147706\|147706 Sequence 3 from U.S. Pat. No. 5639940 | 0.23 | <NONE> | <NONE> | <NONE> |
| 4133 | D12646 | Mouse kif4 mRNA for microtubule-based motor protein KIF4, complete cds | 6e-057 | 1170659 | KINESIN-LIKE PROTEIN KIF4 musculus] | 2e-022 |
| 4134 | D86957 | Human mRNA for KIAA0202 | 1.1 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4135 | U95094 | gene, partial cds *Xenopus laevis* XL-INCENP (XL-INCENP) mRNA, complete cds | 7e-006 | <NONE> | <NONE> | <NONE> |
| 4136 | M20902 | Human apolipoprotein C-I (VLDL) gene, complete cds. | 4e-008 | <NONE> | <NONE> | <NONE> |
| 4137 | L36849 | Cloning vector pZEO (isolate SV1) phleomycin/zeocin-binding protein gene, complete cds. | 9e-040 | 987050 | (X65335) lacZ gene product [unidentified cloning vector] | 9e-007 |
| 4138 | X80910 | *H. sapiens* PPP1CB mRNA | 0 | <NONE> | <NONE> | <NONE> |
| 4139 | M77812 | Rabbit myosin heavy chain mRNA, complete cds. | 0.0002 | 2088793 | (AF003150). similar to cuticular collagen [*Caenorhabditis elegans*] | 0.23 |
| 4140 | U41165 | Human recombination 'hot spot' region associated with the CMT1A duplication and the HNPP deletion containing a mariner transposon-like element | 0.13 | <NONE> | <NONE> | <NONE> |
| 4141 | U95094 | *Xenopus laevis* XL-INCENP (XL-INCENP) mRNA, complete cds | 0.0006 | <NONE> | <NONE> | <NONE> |
| 4142 | AC001502 | *Homo sapiens* (subclone 2_c7 from P1 H43) DNA sequence | 0.014 | 3164130 | (D78600) cytochrome P450 monooxygenase | 7.5 |
| 4143 | U95102 | *Xenopus laevis* mitotic phosphoprotein 90 mRNA, complete cds | 2e-005 | <NONE> | <NONE> | <NONE> |
| 4144 | <NONE> | <NONE> | <NONE> | <NONE> | <NONE> | <NONE> |
| 4145 | L31760 | Human STS UT8178. | 0.17 | <NONE> | <NONE> | <NONE> |
| 4146 | U95094 | *Xenopus laevis* XL-INCENP (XL-INCENP) mRNA, complete cds | 5e-013 | <NONE> | <NONE> | <NONE> |
| 4147 | U95102 | *Xenopus laevis* mitotic phosphoprotein 90 mRNA, complete cds | 0.0006 | 2662587 | (AF036696) contains similarity to *Brassica oleracea* non-green plastid phosphate/triose-phosphate translocator precursor (GB: U13632) [*Caenorhabditis elegans*] | 2e-016 |
| 4148 | X56807 | Human DSC2 mRNA for desmocollins type 2a and 2b | 6e-037 | 319943 | desmocollin 3b precursor - human | 7e-014 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4149 | U95102 | *Xenopus laevis* mitotic phosphoprotein 90 mRNA, complete cds | 1e-012 | <NONE> | <NONE> | <NONE> |
| 4150 | U95102 | *Xenopus laevis* mitotic phosphoprotein 90 mRNA, complete cds | 2e-005 | 2854155 | (AF045640) contains similarity to ion channel proteins | 3.4 |
| 4151 | U95102 | *Xenopus laevis* mitotic phosphoprotein 90 mRNA, complete cds | 3e-010 | 2507153 | VACUOLAR PROTEIN SORTING-ASSOCIATED PROTEIN VPS16 >gi\|2133204\|pir\|\|S 62031 vacuolar protein sorting-associated protein VPS16 - yeast (*Saccharomyces cerevisiae*) >gi\|1171414 (U44030) Vsp16p: Vacuolar sorting protein [*Saccharomyces cerevisiae*] | 0.011 |
| 4152 | D12646 | Mouse kif4 mRNA for microtubule-based motor protein KIF4, complete cds | 2e-035 | 3877579 | (Z82271) Similarity to Mouse kinensin-like protein KIF4 (SW:P33174); cDNA EST EMBL: D27320 comes from this gene; cDNA EST EMBL: D27322 comes from this gene; cDNA EST EMBL: D27321 comes from this gene; cDNA EST EMBL: D35764 comes ... Mouse kinensin-like protein | 2e-054 |
| 4153 | D12646 | Mouse kif4 mRNA for microtubule-based motor protein KIF4, complete cds | 2e-035 | 3877579 | (Z82271) Similarity to Mouse kinensin-like protein KIF4 (SW: P33174); cDNA EST EMBL: D27320 comes from this gene; cDNA EST EMBL: D27322 comes from this gene; cDNA EST EMBL: D27321 comes from this gene; cDNA EST EMBL: D35764 comes ... Mouse kinensin-like protein | 2e-054 |
| 4154 | D12646 | Mouse kif4 mRNA for microtubule-based motor protein KIF4, complete cds | 2e-035 | 3877579 | (Z82271) Similarity to Mouse kinensin-like protein KIF4 (SW: P33174); cDNA EST EMBL: D27320 comes from this | 9e-058 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | gene; cDNA EST EMBL: D27322 comes from this gene; cDNA EST EMBL: D27321 comes from this gene; cDNA EST EMBL: D35764 comes . . . kinensin-like protein KIF4 | |
| 4155 | M30539 | Human SK2c-Ha-ras-1 oncogene-encoded protein gene, exon 1. | 0.13 | 137334 | 66 KD PROTEIN >gi\|77357\|pir\|\|JQ0107 hypothetical 66K protein - Ononis yellow mosaic virus | 10 |
| 4156 | L05096 | *Homo Sapiens* ribosomal protein L39 mRNA, complete cds | 2e-086 | 1173044 | 60S RIBOSOMAL PROTEIN L39 *norvegicus*] >gi\|1373419 (U57846) ribosonial protein L39 ribosomal protein L39 [*Homo sapiens*] | 3e-007 |
| 4157 | D13749 | Plasmid pKA1 DNA | 2e-025 | 987050 | (X65335) lacZ gene product [unidentified cloning vector] | 0.18 |
| 4158 | AF007157 | *Homo sapiens* clone 23856 unknown mRNA, partial cds | 2e-057 | 2131036 | (Z95890) PE_PGRS [*Mycobacterium tuberculosis*] | 6.3 |
| 4159 | AF031400 | *Poecilia orri* NADH dehydrogenase subunit 2 gene, mitochondrial gene encoding mitochondrial protein, complete cds | 1.2 | 3327168 | (AB014577) KIAA0677 protein [*Homo sapiens*] | 0.0008 |
| 4160 | U58468 | Human vasoactive intestinal peptide gene, 5' flanking sequence from -5172 to -1924 | 3e-009 | <NONE> | <NONE> | <NONE> |
| 4161 | D11078 | *Homo sapiens* RGH2 gene, retrovirus-like element | 4e-032 | 2119507 | alpha-1C-adrenergic receptor isoform 2 - human >gi\|927209\|gn\|\|PID\|d1007476 (D32202) alpha 1C adrenergic receptor isoform 2 [*Homo sapiens*] | 1.2 |
| 4162 | <NONE> | <NONE> | <NONE> | <NONE> | <NONE> | <NONE> |
| 4163 | M31061 | Human ornithine decarboxylase gene, complete cds. | 2e-023 | 728831 | !!!! ALU SUBFAMILY J WARNING ENTRY | 0.002 |
| 4164 | M19980 | *M. fervidus* gap gene encoding glyceraldehyde-3-phosphate dehydrogenase, complete cds. | 0.4 | 1825606 | (U88169) similar to molybdoterin biosynthesis MOEB proteins [*Caenorhabditis elegans*] | 3e-057 |
| 4165 | D17036 | Human HepG2 partial cDNA, clone hmd3e08m5 | 5e-025 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4166 | L14714 | *C. elegans* cosmid ZC97. | 0.39 | 3874412 | (Z70034) similarity to 35.1KD hypothetical yeast protein (Swiss Prot accession number P38805); cDNA EST CEMSE65F comes from this gene; cDNA EST EMBL: T01315 comes from this gene; cDNA EST yk452e10.3 comes from this gene; cDNA . . . 35.1 KD hypothetical yeast p | 1e-033 |
| 4167 | U95102 | *Xenopus laevis* mitotic phosphoprotein 90 mRNA, complete cds | 8e-008 | <NONE> | <NONE> | <NONE> |
| 4168 | Z49867 | *Caenorhabditis elegans* cosmid C33D3, complete sequence [*Caenorhabditis elegans*] | 0.044 | 3876784 | (Z81530) predicted using Genefinder | 5.9 |
| 4169 | U95102 | *Xenopus laevis* mitotic phosphoprotein 90 mRNA, complete cds | 9e-010 | 3549676 | (AL031394) putative protein | 3.1 |
| 4170 | D87001 | Human (lambda) DNA for immunoglobulin light chain | 0.36 | 3133246 | (AB013170) NADH dehydrogenase subunit 5 | 2.4 |
| 4171 | M37191 | Human ras inhibitor mRNA, partial cds. | e-122 | 107561 | Ras inhibitor (clone JC310) - human *sapiens*] | 3e-035 |
| 4172 | AB018374 | *Mus musculus* GARP34 mRNA, complete cds | 2e-046 | 3724364 | (AB018374) GARP34 [*Mus musculus*] | 2e-008 |
| 4173 | X62527 | *R. norvegicus* gene for CNS-myelin proteolipid protein (exon 6) | 1.2 | 1155068 | (X94976) cell wall-plasma membrane linker protein | 1.6 |
| 4174 | U95094 | *Xenopus laevis* XL-INCENP (XL-INCENP) mRNA, complete cds | 8e-008 | 2781355 | (AC003113) F24O1.11 [*Arabidopsis thaliana*] | 0.52 |
| 4175 | AF002715 | *Homo sapiens* MAP kinase kinase kinase (MTK1) mRNA, complete cds | e-168 | 2352277 | (AF002715) MAP kinase kinase kinase [*Homo sapiens*] | 1e-042 |
| 4176 | U07807 | Human metallothionein IV (MTIV) gene, complete cds. | 0.047 | <NONE> | <NONE> | <NONE> |
| 4177 | D11129 | Pneumonia virus of mice gene 7 | 0.14 | <NONE> | <NONE> | <NONE> |
| 4178 | U95094 | *Xenopus laevis* XL-INCENP (XL-INCENP) mRNA, complete cds | 2e-006 | <NONE> | <NONE> | <NONE> |
| 4179 | AF070557 | *Homo sapiens* clone 24422 mRNA sequence | 0 | <NONE> | <NONE> | <NONE> |
| 4180 | U95098 | *Xenopus laevis* | 0.005 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mitotic phosphoprotein 44 mRNA, partial cds | | | | |
| 4181 | AF045765 | *Homo sapiens* G protein-coupled receptor | 9e-018 | 728833 | !!!! ALU SUBFAMILY SB1 WARNING ENTRY | 0.051 |
| 4182 | <NONE> | <NONE> | <NONE> | <NONE> | <NONE> | <NONE> |
| 4183 | X62162 | *B. burgdorferi* gene for PC protein | 0.41 | <NONE> | <NONE> | <NONE> |
| 4184 | Z81315 | Human DNA sequence from fosmid F62D4 on chromosome 22q12-qterv > :: emb\|Z81316\|HSF 62D4A Human DNA sequence from fosmid F62D4 on chromosome 22, complete sequence | 1.2 | <NONE> | <NONE> | <NONE> |
| 4185 | U95094 | *Xenopus laevis* XL-INCENP (XL-INCENP) mRNA, complete cds | 3e-009 | <NONE> | <NONE> | <NONE> |
| 4186 | L08108 | Human low-affinity Fc-receptor IIB gene, exons 4-7. | 0.0006 | 462387 | IMMEDIATE-EARLY PROTEIN IE180 herpesvirus 1 (strain Kaplan) >gi\|334071 (M34651) immediate-early protein [Pseudorabies virus] | 0.25 |
| 4187 | AJ228330 | *Pinus pinaster* reverse transcriptase gene of Line-retroelement (clone pPpLi1) | 1.3 | 3108187 | (AC004663) Notch 3 [*Homo sapiens*] | 1.3 |
| 4188 | <NONE> | <NONE> | <NONE> | <NONE> | <NONE> | <NONE> |
| 4189 | AF048991 | *Homo sapiens* MutS homolog 5 (MSH5) gene, exons 13 through 25 and complete cds | 0.002 | 3986756 | (AF109905) NG23 [*Mus musculus*] | 0.066 |
| 4190 | Z59608 | *H. sapiens* CpG DNA, clone 165g8, reverse read cpg165g8.rt1a. | 2e-014 | 1055183 | (U40061) Similar to sodium-dependent phosphate transporter. [*Caenorhabditis elegans*] | 2.4 |
| 4191 | U95102 | *Xenopus laevis* mitotic phosphoprotein 90 mRNA, complete cds | 0.0002 | <NONE> | <NONE> | <NONE> |
| 4192 | U95102 | *Xenopus laevis* mitotic phosphoprotein 90 mRNA, complete cds | 0.0002 | <NONE> | <NONE> | <NONE> |
| 4193 | U95094 | *Xenopus laevis* XL-INCENP (XL-INCENP) | 2e-006 | 2128837 | hypothetical protein MJ1401 - *Methanococcus* | 7.6 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mRNA, complete cds | | | *jannaschii* >gi\|1592049 (U67580) putative ATP dependent RNA helicase [*Methanococcus jannaschii*] | |
| 4194 | X99691 | *B. taurus* DNA for agouti gene | 9e-009 | <NONE> | <NONE> | <NONE> |
| 4195 | U95098 | *Xenopus laevis* mitotic phosphoprotein 44 mRNA, partial cds | 8e-008 | 306929 | (M28696) IgG Fc receptor beta-Fc-gamma-RII [*Homo sapiens*] | 0.64 |
| 4196 | U37521 | *Sus scrofa* E-selectin gene, complete cds | 0.042 | 539800 | calcium-activated potassium channel mSlo - mouse >gi\|347144 (L16912) mSlo [*Mus musculus*] | 3.3 |
| 4197 | U95098 | *Xenopus laevis* mitotic phosphoprotein 44 mRNA, partial cds | 0.0002 | <NONE> | <NONE> | <NONE> |
| 4198 | U95098 | *Xenopus laevis* mitotic phosphoprotein 44 mRNA, partial cds | 0.0002 | <NONE> | <NONE> | <NONE> |
| 4199 | V01087 | Hemagglutinin gene of influenza virus strain A/duck/Ukraine/1/63 > :: gb\|J02109\|FLAHAMU Influenza A/duck/ukraine/1/63 (h3n8), hemagglutinin (seg 4), cdna. | 0.18 | 4038537 | (AL021106) 1-evidence=predicted by match; 1-match_accession=AA392988; 1-match_description=LD12167.5prime LD *Drosophila melanogaster* embryo BlueScript *Drosophila melanogaster* cDNA clone LD12167 5prime.; 1-match_species=Drosop . . . | 8.5 |
| 4200 | X83107 | *H. sapiens* Bmx mRNA for cytoplasmic tyrosine kinase | 0.38 | 1147597 | (U31221) viscerotropic leishmaniasis antigen [*Leishmania tropica*] | 3.3 |
| 4201 | U95102 | *Xenopus laevis* mitotic phosphoprotein 90 mRNA, complete cds | 2e-014 | 2072296 | (U95098) mitotic phosphoprotein 44 [*Xenopus laevis*] | 1.9 |
| 4202 | X71642 | *M. musculus* GEG-154 mRNA | 3.5 | 2760302 | (D89074) hypothetical protein [*Vibrio cholerae* O139 fsl phage] | 1.5 |
| 4203 | U95094 | *Xenopus laevis* XL-INCENP (XL-INCENP) mRNA, complete cds | 2e-013 | 2072296 | (U95098) mitotic phosphoprotein 44 [*Xenopus laevis*] | 3.7 |
| 4204 | U95102 | *Xenopus laevis* mitotic phosphoprotein 90 mRNA, complete cds | 9e-009 | 1574918 | (U19728) organic anion transporter [*Raja erinacea*] | 5.8 |
| 4205 | U95102 | *Xenopus laevis* | 4e-012 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4206 | U95094 | mitotic phosphoprotein 90 mRNA, complete cds *Xenopus laevis* XL-INCENP (XL-INCENP) mRNA, complete cds | 4e-011 | <NONE> | <NONE> | <NONE> |
| 4207 | U95102 | *Xenopus laevis* mitotic phosphoprotein 90 mRNA, complete cds | 2e-007 | <NONE> | <NONE> | <NONE> |
| 4208 | U95094 | *Xenopus laevis* XL-INCENP (XL-INCENP) mRNA, complete cds | 4e-011 | <NONE> | <NONE> | <NONE> |
| 4209 | U50523 | Human BRCA2 region, mRNA sequence CG037 | 0 | 3121764 | ARP2/3 COMPLEX 34 KD SUBUNIT | 9e-026 |
| 4210 | X80909 | *H. sapiens* alpha NAC mRNA | 8e-050 | 2072296 | (U95098) mitotic phosphoprotein 44 [*Xenopus laevis*] | 5.9 |
| 4211 | AF039955 | *Homo sapiens* liver CC chemokine-1 precursor | 7e-006 | <NONE> | <NONE> | <NONE> |
| 4212 | U95102 | *Xenopus laevis* mitotic phosphoprotein 90 mRNA, complete cds | 3e-010 | 2072296 | (U95098) mitotic phosphoprotein 44 [*Xenopus laevis*] | 4.6 |
| 4213 | L35670 | *Homo sapiens* (subclone H8 1.0_g5 from P1 35 H5 C8) DNA sequence. | 7e-017 | <NONE> | <NONE> | <NONE> |
| 4214 | U95102 | *Xenopus laevis* mitotic phosphoprotein 90 mRNA, complete cds | 0.0002 | <NONE> | <NONE> | <NONE> |
| 4215 | <NONE> | <NONE> | <NONE> | <NONE> | <NONE> | <NONE> |
| 4216 | <NONE> | <NONE> | <NONE> | <NONE> | <NONE> | <NONE> |
| 4217 | L33354 | *Lobostemon fruticosus* Buek chloroplast trnL(UAA)-trnF(GAA) intergenic spacer DNA. | 0.35 | 1483615 | (Z77856) beta-glucosidase [*Thermotoga neapolitana*] | 9 |
| 4218 | Z12112 | pWE15A cosmid vector DNA | 5e-033 | 987050 | (X65335) lacZ gene product [unidentified cloning vector] | 4e-008 |
| 4219 | X65279 | pWE15 cosmid vector DNA | 2e-079 | 987050 | (X65335) lacZ gene product [unidentified cloning vector] | 3e-015 |
| 4220 | AF052165 | *Homo sapiens* clone 24522 mRNA sequence | e-170 | 2065177 | (Y12790) Supt5h protein [*Homo sapiens*] sapiens] | 1e-059 |
| 4221 | U95102 | *Xenopus laevis* mitotic phosphoprotein 90 mRNA, complete cds | 2e-006 | <NONE> | <NONE> | <NONE> |
| 4222 | U95102 | *Xenopus laevis* mitotic phosphoprotein 90 mRNA, complete cds | 2e-014 | 2072296 | (U95098) mitotic phosphoprotein 44 [*Xenopus laevis*] | 1.9 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4223 | AF055024 | Homo sapiens clone 24763 mRNA sequence | 0 | <NONE> | <NONE> | <NONE> |
| 4224 | S39048 | knob associated histidine-rich protein KAHRP | 0.39 | <NONE> | <NONE> | <NONE> |
| 4225 | U95102 | Xenopus laevis mitotic phosphoprotein 90 mRNA, complete cds | 4e-011 | <NONE> | <NONE> | <NONE> |
| 4226 | U34377 | Human tyrosine kinase TXK (txk) gene, exon 13. | 2e-028 | 1709347 | SERINE/THREONINE-PROTEIN KINASE NRK2 (SERINE/THREONINE KINASE 2) >gi\|348245 (L20321) protein serine/threonine kinase [Homo sapiens] | 8e-008 |
| 4227 | U25748 | Pan troglodytes epididymal secretory protein precursor (EPI-1) mRNA, complete cds. | 0 | 3182993 | EPIDIDYMAL SECRETORY PROTEIN E1 PRECURSOR (EPI-1) (HEI) (EPIDIDYMAL SECRETORY PROTEIN 14.6) (ESP14.6) >gi\|106343\|pir\|\|S25641 hypothetical protein - human >gi\|2134519\|pir\|\|I53929 epididymal secretory protein 14.6 - crab-eating macaque human >gi\|37477 (X676 | 7e-040 |
| 4228 | <NONE> | <NONE> | <NONE> | <NONE> | <NONE> | <NONE> |
| 4229 | U95102 | Xenopus laevis mitotic phosphoprotein 90 mRNA, complete cds | 0.017 | <NONE> | <NONE> | <NONE> |
| 4230 | X74929 | H. sapiens KRT8 mRNA for keratin 8 | 6e-036 | <NONE> | <NONE> | <NONE> |
| 4231 | U95102 | Xenopus laevis mitotic phosphoprotein 90 mRNA, complete cds | 8e-007 | <NONE> | <NONE> | <NONE> |
| 4232 | U95094 | Xenopus laevis XL-INCENP (XL-INCENP) mRNA, complete cds | 5e-013 | 2072296 | (U95098) mitotic phosphoprotein 44 [Xenopus laevis] | 6 |
| 4233 | U41010 | Caenorhabditis elegans cosmid T05A12 | 4.2 | <NONE> | <NONE> | <NONE> |
| 4234 | U95094 | Xenopus laevis XL-INCENP (XL-INCENP) mRNA, complete cds | 3e-007 | 1363925 | hypothetical protein 2 - North American opossum (fragment) >gi\|897721 (Z48955) ORF-2, putative RT [Didelphis virginiana] | 4.7 |
| 4235 | U95094 | Xenopus laevis XL-INCENP (XL-INCENP) | 0.0002 | 439493 | (D26086) zinc-finger protein [Petunia x | 8.5 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mRNA, complete cds | | | *hybrida*] | |
| 4236 | U95094 | *Xenopus laevis* XL-INCENP (XL-INCENP) mRNA, complete cds | 0.0002 | 2501599 | HYPOTHETICAL 29.1 KD PROTEIN W06E11.4 IN CHROMOSOME III >gi\|669022 (U20862) W06E11.4 gene product [*Caenorhabditis elegans*] | 0.002 |
| 4237 | X94118 | *P. falciparum* PK4 gene | 1.2 | <NONE> | <NONE> | <NONE> |
| 4238 | Z18944 | *S. cerevisiae* BDF1 gene | 7.30E-01 | 2119161 | unknown - chicken (fragment) >gi\|537433 | 0.61 |
| 4239 | AF031939 | *Mus musculus* RalBP1-associated EH domain protein Reps1 (reps1) mRNA, complete cds | e-154 | 2677843 | (AF031939) RalBP1-associated EH domain protein Reps1 | 5e-016 |
| 4240 | U95102 | *Xenopus laevis* mitotic phosphoprotein 90 mRNA, complete cds | 1e-014 | 2072296 | (U95098) mitotic phosphoprotein 44 [*Xenopus laevis*] | 2.9 |
| 4241 | L35566 | *Gallus gallus* homeobox protein (LH-2) mRNA, complete cds. | 3e-044 | 1708809 | HOMEOBOX PROTEIN LH-2 >gi\|508712 | 4e-021 |
| 4242 | Z83086 | *H. sapiens* Fanconi anaemia group A gene, exon 29 | 3.00E-07 | <NONE> | <NONE> | <NONE> |
| 4243 | U63810 | *Homo sapiens* WD40 protein Ciao 1 mRNA, complete cds | 0.00E+00 | 3219331 | (AC004020) Unknown gene product [*Homo sapiens*] | 1e-096 |
| 4244 | U15110 | *Mycoplasma capricolum* ptsI-crr operon phosphocarrier protein enzyme I (ptsI) and phosphocarrier protein enzyme IIA (crr) genes, complete cds, and lipopolysaccharide biosynthesis (kdtB) gene, complete cds. | 1.1 | <NONE> | <NONE> | <NONE> |
| 4245 | <NONE> | <NONE> | <NONE> | <NONE> | <NONE> | <NONE> |
| 4246 | U95094 | *Xenopus laevis* XL-INCENP (XL-INCENP) mRNA, complete cds | 4e-011 | 730888 | OCTAPEPTIDE-REPEAT PROTEIN T2 | 1.4 |
| 4247 | U95102 | *Xenopus laevis* mitotic phosphoprotein 90 mRNA, complete cds | 0.074 | <NONE> | <NONE> | <NONE> |
| 4248 | AJ224152 | *Plasmodium berghei* gene encoding cdc2-related kinase 2 | 0.54 | <NONE> | <NONE> | <NONE> |
| 4249 | M24971 | *D. discoideum* CT-rich satellite | 2e-008 | 119110 | EBNA-1 NUCLEAR | 2e-009 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | rDNA, clone pCT11. | | | PROTEIN herpesvirus 4 (strain B95-8) >gi\|1334880 (V01555) BKRF1 encodes EBNA-1 protein, latent cycle gene. [Human herpesvirus 4] | |
| 4250 | Z72969 | *S. cerevisiae* chromosome VII reading frame ORF YGR184c | 1.2 | <NONE> | <NONE> | <NONE> |
| 4251 | <NONE> | <NONE> | <NONE> | <NONE> | <NONE> | <NONE> |
| 4252 | AJ224326 | *Homo sapiens* mRNA for putative ribulose-5-phosphate-epimerase, partial cds | 0 | <NONE> | <NONE> | <NONE> |
| 4253 | U45245 | *Homo sapiens* paired-box protein PAX2 (PAX2) gene, promoter and exon 1 | 2.1 | <NONE> | <NONE> | <NONE> |
| 4254 | AE001157 | *Borrelia burgdorferi* (section 43 of 70) of the complete genome | 0.63 | <NONE> | <NONE> | <NONE> |
| 4255 | U95102 | *Xenopus laevis* mitotic phosphoprotein 90 mRNA, complete cds | 3e-010 | 2072296 | (U95098) mitotic phosphoprotein 44 [*Xenopus laevis*] | 5.8 |
| 4256 | U95098 | *Xenopus laevis* mitotic phosphoprotein 44 mRNA, partial cds | 0.0005 | 2773162 | (AF039595) sulfonylurea receptor 1B [*Rattus norvegicus*] | 9.6 |
| 4257 | U95102 | *Xenopus laevis* mitotic phosphoprotein 90 mRNA, complete cds | 5e-009 | <NONE> | <NONE> | <NONE> |
| 4258 | L11130 | Influenza A/gul1/MD/19/77 (H2N8) hemagglutinin | 0.67 | <NONE> | <NONE> | <NONE> |
| 4259 | AB018270 | *Homo sapiens* mRNA for KIAA0727 protein, partial cds | 0 | 2072296 | (U95098) mitotic phosphoprotein 44 [*Xenopus laevis*] | 3 |
| 4260 | U67494 | *Methanococcus jannaschii* section 36 of 150 of the complete genome | 0.014 | <NONE> | <NONE> | <NONE> |
| 4261 | L09209 | *Homo sapiens* amyloid protein homologue mRNA, complete cds > :: gb\|I13782\|I13782 Sequence 12 from patent U.S. Pat. No. 5441931 > :: gb\|I68752\|I68752 Sequence 12 from patent U.S. Pat. No. 5677146 | 6e-089 | <NONE> | <NONE> | <NONE> |
| 4262 | M27866 | Human | e-158 | 2072296 | (U95098) mitotic | 1.7 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | retinoblastoma susceptibility protein gene, exon 27. > :: gb|I09392| Sequence 25 from Patent WO 8906703 | | | phosphoprotein 44 [*Xenopus laevis*] | |
| 4263 | U59629 | Human transcription factor LZIP-alpha mRNA, complete cds | 1e-052 | 2828799 | (U55386) unknown [*Anabaena* PCC7120] | 0.097 |
| 4264 | U95102 | *Xenopus laevis* mitotic phosphoprotein 90 mRNA, complete cds | 2e-006 | 3176395 | (AB015041) PIF1 [*Caenorhabditis elegans*] | 3e-005 |
| 4265 | AF069250 | *Homo sapiens* okadaic acid-inducible phosphoprotein (OA48-18) mRNA, complete cds | 2e-068 | 3037018 | (AF041330) NADH dehydrogenase subunit 5 [*Bodo saltans*] | 0.002 |
| 4266 | M11560 | Human aldolase A mRNA, complete cds. | 0.00E+00 | 113606 | FRUCTOSE-BISPHOSPHATE ALDOLASE A fructose-bisphosphate aldolase (EC 4.1.2.13) A- [human *sapiens*] | 5e-055 |
| 4267 | U95102 | *Xenopus laevis* mitotic phosphoprotein 90 mRNA, complete cds | 2e-009 | <NONE> | <NONE> | <NONE> |
| 4268 | U95102 | *Xenopus laevis* mitotic phosphoprotein 90 mRNA, complete cds | 1e-005 | 2688708 | (AE001176) conserved hypothetical protein [*Borrelia burgdorferi*] | 8.5 |
| 4269 | L35566 | *Gallus gallus* homeobox protein (LH-2) mRNA, complete cds. | 6e-041 | 1708809 | HOMEOBOX PROTEIN LH-2 >gi|508712 | 7e-019 |
| 4270 | U95094 | *Xenopus laevis* XL-INCENP (XL-INCENP) mRNA, complete cds | 1.00E-11 | 1709997 | DNA REPAIR PROTEIN RAD18 >gi|1150622 protein rad18 [*Schizosaccharomyces pombe*] | 6e-027 |
| 4271 | U95094 | *Xenopus laevis* XL-INCENP (XL-INCENP) mRNA, complete cds | 2e-009 | 586442 | NUCLEOPORIN NUP170 (NUCLEAR PORE PROTEIN NUP170) >gi|626192|pir||S45429 probable membrane protein YBL079w - yeast [(*Saccharomyces cerevisiae*) *cerevisiae*] >gi|536127 (Z35840) ORF YBL079w | 0.44 |
| 4272 | U95094 | *Xenopus laevis* XL-INCENP (XL-INCENP) mRNA, complete cds | 3e-013 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4273 | <NONE> | <NONE> | <NONE> | <NONE> | <NONE> | <NONE> |
| 4274 | <NONE> | <NONE> | <NONE> | <NONE> | <NONE> | <NONE> |
| 4275 | X00334 | Drosophila virilis simple DNA sequence (pDv-19) | 6e-010 | 119110 | EBNA-1 NUCLEAR PROTEIN herpesvirus 4 (strain B95-8) >gi\|1334880 (V01555) BKRF1 encodes EBNA-1 protein, latent cycle gene. [Human herpesvirus 4] | 2e-016 |
| 4276 | U95094 | Xenopus laevis XL-INCENP (XL-INCENP) mRNA, complete cds | 2e-007 | <NONE> | <NONE> | <NONE> |
| 4277 | AF069250 | Homo sapiens okadaic acid-inducible phosphoprotein (OA48-18) mRNA, complete cds | 2e-068 | 3037018 | (AF041330) NADH dehydrogenase subunit 5 [Bodo saltans] | 0.002 |
| 4278 | Y10183 | H. sapiens mRNA for MEMD protein | e-162 | <NONE> | <NONE> | <NONE> |
| 4279 | D86960 | Human mRNA for KIAA0205 gene, complete cds | 2e-078 | <NONE> | <NONE> | <NONE> |
| 4280 | X65319 | Cloning vector pCAT-Enhancer | 3e-081 | 987050 | (X65335) lacZ gene product [unidentified cloning vector] | 3e-015 |
| 4281 | X86693 | H. sapiens mRNA for hevin like protein | 0.18 | <NONE> | <NONE> | <NONE> |
| 4282 | U95094 | Xenopus laevis XL-INCENP (XL-INCENP) mRNA, complete cds | 0.0001 | <NONE> | <NONE> | <NONE> |
| 4283 | M33156 | A. aegypti D7 gene, exons 1–5. | 1.30E+00 | <NONE> | <NONE> | <NONE> |
| 4284 | X02317 | Human mRNA for Cu/Zn superoxide dismutase (SOD) | 0 | 218564 | (D90358) HB-SOD [Schizosaccharomyces pombe] | 7e-032 |
| 4285 | U95094 | Xenopus laevis XL-INCENP (XL-INCENP) mRNA, complete cds | 2.00E-04 | <NONE> | <NONE> | <NONE> |
| 4286 | U95094 | Xenopus laevis XL-INCENP (XL-INCENP) mRNA, complete cds | 2.00E-04 | <NONE> | <NONE> | <NONE> |
| 4287 | X02317 | Human mRNA for Cu/Zn superoxide dismutase (SOD) | 0 | 134611 | SUPEROXIDE DISMUTASE (CU-ZN) dismutase (aa 1-154) [Homo sapiens] >gi\|338276 (K00065) superoxide dismutase [Homo sapiens] >gi\|1237407 (L44139) Cu/Zn- | 2e-079 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4288 | X04408 | Human mRNA for coupling protein G(s) alpha subunit (adenylyl cyclase) | 0 | 386748 | superoxide dismutase [*Homo sapiens*] (M14631) guanine nucleotide-binding protein alpha subunit | 2e-073 |
| 4289 | M28161 | Rabbit MHC class II RLA-DR-alpha gene, complete cds. | 2.4 | <NONE> | <NONE> | <NONE> |
| 4290 | U33956 | Human Down Syndrome region of chromosome 21, genomic sequence, clone A12H1-1F8. | 0.37 | <NONE> | <NONE> | <NONE> |
| 4291 | U90331 | *Mus musculus* neural plakophilin related arm-repeat protein (NPRAP) mRNA, complete cds | 0.15 | 135063 | SUPPRESSOR OF SABLE PROTEIN fruit fly (*Drosophila melanogaster*) >gi\|158517 (M57889) su(s) protein [*Drosophila melanogaster*] | 5.2 |
| 4292 | AF045531 | *Homo sapiens* germline chromosome 22, 22q11.2 region | 0.005 | <NONE> | <NONE> | <NONE> |
| 4293 | D86960 | Human mRNA for KIAA0205 gene, complete cds | 2e-078 | <NONE> | <NONE> | <NONE> |
| 4294 | U95094 | *Xenopus laevis* XL-INCENP (XL-INCENP) mRNA, complete cds | 2e-005 | <NONE> | <NONE> | <NONE> |
| 4295 | U95098 | *Xenopus laevis* mitotic phosphoprotein 44 mRNA, partial cds | 5.00E-03 | <NONE> | <NONE> | <NONE> |
| 4296 | U17073 | *Neurospora crassa* frequency (frq) mRNA, complete cds. | 0.041 | 3152938 | (AF065482) sorting nexin 2 [*Homo sapiens*] | 0.83 |
| 4297 | M93051 | *Pisum sativum* ascorbate peroxidase (ApxI) gene, complete cds. | 0.2 | <NONE> | <NONE> | <NONE> |
| 4298 | U28153 | *Caenorhabditis elegans* UNC-76 (unc-76) gene, complete cds. | 0.37 | <NONE> | <NONE> | <NONE> |
| 4299 | U28153 | *Caenorhabditis elegans* UNC-76 (unc-76) gene, complete cds. | 0.37 | <NONE> | <NONE> | <NONE> |
| 4300 | U20240 | Human C/EBP gamma mRNA, complete cds > :: gb\|G28590\|G28590 human STS SHGC-35371. | e-141 | 1705750 | CCAAT/ENHANCER BINDING PROTEIN GAMMA (C/EBP GAMMA) >gi\|1363931\|pir\|JC4243 transcription CCAAT enhancer binding protein-gamma - human | 1e-011 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4301 | Y16359 | *Calonectris diomedea* random amplified polymorphic DNA, clone Cd-O8f1 | 4e-075 | 595780 | >gi\|727294 (U20240) C/EBP gamma [*Homo sapiens*] (U13871) lacZ alpha peptide [Cloning vector] | 0.0001 |
| 4302 | U95094 | *Xenopus laevis* XL-INCENP (XL-INCENP) mRNA, complete cds | 5e-013 | <NONE> | <NONE> | <NONE> |
| 4303 | <NONE> | <NONE> | <NONE> | <NONE> | <NONE> | <NONE> |
| 4304 | U90331 | *Mus musculus* neural plakophilin related arm-repeat protein (NPRAP) mRNA, complete cds | 0.15 | 135063 | SUPPRESSOR OF SABLE PROTEIN fruit fly (*Drosophila melanogaster*) >gi\|158517 (M57889) su(s) protein [*Drosophila melanogaster*] | 5.2 |
| 4305 | <NONE> | <NONE> | <NONE> | <NONE> | <NONE> | <NONE> |
| 4306 | D86960 | Human mRNA for KIAA0205 gene, complete cds | 0 | 1653865 | (D90917) UDP-N-acetylglucosamine-N-acetylmuramyl-(pentapeptide) pyrophosphoryl-undecaprenol N-acetylglucosamine transferase [*Synechocystis* sp.] | 4.40E+00 |
| 4307 | U95094 | *Xenopus laevis* XL-INCENP (XL-INCENP) mRNA, complete cds | 1e-013 | 4105520 | (AF046933) carboxysome structural polypeptide | 2.4 |
| 4308 | Y14723 | *Choanomphalus incertus* mitochondrial cytochrome c oxidase subunit I gene, partial | 0.36 | <NONE> | <NONE> | <NONE> |
| 4309 | AB018327 | *Homo sapiens* mRNA for KIAA0784 protein, partial cds | 0 | 3882289 | (AB018327) KIAA0784 protein [*Homo sapiens*] | 4e-041 |
| 4310 | AB007860 | *Homo sapiens* KIAA0400 mRNA, complete cds | 0 | <NONE> | <NONE> | <NONE> |
| 4311 | <NONE> | <NONE> | <NONE> | <NONE> | <NONE> | <NONE> |
| 4312 | U96440 | *Drosophila melanogaster* cut gene, partial sequence | 0.053 | 119110 | EBNA-1 NUCLEAR PROTEIN herpesvirus 4 (strain B95-8) >gi\|1334880 <V01555> BKRF1 encodes EBNA-1 protein, latent cycle gene. [Human herpesvirus 4] | 0.0004 |
| 4313 | X64707 | *H. sapiens* BBC1 mRNA | 3e-090 | 1350662 | 60S RIBOSOMAL PROTEIN L13 | 2e-025 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4314 | U67522 | *Methanococcus jannaschii* section 64 of 150 of the complete genome | 0.38 | <NONE> | (A52) <NONE> | <NONE> |
| 4315 | M11560 | Human aldolase A mRNA, complete cds. | 0.00E+00 | 113606 | FRUCTOSE-BISPHOSPHATE ALDOLASE A fructose-bisphosphate aldolase (EC 4.1.2.13) A-[human *sapiens*] | 5e-055 |
| 4316 | X92098 | *H. sapiens* mRNA for transmembrane protein mp24 | e-123 | 3914237 | COP-COATED VESICLE MEMBRANE PROTEIN P24 PRECURSOR (P24A) (RNP24) >gi\|1212965\|gnl\|PID\|e205529 | 1e-017 |
| 4317 | <NONE> | <NONE> | <NONE> | <NONE> | <NONE> | <NONE> |
| 4318 | D86960 | Human mRNA for KIAA0205 gene, complete cds | 0 | 1653865 | (D90917) UDP-N-acetylglucosamine-N-acetylmuramyl-(pentapeptide) pyrophosphoryl-undecaprenol N-acetylglucosamine transferase [*Synechocystis* sp.] | 4.40E+00 |
| 4319 | M83094 | *Homo sapiens* cytosolic selenium-dependent glutathione peroxidase gene, complete cds, and rhoh12 gene, 3' end. | 0.00E+00 | <NONE> | <NONE> | <NONE> |
| 4320 | U95102 | *Xenopus laevis* mitotic phosphoprotein 90 mRNA, complete cds | 5e-015 | <NONE> | <NONE> | <NONE> |
| 4321 | U95102 | *Xenopus laevis* mitotic phosphoprotein 90 mRNA, comptete cds | 7e-007 | <NONE> | <NONE> | <NONE> |
| 4322 | U95098 | *Xenopus laevis* mitotic phosphoprotein 44 mRNA, partial cds | 3.3 | <NONE> | <NONE> | <NONE> |
| 4323 | U95102 | *Xenopus laevis* mitotic phosphoprotein 90 mRNA, complete cds | 1.40E-02 | <NONE> | <NONE> | <NONE> |
| 4324 | <NONE> | <NONE> | <NONE> | <NONE> | <NONE> | <NONE> |
| 4325 | U95102 | *Xenopus laevis* mitotic phosphoprotein 90 mRNA, complete cds | 3e-010 | <NONE> | <NONE> | <NONE> |
| 4326 | AF088034 | *Homo sapiens* full length insert cDNA clone ZC24F03 | 0 | 854598 | (X87611) ORF YJR83.18 [*Saccharomyces cerevisiae*] | 2e-024 |
| 4327 | U47322 | Cloning vector DNA, complete | 6.00E-06 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4328 | U47322 | sequence. Cloning vector DNA, complete sequence. | 6.00E-06 | <NONE> | <NONE> | <NONE> |
| 4329 | D86960 | Human mRNA for KIAA0205 gene, complete cds | 0.00E+00 | 1653865 | (D90917) UDP-N-acetylglucosamine -N-acetylmuramyl-(pentapeptide) pyrophosphoryl - undecaprenol N-acetylglucosamine transferase [*Synechocystis* sp.] | 1.4 |
| 4330 | Z70316 | *D. melanogaster* mRNA for tyramine-beta-hydroxylase | 1.5 | <NONE> | <NONE> | <NONE> |
| 4331 | L28010 | *Homo sapiens* HnRNP F protein mRNA, complete cds | 3e-070 | 1710628 | HETEROGENEOUS NUCLEAR RIBONUCLEOPROTEIN F (HNRNP F) >gi\|631210\|pir\|S43484 hnRNP F protein - human >gi\|452048 (L28010) HnRNP F protein [*Homo sapiens*] | 2e-005 |
| 4332 | U95098 | *Xenopus laevis* mitotic phosphoprotein 44 mRNA, partial cds | 1.40E-01 | <NONE> | <NONE> | <NONE> |
| 4333 | U95098 | *Xenopus laevis* mitotic phosphoprotein 44 mRNA, partial cds | 0.13 | <NONE> | <NONE> | <NONE> |
| 4334 | U95102 | *Xenopus laevis* mitotic phosphoprotein 90 mRNA, complete cds | 0.004 | 1723286 | VERY HYPOTHETICAL 11.9 KD PROTEIN C4H3.12C IN CHROMOSOME I>gi\|1184025 (Z69380) unknown | 3.1 |
| 4335 | <NONE> | <NONE> | <NONE> | 2314752 | (AE000654) rare lipoprotein A (rlpA) [*Helicobacter pylori*] | 7.3 |
| 4336 | AB007963 | *Homo sapiens* mRNA for KIAA0494 protein, complete cds | 8e-078 | 3413938 | (AB007963) KIAA0494 protein [*Homo sapiens*] | 1.00E-11 |
| 4337 | <NONE> | <NONE> | <NONE> | <NONE> | <NONE> | <NONE> |
| 4338 | X12597 | Human mRNA for high mobility group-1 protein | 3e-048 | 123371 | HIGH MOBILITY GROUP PROTEIN HMG1 protein HMG-1-pig >gi\|164490 (M21683) non-histone protein HMG1 [*Sus scrofa*] | 0.006 |
| 4339 | U95102 | *Xenopus laevis* mitotic phosphoprotein 90 mRNA, | 1e-013 | 2853095 | (AL021767) very hypothetical protein | 0.043 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4340 | U95102 | complete cds *Xenopus laevis* mitotic phosphoprotein 90 mRNA, complete cds | 8e-007 | <NONE> | <NONE> | <NONE> |
| 4341 | U95094 | *Xenopus laevis* XL-INCENP (XL-INCENP) mRNA, complete cds | 7e-006 | 3063453 | (AC003981) F22O13.15 [*Arabidopsis thaliana*] | 4.5 |
| 4342 | U95094 | *Xenopus laevis* XL-INCENP (XL-INCENP) mRNA, complete cds | 4.00E-11 | 231629 | BILE-SALT-ACTIVATED LIPASE PRECURSOR (ESTER LIPASE) (STEROL ESTERASE) (CHOLESTEROL ESTERASE) salt-activated lipase [*Homo sapiens*] sapiens] | 9.6 |
| 4343 | L31732 | Human STS UT643, 5' primer bind. | 1.6 | <NONE> | <NONE> | <NONE> |
| 4344 | AF037332 | *Homo sapiens* Eph-like receptor tyrosine kinase hEphB1b (EphB1) mRNA, complete cds | 0.66 | <NONE> | <NONE> | <NONE> |
| 4345 | <NONE> | <NONE> | <NONE> | <NONE> | <NONE> | <NONE> |
| 4346 | U95102 | *Xenopus laevis* mitotic phosphoprotein 90 mRNA, complete cds | 2.00E-05 | <NONE> | <NONE> | <NONE> |
| 4347 | U95102 | *Xenopus laevis* mitotic phosphoprotein 90 mRNA, complete cds | 4e-007 | <NONE> | <NONE> | <NONE> |
| 4348 | Z30961 | *H. sapiens* DNA for Mhc Alu elements | 7.00E-17 | 728835 | !!!! ALU SUBFAMILY SC WARNING ENTRY | 0.5 |
| 4349 | U34887 | Yeast integrating vector pRS306 containing a fragment of lacZ. | 7e-068 | 3152967 | (Y14016) hypothetical protein | 9 |
| 4350 | D28124 | Human mRNA for unknown product, complete cds | 0 | 1825638 | (U88172) similar to protein-tyrosine phosphatase | 0.062 |
| 4351 | AF069503 | *Carcharhinus plumbeus* microsatellite repeat region | 4.20E+00 | <NONE> | <NONE> | <NONE> |
| 4352 | AF069503 | *Carcharhinus plumbeus* microsatellite repeat region | 4.20E+00 | <NONE> | <NONE> | <NONE> |
| 4353 | D10848 | Alkalophilic *Bacillus* sp. genomic DNA for lipo-penicillinase | 0.033 | <NONE> | <NONE> | <NONE> |
| 4354 | D28124 | Human mRNA for unknown product, complete cds | 0 | 1825638 | (U88172) similar to protein-tyrosine phosphatase | 0.062 |
| 4355 | U19482 | *Mus musculus* C10-like chemokine | 3.70E+00 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4356 | AF050068 | *Homo sapiens* growth arrest specific 11 mRNA, complete cds | 1.4 | 1916844 | (U82987) Bcl-2 binding component 3 [*Homo sapiens*] | 0.042 |
| 4357 | U95094 | *Xenopus laevis* XL-INCENP (XL-INCENP) mRNA, complete cds | 2e-005 | <NONE> | <NONE> | <NONE> |
| 4358 | AE000026 | *Mycoplasma pneumoniae* section 26 of 63 of the complete genome | 1.3 | <NONE> | <NONE> | <NONE> |
| 4359 | <NONE> | <NONE> | <NONE> | 2114321 | (D88733) membrane glycoprotein [Equine herpesvirus 1] | 8.00E-01 |
| 4360 | <NONE> | <NONE> | <NONE> | <NONE> | <NONE> | <NONE> |
| 4361 | Y07660 | *M. tuberculosis* accBC gene | 2e-068 | 465847 | HYPOTHETICAL 66.5 KD PROTEIN F02A9.5 IN CHROMOSOME III >gi\|280542\|pir\|\|S28313 hypothetical protein F02A9.5 - *Caenorhabditis elegans* Genefinder; similar to Propionyl-CoA carboxylase beta chain; cDNA EST EMBL:M89018 comes from this gene; cDNA EST EMBL:D2806 | 4e-079 |
| 4362 | U12022 | Human calmodulin (CALM1) gene, exons 2, 3, 4, 5 and 6, and complete cds | e-127 | <NONE> | <NONE> | <NONE> |
| 4363 | AC001178 | *Homo sapiens* (subclone 2_g12 from BAC H94) DNA sequence | 3.00E-28 | <NONE> | <NONE> | <NONE> |
| 4364 | <NONE> | <NONE> | <NONE> | 4063042 | (AF068065) GP900; mucin-like glycoprotein [*Cryptosporidium parvum*] | 0.52 |
| 4365 | <NONE> | <NONE> | <NONE> | <NONE> | <NONE> | <NONE> |
| 4366 | U95102 | *Xenopus laevis* mitotic phosphoprotein 90 mRNA, complete cds | 1.00E-12 | <NONE> | <NONE> | <NONE> |
| 4367 | X14448 | Human GLA gene for alpha-D-galactosidase A (EC 3.2.1.22) | 3 | <NONE> | <NONE> | <NONE> |
| 4368 | U95102 | *Xenopus laevis* mitotic phosphoprotein 90 mRNA, complete cds | 5.00E-04 | 3873753 | (Z66519) similar to phytoene synthase precursor; cDNA EST yk340f7.3 comes from this gene; cDNA EST | 2e-008 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | yk340f7.5 comes from this gene [*Caenorhabditis elegans*] | |
| 4369 | X04098 | Human mRNA for cytoskeletal gamma-actin | 0 | <NONE> | <NONE> | <NONE> |
| 4370 | M13452 | Human lamin A mRNA, 3' end. | 0 | 125962 | LAMIN A (70 KD LAMIN) | 3e-057 |
| 4371 | AF068863 | *Homo sapiens* oligodendrocyte-specific protein | 3.4 | <NONE> | <NONE> | <NONE> |
| 4372 | U95098 | *Xenopus laevis* mitotic phosphoprotein 44 mRNA, partial cds | 1.40E-01 | <NONE> | <NONE> | <NONE> |
| 4373 | L04636 | *Homo sapiens* pre-mRNA splicing factor 2 p32 subunit (SF2p32) mRNA, complete cds. | 0 | 730772 | COMPLEMENT COMPONENT 1, Q SUBCOMPONENT BINDING PROTEIN PRECURSOR (GLYCOPROTEIN GC1QBP) (GC1Q-R PROTEIN) (HYALURONAN-BINDING PROTEIN 1) chain precursor - human >gi\|338045 (L04636) splicing factor [*Homo sapiens*] >gi\|472956 (X75913) gCIq-R [*Homo sapiens*] >gi | 2e-050 |
| 4374 | M59832 | Human merosin mRNA, 3' end. | 0.043 | <NONE> | <NONE> | <NONE> |
| 4375 | <NONE> | <NONE> | <NONE> | 188864 | (M74027) mucin [*Homo sapiens*] | 0.042 |
| 4376 | X17206 | Human mRNA for LLRep3 | 0 | 88570 | ribosomal protein S2 - [human (fragment) *sapiens*] | 6e-078 |
| 4377 | X17206 | Human mRNA for LLRep3 | 0 | 88570 | ribosomal protein S2 - [human (fragment) *sapiens*] | 6e-078 |
| 4378 | <NONE> | <NONE> | <NONE> | <NONE> | <NONE> | <NONE> |
| 4379 | X98420 | *S. shibatae* topR gene | 1.10E+00 | 2746890 | (AF040655) No definition line found [*Caenorhabditis elegans*] | 9.3 |
| 4380 | X98420 | *S. shibatae* topR gene | 1.10E+00 | 2746890 | (AF040655) No definition line found [*Caenorhabditis elegans*] | 9.3 |
| 4381 | X75787 | *P. falciparum* (FAF-2) mRNA for aspartic hemoglobinase | 4 | <NONE> | <NONE> | <NONE> |
| 4382 | AF044209 | *Homo sapiens* nuclear receptor co-repressor N-CoR mRNA, complete cds | 0 | 3510603 | (AF044209) nuclear receptor co-repressor N-CoR [*Homo sapiens*] | 4e-029 |
| 4383 | <NONE> | <NONE> | <NONE> | <NONE> | <NONE> | <NONE> |
| 4384 | X64707 | *H. sapiens* BBC1 | e-110 | 1350662 | 60S | 0.003 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mRNA | | | RIBOSOMAL PROTEIN L13 (A52) | |
| 4385 | Z70316 | *D. melanogaster* mRNA for tyramine-beta-hydroxylase | 1.5 | <NONE> | <NONE> | <NONE> |
| 4386 | AF000371 | *Vitis vinifera* UDP glucose:flavonoid 3-o-glucosyltransferase mRNA, partial cds | 0.19 | <NONE> | <NONE> | <NONE> |
| 4387 | U95094 | *Xenopus laevis* XL-INCENP (XL-INCENP) mRNA, complete cds | 3e-013 | 2072296 | (U95098) mitotic phosphoprotein 44 [*Xenopus laevis*] | 1.8 |
| 4388 | AE000688 | *Aquifex aeolicus* section 20 of 109 of the complete genome | 3.8 | <NONE> | <NONE> | <NONE> |
| 4389 | L05612 | *Dictyostelium purpureum* DNA sequence, repeat region. | 2.8 | <NONE> | <NONE> | <NONE> |
| 4390 | U33761 | Human cyclin A/CDK2-associated p45 (Skp2) mRNA, complete cds | 2e-079 | 2134952 | cyclin A/CDK2-associated p45 - [human *sapiens*] | 1e-025 |
| 4391 | U48288 | *Rattus norvegicus* A-kinase anchoring protein AKAP 220 mRNA, complete cds | 0.48 | <NONE> | <NONE> | <NONE> |
| 4392 | AB007963 | *Homo sapiens* mRNA for KIAA0494 protein, complete cds | 0.00E+00 | 3413938 | (AB007963) KIAA0494 protein [*Homo sapiens*] | 6e-071 |
| 4393 | <NONE> | <NONE> | <NONE> | 119110 | EBNA-1 NUCLEAR PROTEIN herpesvirus 4 (strain B95-8) >gi|1334880 (V01555) BKRF1 encodes EBNA-1 protein, latent cycle gene. [Human herpesvirus 4] | 6e-027 |
| 4394 | U52784 | *Ansonia muelleri* CMNH H1476 16S rRNA gene, mitochondrial gene encoding mitochondrial rRNA, partial sequence | 0.014 | <NONE> | <NONE> | <NONE> |
| 4395 | <NONE> | <NONE> | <NONE> | <NONE> | <NONE> | <NONE> |
| 4396 | <NONE> | <NONE> | <NONE> | <NONE> | <NONE> | <NONE> |
| 4397 | U38376 | *Rattus norvegicus* cytosolic phospholipase A2 mRNA, complete cds | 1.1 | <NONE> | <NONE> | <NONE> |
| 4398 | U78770 | *Mus musculus* spasmolytic polypeptide (mSP) gene, | 0.028 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4399 | U95102 | complete cds Xenopus laevis mitotic phosphoprotein 90 mRNA, complete cds | 0.12 | <NONE> | <NONE> | <NONE> |
| 4400 | U95094 | Xenopus laevis XL-INCENP (XL-INCENP) mRNA, complete cds | 2e-014 | 2072296 | (U95098) mitotic phosphoprotein 44 [Xenopus laevis] | 5.8 |
| 4401 | U95098 | Xenopus laevis mitotic phosphoprotein 44 mRNA, partial cds | 0.0003 | <NONE> | <NONE> | <NONE> |
| 4402 | X70288 | H. sapiens gene for thioredoxin, exons 4 and 5 | 3e-030 | <NONE> | <NONE> | <NONE> |
| 4403 | X76683 | Plasmid vector pHM2 betalactamase gene | 7e-080 | 987050 | (X65335) lacZ gene product [unidentified cloning vector] | 3e-015 |
| 4404 | X69295 | H. sapiens MSX2 mRNA for transcription factor | 0.43 | <NONE> | <NONE> | <NONE> |
| 4405 | U20371 | Mus musculus homeobox protein (Hoxa11) gene, complete cds. | 0.6 | <NONE> | <NONE> | <NONE> |
| 4406 | D49842 | Rabbit mRNA for CD86, complete cds | 1.10E+00 | 135554 | TETRACYCLINE RESISTANCE PROTEIN Bacillus cereus plasmid pBC16 >gi\|72838\|pir\|YTSOG tetracycline resistance protein - Streptococcus agalactiae plasmid pMV158 >gi\|80428\|pir\|JQ1211 tetracycline resistance protein - Bacillus sp. plasmid pTB19 >gi\|151696 (M63 | 1.4 |
| 4407 | AB007194 | Oryza sativa mRNA for fructose-1,6-bisphosphatase (plastidic isoform), complete cds | 3.5 | <NONE> | <NONE> | <NONE> |
| 4408 | U95098 | Xenopus laevis mitotic phosphoprotein 44 mRNA, partial cds | 1e-007 | <NONE> | <NONE> | <NONE> |
| 4409 | <NONE> | <NONE> | <NONE> | <NONE> | <NONE> | <NONE> |
| 4410 | U28924 | Pisum sativum cytosolic glutamine synthetase | 0.008 | 3769486 | (AF074946) DNA polymerase [hemorrhagic enteritis virus] | 1.3 |
| 4411 | D30783 | Homo sapiens mRNA for epiregulin, complete cds | 0 | 1723438 | HYPOTHETICAL 52.3 KD PROTEIN C56F8.06C IN CHROMOSOME I PRECURSOR >gi\|1204228 (Z69728) | 0.13 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4412 | AJ012449 | *Homo sapiens* mRNA for NS1-binding protein | 0 | 3851214 | unknown [*Schizosaccharomyces pombe*] (AJ012449) NS1-binding protein [*Homo sapiens*] | 4e-088 |
| 4413 | X62357 | *H. sapiens* Alu repeat (clones 2-48) | 1e-006 | <NONE> | <NONE> | <NONE> |
| 4414 | U95102 | *Xenopus laevis* mitotic phosphoprotein 90 mRNA, complete cds | 6.00E-05 | <NONE> | <NONE> | <NONE> |
| 4415 | Z15015 | *D. pulex* mitochondrion genes for NADH dehydrogenase subunit 2, cytochrome C oxidase subunit 1, tRNA-Val, tRNA-Ile, tRNA-Gln, tRNA-fMet, tRNA-Trp, tRNA-Cys, tRNA-Tyr, small subunit rRNA, large subunit rRNA | 2.2 | 1076802 | extensin-like protein - maize >gi\|600118 | 8e-027 |
| 4416 | D87942 | *Homo sapiens* mRNA for alpha(1,2)fucosyl transferase, complete cds | 2e-027 | 728838 | !!!! ALU SUBFAMILY SX WARNING ENTRY | 7.5 |
| 4417 | D86977 | Human mRNA for KIAA0224 gene, complete cds | 0 | 3024898 | PUTATIVE PRE-MRNA SPLICING FACTOR ATP-DEPENDENT RNA HELICASE KIAA0224 (HA4657) putative ATP-dependent RNA helicase K03H1.2 of *C. elegans* (S41025) [*Homo sapiens*] >gi\|3123906 (AF038391) pre-mRNA splicing factor [*Homo sapiens*] | 2e-053 |
| 4418 | L28010 | *Homo sapiens* HnRNP F protein mRNA, complete cds | 0 | 1710628 | HETEROGENEOUS NUCLEAR RIBONUCLEOPROTEIN F (HNRNP F) >gi\|631210\|pir\|S43484 hnRNP F protein - human >gi\|452048 (L28010) HnRNP F protein [*Homo sapiens*] | 5e-045 |
| 4419 | U95094 | *Xenopus laevis* XL-INCENP (XL-INCENP) mRNA, complete cds | 3e-009 | <NONE> | <NONE> | <NONE> |
| 4420 | U95094 | *Xenopus laevis* XL-INCENP (XL-INCENP) mRNA, complete | 3e-009 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4421 | X14313 | *Arabidopsis* CRB gene for 12S seed storage protein > gene, exons 1–4. | 0.24 | <NONE> | <NONE> | <NONE> |
| 4422 | X14313 | *Arabidopsis* CRB gene for 12S seed storage protein > gene, exons 1–4. | 0.24 | <NONE> | <NONE> | <NONE> |
| 4423 | U95094 | *Xenopus laevis* XL-INCENP (XL-INCENP) mRNA, complete cds | 3e-009 | <NONE> | <NONE> | <NONE> |
| 4424 | U95098 | *Xenopus laevis* mitotic phosphoprotein 44 mRNA, partial cds | 3.00E-08 | 1125753 | (U42833) coded for by *C. elegans* cDNA CEESN37F; Similar to ammonium transport protein. [*Caenorhabditis elegans*] | 1e-019 |
| 4425 | U95094 | *Xenopus laevis* XL-INCENP (XL-INCENP) mRNA, complete cds | 2.00E-05 | <NONE> | <NONE> | <NONE> |
| 4426 | U95102 | *Xenopus laevis* mitotic phosphoprotein 90 mRNA, complete cds | 3e-009 | 1125753 | (U42833) coded for by *C. elegans* cDNA CEESN37F; Similar to ammonium transport protein. [*Caenorhabditis elegans*] | 2e-008 |
| 4427 | AF053649 | *Homo sapiens* cellular apoptosis susceptibility protein (CSE1) gene, exons 15 and 16 | 3e-008 | <NONE> | <NONE> | <NONE> |
| 4428 | U95098 | *Xenopus laevis* mitotic phosphoprotein 44 mRNA, partial cds | 1e-007 | 2072296 | (U95098) mitotic phosphoprotein 44 [*Xenopus laevis*] | 8.8 |
| 4429 | X94253 | *S. scrofa* mRNA for heterogeneous nuclear ribonucleoprotein | 6e-023 | <NONE> | <NONE> | <NONE> |
| 4430 | AF005039 | *Homo sapiens* secretory carrier membrane protein | 0 | 2232243 | (AF005039) secretory carrier membrane protein [*Homo sapiens*] | 8e-008 |
| 4431 | AF037332 | *Homo sapiens* Eph-like receptor tyrosine kinase hEphB1b (EphB1) mRNA, complete cds | 0.12 | 3861156 | (AJ235272) unknown [*Rickettsia prowazekii*] | 0.37 |
| 4432 | D28124 | Human mRNA for unknown product, complete cds | 7e-067 | <NONE> | <NONE> | <NONE> |
| 4433 | U95094 | *Xenopus laevis* XL-INCENP (XL-INCENP) mRNA, complete cds | 3e-013 | <NONE> | <NONE> | <NONE> |
| 4434 | M93426 | Human protein tyrosine phosphatase zeta- | 0 | 400199 | PROTEIN-TYROSINE PHOSPHATASE | 4e-051 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | polypeptide (PTPRZ) mRNA, complete cds. > :: gb|G20044|G200 44 sWSS1987 Eric D. Green *Homo sapiens* STS genomic, sequence tagged site [*Homo sapiens*] | | | ZETA PRECURSOR (R-PTP-ZETA) >gi|476869|pir||A4 6151 protein-tyrosine-phosphatase (EC 3.1.3.48), receptor type zeta - human >gi|190744 (M93426) protein tyrosine phosphatase zeta-polypeptide [*Homo sapiens*] | |
| 4435 | U54562 | Human translation initiation factor eIF3 p48 subunit (Int-6) mRNA, complete cds | 0 | 2498490 | VIRAL INTEGRATION SITE PROTEIN INT-6 >gi|1854579 (L35556) Int-6 [*Mus musculus*] sapiens] >gi|2351382 (U54562) eIF3-p48 [*Homo sapiens*] sapiens] | e-110 |
| 4436 | U54562 | Human translation initiation factor eIF3 p48 subunit (Int-6) mRNA, complete cds | 0 | 2498490 | VIRAL INTEGRATION SITE PROTEIN INT-6 >gi|1854579 (L35556) Int-6 [*Mus musculus*] sapiens] >gi|2351382 (U54562) eIF3-p48 [*Homo sapiens*] sapiens] | e-110 |
| 4437 | U95102 | *Xenopus laevis* mitotic phosphoprotein 90 mRNA, complete cds | 0.12 | <NONE> | <NONE> | <NONE> |
| 4438 | U95094 | *Xenopus laevis* XL-INCENP (XL-INCENP) mRNA, complete cds | 3e-009 | <NONE> | <NONE> | <NONE> |
| 4439 | X03558 | Human mRNA for elongation factor 1 alpha subunit | 0 | 1169475 | ELONGATION FACTOR 1-ALPHA 1 | 4e-083 |
| 4440 | J03607 | Human 40-kDa keratin intermediate filament precursor gene. | 0 | 1070608 | keratin 19, type 1, cytoskeletal - [human sapiens] | 4e-058 |
| 4441 | <NONE> | <NONE> | <NONE> | 4063042 | (AF068065) GP900; mucin-like glycoprotein [*Cryptosporidium parvum*] | 0.011 |
| 4442 | <NONE> | <NONE> | <NONE> | 4063042 | (AF068065) GP900; mucin-like glycoprotein [*Cryptosporidium parvum*] | 0.011 |
| 4443 | Y13401 | *Homo sapiens* CD3 delta gene, enhancer sequence | 8e-008 | <NONE> | <NONE> | <NONE> |
| 4444 | X04409 | Human mRNA for coupling | 0 | 71879 | GTP-binding regulatory protein | 7e-092 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | protein G(s) alpha-subunit (alpha-S1) (stimulatory regulatory component Gs of adenylyl cyclase) | | | Gs alpha chain G-s-alpha-4 [Homo sapiens] | |
| 4445 | AF038958 | Homo sapiens synaptic glycoprotein SC2 spliced variant mRNA, complete cds | 1e-072 | 3329386 | (AF038958) synaptic glycoprotein SC2 spliced variant | 6e-019 |
| 4446 | D17244 | Human HepG2 3' region MboI cDNA, clone hmd4h04m3 | 1e-075 | 2500256 | 50S RIBOSOMAL PROTEIN L13 protein L13 [Streptomyces coelicolor] | 0.043 |
| 4447 | <NONE> | <NONE> | <NONE> | 4063042 | (AF068065) GP900; mucin-like glycoprotein [Cryptosporidium parvum] | 0.005 |
| 4448 | M24597 | Beet curly top virus (clone pBCT028) DNA, complete genome. | 4.1 | <NONE> | <NONE> | <NONE> |
| 4449 | U59706 | Gallus gallus alternatively spliced AMPA glutamate receptor, isoform GluR2 flop, (GluR2) mRNA, partial cds. | 0.014 | 3283975 | (AF072521) poly-(ADPribosyl)-transferase homolog PARP | 0.02 |
| 4450 | AJ010014 | Homo sapiens mRNA for M96A protein | 0 | 3342452 | (AF072814) PHD finger DNA binding protein isoform 1 | 2e-029 |
| 4451 | <NONE> | <NONE> | <NONE> | <NONE> | <NONE> | <NONE> |
| 4452 | X06960 | Aspergillus nidulans mitochondrial DNA for cytochrome oxidase subunit 3, tRNA-Tyr | 0.23 | <NONE> | <NONE> | <NONE> |
| 4453 | L01089 | Human profilaggrin (FLG) gene exons 2–3, 5'end. | 1.3 | <NONE> | <NONE> | <NONE> |
| 4454 | X65319 | Cloning vector pCAT-Enhancer | 1e-071 | 987050 | (X65335) lacZ gene product [unidentified cloning vector] | 1e-014 |
| 4455 | X87212 | H. sapiens mRNA for cathepsin C | 0 | 1582221 | prepro-cathepsin C [Homo sapiens] | 6e-046 |
| 4456 | X53123 | Cloning vector pAST 19a for C. elegans | 5 | <NONE> | <NONE> | <NONE> |
| 4457 | D15057 | Human mRNA for DAD-1, complete cds | 0 | 2944452 | (AF051310) defender against death 1 [Mus musculus] | 1e-015 |
| 4458 | X83860 | H. sapiens mRNA for prostaglandin E receptor (EP3c) | 1.2 | 2137044 | unknown protein - [rabbit (fragment) cuniculus] | 7e-014 |
| 4459 | M95058 | Rattus rattus steroid 5-alpha-reductase 2 mRNA, complete cds. | 0.42 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4460 | AF044588 | *Homo sapiens* protein regulating cytokinesis 1 | 2e-043 | 2865521 | (AF044588) protein regulating cytokinesis 1; PRC1 [*Homo sapiens*] | 4e-015 |
| 4461 | X54282 | Human chromosome 11 DNA, approx. 20 kb 3' of beta-globin gene, nuclear scaffold associated region | 0.014 | 1911867 | cadherin 3 [*Caenorhabditis elegans*, Peptide, 3337 aa] | 9.8 |
| 4462 | U95102 | *Xenopus laevis* mitotic phosphoprotein 90 mRNA, complete cds | 3e-010 | 3875640 | (Z92781) F09C3.3 [*Caenorhabditis elegans*] | 9.6 |
| 4463 | M73791 | Human novel gene mRNA, complete cds. | 0 | 1172810 | 60S RIBOSOMAL PROTEIN L10 (QM PROTEIN HOMOLOG) >gi|543339|pir||JC 2013 ribosomal protein L10, cytosolic - mouse >gi|2143959|pir||JC4911 ribosomal protein L10 - rat >gi|407466 (X75312) QM protein [*Mus musculus*] >gi|410742 (M93980) 24.6 kda protein [*Mus musc*] | 7e-085 |
| 4464 | <NONE> | <NONE> | <NONE> | <NONE> | <NONE> | <NONE> |
| 4465 | Z27116 | *S. cerevisiae* HBS1, MRP-L20 and PRP-16 genes | 0.058 | <NONE> | <NONE> | <NONE> |
| 4466 | <NONE> | <NONE> | <NONE> | <NONE> | <NONE> | <NONE> |
| 4467 | M96575 | *Drosophila melanogaster* collagen type IV gene, complete cds. | 3.60E+00 | <NONE> | <NONE> | <NONE> |
| 4468 | D50010 | Human DNA for alpha-platelet-derived growth factor receptor, exon 15 | 1e-006 | <NONE> | <NONE> | <NONE> |
| 4469 | X70649 | *Homo sapiens* DDX1 gene, complete CDS | 0 | 539572 | DEAD box protein RB - human | 3e-036 |
| 4470 | AJ223377 | *Puumala* virus S-segment RNA | 1.4 | <NONE> | <NONE> | <NONE> |
| 4471 | Y14599 | *Staphylococcus xylosus* lacR, lacP, lacH genes and 2 ORF's | 1.4 | 3659505 | (AC005084) similar to mouse mCASK-A; similar to e1288039 | 0.63 |
| 4472 | X13336 | Spinach plastid genes rps3, rps19, rpl14, rpl16 and rpl22 for ribosomal proteins S3, S19, L14, L16 and L22 | 0.15 | 1330375 | (U58758) similar to rat GAP-associated protein p190 | 0.27 |
| 4473 | AF056022 | *Homo sapiens* p60 katanin mRNA, complete cds | 0 | 3283072 | (AF056022) p60 katanin [*Homo sapiens*] | 7e-029 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4474 | U95102 | *Xenopus laevis* mitotic phosphoprotein 90 mRNA, complete cds | 0.0002 | <NONE> | <NONE> | <NONE> |
| 4475 | M86849 | Human connexin 26 (GJB2) mRNA. | 0 | 127542 | ALDOSE 1-EPIMERASE PRECURSOR [*calcoaceticus*] | 5.2 |
| 4476 | <NONE> | <NONE> | <NONE> | <NONE> | <NONE> | <NONE> |
| 4477 | X95455 | *G. gallus* mRNA for RING zinc finger | 9e-031 | 1321818 | (X95455) RING zinc finger protein protein [*Gallus gallus*] | 9e-038 |
| 4478 | U95098 | *Xenopus laevis* mitotic phosphoprotein 44 mRNA, partial cds | 0.13 | <NONE> | <NONE> | <NONE> |
| 4479 | J03607 | Human 40-kDa keratin intermediate filament precursor gene. | 0 | 1070608 | keratin 19, type 1, cytoskeletal - [human *sapiens*] | 9e-068 |
| 4480 | M90104 | Human splicing factor SC35 mRNA, complete cds. | e-120 | 3929382 | SPLICING FACTOR, ARGININE/SERINE-RICH 10 (PUTATIVE MYELIN REGULATORY FACTOR 1) (MRF-1) >gi\|555924 (U14648) putative myelin regulatory factor 1; MRF-1 [*Mus musculus*] | 1.1 |
| 4481 | AF020762 | *Homo sapiens* clone 1400 unknown protein mRNA, partial cds | 6e-067 | <NONE> | <NONE> | <NONE> |
| 4482 | AE001386 | *Plasmodium falciparum* chromosome 2, section 23 of 73 of the complete sequence | 0.72 | <NONE> | <NONE> | <NONE> |
| 4483 | AF054868 | *Pseudomonas aeruginosa* autoinducer synthetase chloramphenicol-sensitive protein (rarD), and hypothetical protein (yafL) gene . . . | 0.005 | 1709793 | SALIVARY PROLINE-RICH PROTEIN PO [*sapiens*] | 0.13 |
| 4484 | <NONE> | <NONE> | <NONE> | <NONE> | <NONE> | <NONE> |
| 4485 | <NONE> | <NONE> | <NONE> | <NONE> | <NONE> | <NONE> |
| 4486 | AE001406 | *Plasmodium falciparum* chromosome 2, section 43 of 73 of the complete sequence | 0.001 | <NONE> | <NONE> | <NONE> |
| 4487 | AE001417 | *Plasmodium falciparum* chromosome 2, section 54 of 73 of the complete sequence | 2.1 | <NONE> | <NONE> | <NONE> |
| 4488 | X90446 | Canine | 4.4 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | herpesvirus DNA for ORF 1 (HSV1 UL44, EHV1 ORF 15 homolog) ORF2 (EHV1 ORF 16 homolog) | | | | |
| 4489 | U95102 | *Xenopus laevis* mitotic phosphoprotein 90 mRNA, complete cds | 0.17 | 4008355 | (Z68297) Similarity to Yeast TAT-binding homolog 7 (SW:TBP7_YEAST); cDNA EST EMBL:D37124 comes from this gene; cDNA EST EMBL:D35150 comes from this gene; cDNA EST EMBL:D35400 comes from this gene; cDNA EST EMBL:D34900 comes . . . >gi\|4008373\|gnl\|PID\|e135984 | 3e-007 |
| 4490 | D78130 | *Homo sapiens* mRNA for squalene epoxidase, complete cds | 0 | 2443316 | (D78130) squalene epoxidase [*Homo sapiens*] | 5e-008 |
| 4491 | L18931 | *Buchnera aphidicola* Arginyl tRNA synthetase promoter region. | 0.16 | <NONE> | <NONE> | <NONE> |
| 4492 | X17206 | Human mRNA for LLRep3 | e-112 | 1350976 | 40S RIBOSOMAL PROTEIN S2 >gi\|939718 | 2e-005 |
| 4493 | D28473 | Human T-lymphocyte mRNA for isoleucyl-tRNA synthetase, complete cds | e-157 | 440799 | (U04953) isoleucyl-tRNA synthetase [*Homo sapiens*] | 3e-005 |
| 4494 | L13624 | *Cercopithecus aethiops* C4 complement | 3.6 | <NONE> | <NONE> | <NONE> |
| 4495 | M13011 | Rat c-ras-H-1 gene, complete cds. | 0.25 | <NONE> | <NONE> | <NONE> |
| 4496 | Y10252 | *L. japonicus* panC gene | 0.38 | 627071 | histidine-rich protein - *Plasmodium lophurae* | 4.4 |
| 4497 | X76683 | Plasmid vector pHM2 betalactamase gene | 1e-093 | 987050 | (X65335) lacZ gene product [unidentified cloning vector] | 3e-015 |
| 4498 | M24486 | Human prolyl 4-hydroxylase alpha subunit mRNA, complete cds, clone PA-11. | 0 | 129365 | PROLYL 4-HYDROXYLASE ALPHA SUBUNIT 1.14.11.2) alpha chain - chicken | 2e-057 |
| 4499 | D80004 | Human mRNA for KIAA0182 gene, partial cds | 2e-068 | <NONE> | <NONE> | <NONE> |
| 4500 | U22233 | Human methylthioadenosine phosphorylase (MTAP) mRNA, complete cds. | 0 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4501 | D63875 | Human mRNA for KIAA0155 gene, complete cds > :: gb\|G28541\|G28541 human STS SHGC-31621. | 0 | 961442 | (D63875) KIAA0155 gene product is related to C. elegans B0464.2 protein. [Homo sapiens] | 2e-019 |
| 4502 | <NONE> | <NONE> | <NONE> | <NONE> | <NONE> | <NONE> |
| 4503 | X85018 | H. sapiens mRNA for UDP-GalNAc:polypeptide N-acetylgalactosaminyltransferase (T1) | e-110 | 1709559 | POLYPEPTIDE N-ACETYLGALACTOSAMINYLTRANSFERASE (PROTEIN-UDP ACETYLGALACTOSAMINYLTRANSFERASE) N-ACETYLGALACTOSAMINYLTRANSFERASE) (GALNAC-T1) polypeptide N-acetylgalactosaminyltransferase [Rattus norvegicus] | 2e-018 |
| 4504 | <NONE> | <NONE> | <NONE> | <NONE> | <NONE> | <NONE> |
| 4505 | <NONE> | <NONE> | <NONE> | <NONE> | <NONE> | <NONE> |
| 4506 | AF067782 | Papio hamadryas BC200 alpha scRNA gene, complete sequence | 0.48 | <NONE> | <NONE> | <NONE> |
| 4507 | AF073298 | Homo sapiens 4F5rel mRNA, complete cds | e-166 | 3641536 | (AF073297) 4F5rel [Mus. musculus] >gi\|3641538 (AF073298) 4F5rel [Homo sapiens] | 3e-013 |
| 4508 | M12922 | Yeast (S. cerevisiae) chromosome III L terminal region DNA. | 2e-010 | 188864 | (M74027) mucin [Homo sapiens] | 6e-023 |
| 4509 | X69524 | M. squamata cabcl mRNA for chlorophyll a/b/c binding protein precursor | 1.3 | <NONE> | <NONE> | <NONE> |
| 4510 | U95098 | Xenopus laevis mitotic phosphoprotein 44 mRNA, partial cds | 1.2 | <NONE> | <NONE> | <NONE> |
| 4512 | U12404 | Human Csa-19 mRNA, complete cds. | 0 | 1709973 | 60S RIBOSOMAL PROTEIN L10A (CSA-19) | 4e-056 |
| 4513 | U95094 | Xenopus laevis XL-INCENP (XL-NCENP) mRNA, complete cds | 8e-014 | <NONE> | <NONE> | <NONE> |
| 4514 | <NONE> | <NONE> | <NONE> | 121627 | GLYCINE-RICH CELL WALL STRUCTURAL PROTEIN 1 PRECURSOR >gi\|82244\|pir\|\|A26099 glycine-rich cell wall structural protein - [garden petunia >gi\|20553 | 2e-030 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4515 | D87255 | Hepatitis G virus RNA for polyprotein, complete cds | 0.19 | 930045 | *hybrida*] >gi\|225181\|prf\|\|12 10313A Gly rich structural protein [*Petunia* sp.] (X15332) alpha-1 (III) collagen [*Homo sapiens*] | 0.002 |
| 4516 | U31820 | *Gallus gallus* Mel-1a melatonin receptor mRNA, complete cds. | 3.3 | 1718187 | ENVELOPE GLYCOPROTEIN GP340 glycoprotein 350/220 - [human herpesvirus 4 >gi\|59164 virus] >gi\|306293 (L07923) glycoprotein 340 | 0.096 |
| 4517 | X68107 | *M. sativa* msCHSII mRNA for chalcone synthase | 3.4 | <NONE> | <NONE> | <NONE> |
| 4518 | <NONE> | <NONE> | <NONE> | <NONE> | <NONE> | <NONE> |
| 4519 | U95098 | *Xenopus laevis* mitotic phosphoprotein 44 mRNA, partial cds | 6e-006 | 1065484 | (U40415) similar to *S. cerevisiae* LAG1 (SP:P38703) | 0.001 |
| 4520 | D87671 | Rat mRNA for TIP120, complete cds | 1e-043 | 1799570 | (D87671) TIP120 [*Rattus norvegicus*] | 0.01 |
| 4521 | <NONE> | <NONE> | <NONE> | <NONE> | <NONE> | <NONE> |
| 4522 | <NONE> | <NONE> | <NONE> | <NONE> | <NONE> | <NONE> |
| 4523 | X16869 | Human mRNA for elongation factor 1-alpha (clone CEF4) | 4e-022 | 1085204 | translation elongation factor eEF-1 alpha chain - zebra fish >gi\|408805 (L23807) elongation factor 1-alpha [*Danio rerio*] >gi\|454915 (X77689) translational elongation factor-1 alpha [*Danio rerio*] >gi\|1009241 [*rerio*] >gi\|1091578\|prf\|\|2 021264A elongation fact | 5.1 |
| 4524 | U95102 | *Xenopus laevis* mitotic phosphoprotein 90 mRNA, complete cds | 3e-010 | <NONE> | <NONE> | <NONE> |
| 4525 | U95102 | *Xenopus laevis* mitotic phosphoprotein 90 mRNA, complete cds | 2e-007 | <NONE> | <NONE> | <NONE> |
| 4526 | <NONE> | <NONE> | <NONE> | <NONE> | <NONE> | <NONE> |
| 4527 | AF069250 | *Homo sapiens* okadaic acid-inducible phosphoprotein (OA48-18) mRNA, complete cds | 7e-080 | 3037018 | (AF041330) NADH dehydrogenase subunit 5 [*Bodo saltans*] | 0.0001 |
| 4528 | AF069250 | *Homo sapiens* okadaic acid-inducible phosphoprotein (OA48-18) | 7e-080 | 3037018 | (AF041330) NADH dehydrogenase subunit 5 [*Bodo saltans*] | 0.0001 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4529 | U66532 | mRNA, complete cds Human beta4-integrin (ITGB4) gene, exons 7, 8, 9, 10, 11 and 12 | 0.51 | 119110 | EBNA-1 NUCLEAR PROTEIN herpesvirus 4 (strain B95-8) >gi|1334880 (V01555) BKRF1 encodes EBNA-1 protein, latent cycle gene. [Human herpesvirus 4] | 1e-023 |
| 4530 | X65329 | Cloning vector pCAT-Enhancer | 1e-074 | 987050 | (X65335) lacZ gene product [unidentified cloning vector] | 8e-011 |
| 4531 | AJ010841 | *Homo sapiens* mRNA for putative thioredoxin-like protein | 8e-028 | 3646128 | (AJ010841) thioredoxin-like protein | 0.062 |
| 4532 | D14034 | Human gene for Zn-alpha2-glycoprotein, complete cds | 0.005 | <NONE> | <NONE> | <NONE> |
| 4533 | M12670 | Human fibroblast collagenase inhibitor mRNA, complete cds. | 6e-098 | 1351250 | METALLOPROTEINASE INHIBITOR 1 PRECURSOR (TIMP-1) >gi|1363927|pir|J C4303 matrix metalloproteinase-1 tissue inhibitor - baboon >gi|561546 [*hamadryas cynocephalus*] | 7e-008 |
| 4534 | M17196 | *A. californica* (marine gastropod mollusc) neuropeptide gene (ganglion R14), exon 1, 5' end. | 0.019 | 2135765 | mucin 2 precursor, intestinal - human | 0.003 |
| 4535 | AJ001454 | *Homo sapiens* mRNA for testican-3 | 1.4 | <NONE> | <NONE> | <NONE> |
| 4536 | X75757 | *G. gallus* cycB3 mRNA. | 9e-040 | 729112 | G2/MITOTIC-SPECIFIC CYCLIN B3 | 9e-019 |
| 4537 | Z27116 | *S. cerevisiae* HBS1, MRP-L20 and PRP-16 genes | 0.058 | <NONE> | <NONE> | <NONE> |
| 4538 | AF083322 | *Homo sapiens* centriole associated protein CEP110 mRNA, complete cds | 9e-051 | 1079393 | chromokinesin - chicken >gi|603761 (U18309) chromokinesin [*Gallus gallus*] | 0.012 |
| 4539 | <NONE> | <NONE> | <NONE> | <NONE> | <NONE> | <NONE> |
| 4540 | M26325 | Human cytokeratin 18 mRNA, 3' end. | 0 | 125083 | KERATIN, TYPE I CYTOSKELETAL 18 keratin 18, type I, cytoskeletal - human >gi|34037 | 2e-093 |
| 4541 | U37066 | Human endogenous retrovirus strain | 1.3 | 252486 | P-selectin, CD62 [mice, Peptide, [768 aa] *musculus*] | 1.8 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4542 | Z30543 | XA38 pol polyprotein (pol) gene, partial cds | 2e-027 | <NONE> | <NONE> | <NONE> |
| 4543 | M90077 | Turkey herpesvirus (HVT-delUs-Beta1 PKI3) gene for protein kinase | 0.14 | <NONE> | <NONE> | <NONE> |
| | | Wheat translation elongation factor 1 alpha-subunit (TEF1) mRNA, complete cds. | | | | |
| 4544 | AJ001235 | *Papio hamadryas* ERV-9 like LTR insertion | 2e-044 | <NONE> | <NONE> | <NONE> |
| 4545 | <NONE> | <NONE> | <NONE> | <NONE> | <NONE> | <NONE> |
| 4546 | AF100654 | *Caenorhabditis elegans* cosmid C24E9 | 0.41 | <NONE> | <NONE> | <NONE> |
| 4547 | L28821 | *Homo sapiens* alpha mannosidase II isozyme mRNA, complete cds. | 0 | 1679607 | (X97650) myosin-I [*Mus musculus*] | 4.5 |
| 4548 | U95094 | *Xenopus laevis* XL-INCENP (XL-INCENP) mRNA, complete cds | 4e-013 | <NONE> | <NONE> | <NONE> |
| 4549 | L20140 | *Zea mays* pollen specific pectate lyase homologue gene, complete cds. | 0.92 | <NONE> | <NONE> | <NONE> |
| 4550 | U33955 | Human Down Syndrome region of chromosome 21, genomic sequence, clone A12H1-1F2. | 4.4 | <NONE> | <NONE> | <NONE> |
| 4551 | U95094 | *Xenopus laevis* XL-INCENP (XL-INCENP) mRNA, complete cds | 0.0005 | <NONE> | <NONE> | <NONE> |
| 4552 | U95094 | *Xenopus laevis* XL-INCENP (XL-INCENP) mRNA, complete cds | 0.042 | <NONE> | <NONE> | <NONE> |
| 4553 | X12660 | Human chromosome 14 Ig JH (switch mu) DNA showing scattered homology to bcl2 gene exon 2 3'UTR | 1e-006 | 2117245 | (Z95586) hypothetical protein Rv1592c | 2.1 |
| 4554 | U95102 | *Xenopus laevis* mitotic phosphoprotein 90 mRNA, complete cds | 0.002 | 284314 | modulator recognition factor 1 - human factor I [*Homo sapiens*] | 7.1 |
| 4555 | AF070523 | *Homo sapiens* JWA protein mRNA, complete cds | 0 | 3322740 | (AE001222) conserved hypothetical protein [*Treponema pallidum*] | 5.9 |
| 4556 | Z11900 | *H. sapiens* OTF3 gene | 0.13 | <NONE> | <NONE> | <NONE> |
| 4557 | M24972 | *D. discoideum* CT-rich satellite | 4e-007 | 2605798 | (AF027735) minor ampullate silk | 5.30E-01 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4558 | U95098 | rDNA, clone pCT8. *Xenopus laevis* mitotic phosphoprotein 44 mRNA, partial cds | 8e-007 | <NONE> | protein MiSp1 [*Nephila clavipes*] <NONE> | <NONE> |
| 4559 | D32056 | Human gene for 2-oxoglutarate dehydrogenase, exon 1 sequence | 0.06 | <NONE> | <NONE> | <NONE> |
| 4560 | AF034085 | *Caenorhabditis elegans* UNC-45 (unc-45) gene, complete cds | 0.025 | 1652167 | (D90903) hypothetical protein | 4.8 |
| 4561 | AF091242 | *Homo sapiens* ATP sulfurylase/APS kinase 2 mRNA, complete cds | 0.0003 | <NONE> | <NONE> | <NONE> |
| 4562 | M31520 | Human ribosomal protein S24 mRNA. | 1e-031 | 2072296 | (U95098) mitotic phosphoprotein 44 [*Xenopus laevis*] | 5.7 |
| 4563 | <NONE> | <NONE> | <NONE> | <NONE> | <NONE> | <NONE> |
| 4564 | U95094 | *Xenopus laevis* XL-INCENP (XL-INCENP) mRNA, complete cds | 0.0005 | <NONE> | <NONE> | <NONE> |
| 4565 | AB015432 | *Rattus norvegicus* mRNA for LAT1 (L-type amino acid transporter 1), complete cds | 4e-022 | 1665759 | (D87432) Similar to *Schistosoma mansoni* amino acid permease (L25068). [*Homo sapiens*] | 5e-024 |
| 4566 | AE001397 | *Plasmodium falciparum* chromosome 2, section 34 of 73 of the complete sequence | 0.0005 | 3875266 | (Z77655) predicted using Genefinder; similar to 7tm receptor [*Caenorhabditis elegans*] | 5.90E+00 |
| 4567 | AE001397 | *Plasmodium falciparum* chromosome 2, Section 34 of 73 of the complete sequence | 0.0005 | 3875266 | (Z77655) predicted using Genefinder; similar to 7tm receptor [*Caenorhabditis elegans*] | 5.90E+00 |
| 4568 | Y15155 | *Homo sapiens* PHKB gene, exon 8, and repetitive elements | 4e-033 | 2072296 | (U95098) mitotic phosphoprotein 44 [*Xenopus laevis*] | 5.7 |
| 4569 | U95094 | *Xenopus laevis* XL-INCENP (XL-INCENP) mRNA, complete cds | 2.00E-03 | 2622750 | (AE000921) DNA topoisomerase I [*Methanobacterium thermoautotrophicum*] | 2.6 |
| 4570 | AE000688 | *Aquifex aeolicus* section 20 of 109 of the complete genome | 4.5 | <NONE> | <NONE> | <NONE> |
| 4571 | Z95123 | *Caenorhabditis elegans* cosmid VZK822l, complete sequence [*Caenorhabditis elegans*] | 0.4 | <NONE> | <NONE> | <NONE> |
| 4572 | U95102 | *Xenopus laevis* mitotic phosphoprotein 90 mRNA, | 3.00E-08 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4573 | U95094 | *Xenopus laevis* XL-INCENP (XL-INCENP) mRNA, complete cds | 4e-012 | 2072296 | (U95098) mitotic phosphoprotein 44 [*Xenopus laevis*] | 3.3 |
| 4574 | U95102 | *Xenopus laevis* mitotic phosphoprotein 90 mRNA, complete cds | 7e-006 | <NONE> | <NONE> | <NONE> |
| 4575 | U18671 | Human Stat2 gene, complete cds. | 2e-023 | 728831 | !!!! ALU SUBFAMILY J WARNING ENTRY | 0.002 |
| 4576 | Z83241 | *Caenorhabditis elegans* cosmid T25C8, complete sequence [*Caenorhabditis elegans*] | 1.1 | 117698 | IOLD PROTEIN protein [*Bacillus subtilis*] >gi\|2636519\|gnl\|PID\|e1184698 catabolism [*Bacillus subtilis*] | 5.3 |
| 4577 | L04690 | *Cricetulus griseus* cholesterol 7-alpha-hydroxylase gene, complete cds. > :: gb\|I26617\|I26617 Sequence 35 from patent U.S. Pat. No. 5558999 > :: gb\|AR008072\|AR008072 Sequence 35 from patent U.S. Pat. No. 5753431 | 3.2 | 212906 | (L02621) intestinal zipper protein [*Gallus gallus*] | 4.1 |
| 4578 | Z54191 | *A. pleuropneumoniae* tfbB gene encoding transferrin receptor. | 0.54 | 2102696 | (U72761) karyopherin beta 3 [*Homo sapiens*] | 8.6 |
| 4579 | X17025 | Human homolog of yeast IPP isomerase > :: gb\|G27043\|G27043 human STS SHGC-31614. | 2e-035 | <NONE> | <NONE> | <NONE> |
| 4580 | L32977 | *Homo sapiens* (clone f17252) ubiquinol cytochrome c reductase Rieske iron-sulphur protein (UQCRFS1) gene, exon 2 | 0.00E+00 | 1351361 | UBIQUINOL-CYTOCHROME C REDUCTASE IRON-SULFUR SUBUNIT PRECURSOR (RIESKE IRON-SULFUR PROTEIN) (RISP) >gi\|488299 (L32977) Rieske Fe-S protein | 1e-070 |
| 4581 | M26708 | Human prothymosin alpha mRNA (ProT-alpha), complete cds. | 0 | 190369 | (J04798) open reading frame A; putative [*Homo sapiens*] | 6e-018 |
| 4582 | U95094 | *Xenopus laevis* XL-INCENP (XL-INCENP) mRNA, complete cds | 2e-04 | 2314130 | (AE000607) *H. pylori* predicted coding region HP0985 | 3.3 |
| 4583 | U95102 | *Xenopus laevis* mitotic phosphoprotein 90 mRNA, complete cds | 4e-011 | 1236083 | (U49507) Lisch7 [*Mus musculus*] | 4.3 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4584 | U95094 | *Xenopus laevis* XL-INCENP (XL-INCENP) mRNA, complete cds | 2e-014 | 348196 | (L19917) immunoglobulin heavy-chain subgroup VIII V-D-J region [*Homo sapiens*] | 9.7 |
| 4585 | <NONE> | <NONE> | <NONE> | <NONE> | <NONE> | <NONE> |
| 4586 | <NONE> | <NONE> | <NONE> | <NONE> | <NONE> | <NONE> |
| 4587 | X52601 | *H. sapiens* hTOP1 gene for topoisomerase, 5'end | 4.6 | <NONE> | <NONE> | <NONE> |
| 4588 | AF038604 | *Caenorhabditis elegans* cosmid B0546 | 0.17 | <NONE> | <NONE> | <NONE> |
| 4589 | <NONE> | <NONE> | <NONE> | <NONE> | <NONE> | <NONE> |
| 4590 | U23441 | *Tetrahymena thermophila* B internal deletion sequence. | 0.0005 | 1469281 | (U08801) envelope glycoprotein [Human immunodeficiency virus type 1] | 1.1 |
| 4591 | AC005276 | *Homo sapiens* clone fragment UWGC:gap3 from 7q31.3, complete sequence [*Homo sapiens*] | 0.009 | <NONE> | <NONE> | <NONE> |
| 4592 | D84117 | *Homo sapiens* DNA for prostacyclin synthase, exon 3 | 0.48 | <NONE> | <NONE> | <NONE> |
| 4593 | U28153 | *Caenorhabditis elegans* UNC-76 (unc-76) gene, complete cds. | 1.30E-01 | <NONE> | <NONE> | <NONE> |
| 4594 | U67274 | Human metastasis suppressor (KAII) gene, exon 1, and complete cds | 1e-008 | <NONE> | <NONE> | <NONE> |
| 4595 | AF009621 | *Onchocerca volvulus* cytosolic Cu/Zn superoxide dismutase (OvSOD1) and extracellular Cu/Zn superoxide dismutase (OvSOD2) genes, complete cds | 4 | <NONE> | <NONE> | <NONE> |
| 4596 | <NONE> | <NONE> | <NONE> | <NONE> | <NONE> | <NONE> |
| 4597 | <NONE> | <NONE> | <NONE> | 2078483 | (U43200) antifreeze glycopeptide AFGP polyprotein precursor [*Boreogadus saida*] | 0.78 |
| 4598 | <NONE> | <NONE> | <NONE> | <NONE> | <NONE> | <NONE> |
| 4599 | <NONE> | <NONE> | <NONE> | <NONE> | <NONE> | <NONE> |
| 4600 | AL021806 | *Homo sapiens* DNA sequence from PAC 779B17 on chromosome 22q13.1. Contains exon trap, complete sequence | 4e-029 | 728836 | !!!! ALU SUBFAMILY SP WARNING ENTRY | 0.002 |
| 4601 | AL022222 | *Plasmodium* | 4.9 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | *falciparum* DNA *** SEQUENCING IN PROGRESS *** from contig 3-118, complete sequence | | | | |
| 4602 | Z73149 | *N. tabacum* DNA (recombination breakpoint between T-DNA and plant DNA) | 1.6 | <NONE> | <NONE> | <NONE> |
| 4603 | AF082835 | *Mus spretus* E6-AP ubiquitin-protein ligase | 4 | <NONE> | <NONE> | <NONE> |
| 4604 | AF050123 | *Homo sapiens* hypoxia-inducible factor 1 alpha subunit (HIF1A) gene, exon 10 | 3e-009 | 728838 | !!!! ALU SUBFAMILY SX WARNING ENTRY | 6.7 |
| 4605 | U95102 | *Xenopus laevis* mitotic phosphoprotein 90 mRNA, complete cds | 7e-006 | <NONE> | <NONE> | <NONE> |
| 4606 | AF001355 | *Pseudomonas syringae* pv. *syringae* DNA binding protein HpkR (hpkR), histidine protein kinase HpkY (hpkY), phosphate acceptor regulatory protein CheY-2 (cheY-2), ankyrin AnkF (ankF), and catalase isozyme catalytic subuni . . . | 2.1 | 3041736 | TRANSCRIPTION FACTOR SOX-11 | 8.9 |
| 4607 | U95102 | *Xenopus laevis* mitotic phosphoprotein 90 mRNA, complete cds | 8.00E-08 | 3123155 | HYPOTHETICAL 49.0 KD TRP-ASP REPEATS CONTAINING PROTEIN F55F8.5 IN CHROMOSOME I family [*Caenorhabditis elegans*] | 2e-027 |
| 4608 | <NONE> | <NONE> | <NONE> | 1170978 | MYOCYTE NUCLEAR FACTOR (MNF) [*musculus*] | 0.18 |
| 4609 | U95098 | *Xenopus laevis* mitotic phosphoprotein 44 mRNA, partial cds | 4e-009 | 2072296 | (U95098) mitotic phosphoprotein 44 [*Xenopus laevis*] | 8.9 |
| 4610 | U95094 | *Xenopus laevis* XL-INCENP (XL-INCENP) mRNA, complete cds | 2e-007 | <NONE> | <NONE> | <NONE> |
| 4611 | X75861 | *H. sapiens* TEGT gene | e-177 | 2072296 | (U95098) mitotic phosphoprotein 44 [*Xenopus laevis*] | 2.8 |
| 4612 | U19867 | Cloning vector pSPL3, exon splicing vector, complete sequence, HIV envelope protein | 5e-055 | 987050 | (X65335) lacZ gene product [unidentified cloning vector] | 3e-011 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4613 | U73332 | gp160 and beta-lactamase, complete cds. Human non-coding genomic sequence upstream from unique L0 sequence in the alpha-globin gene cluster | 8e-008 | <NONE> | <NONE> | <NONE> |
| 4614 | <NONE> | <NONE> | <NONE> | 193952 | (J03770) homeobox protein [*Mus musculus*] | 6 |
| 4615 | U95102 | *Xenopus laevis* mitotic phosphoprotein 90 mRNA, complete cds | 6e-006 | 586875 | HYPOTHETICAL 29.2 KD PROTEIN IN METS-KSGA INTERGENIC REGION >gi\|2127033\|pir\|\|S66068 hypothetical protein - [*Bacillus subtilis subtilis*] >gi\|2632306\|gnl\|PID\|e1181972 (Z99104) similar to hypothetical proteins [*Bacillus subtilis*] | 5e-019 |
| 4616 | K00384 | Yeast (*S. cerevisiae*) mitochondrial var1 gene, 5' flank. | 0.001 | <NONE> | <NONE> | <NONE> |
| 4617 | J04628 | *Rattus norvegicus* 3-hydroxyiso-butyrate mRNA, 3' end. | e-154 | 416873 | 3-HYDROXYISOBUTYRATE DEHYDROGENASE PRECURSOR (HIBADH) >gi\|111295\|pir\|\|A32867 3-hydroxyisobutyrate dehydrogenase (EC 1.1.1.31) precursor - rat (fragment) >gi\|556389 (J04628) 3-hydroxyisobutyrate dehydrogenase [*Rattus norvegicus*] | 1e-049 |
| 4618 | U95098 | *Xenopus laevis* mitotic phosphoprotein 44 mRNA, partial cds | 0.38 | <NONE> | <NONE> | <NONE> |
| 4619 | U10361 | *Saccharomyces cerevisiae* Snf8p (SNF8) gene, complete cds. | 2.7 | <NONE> | <NONE> | <NONE> |
| 4620 | D42044 | Human mRNA for KIAA0090 gene, partial cds | e-151 | 577301 | (D42044) The ha3523 gene product is related to *S. cerevisiae* gene product located in chromosome III. [*Homo sapiens*] | 4e-052 |
| 4621 | U10361 | *Saccharomyces cerevisiae* Snf8p | 2.7 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4622 | <NONE> | (SNF8) gene, complete cds. <NONE> | <NONE> | <NONE> | <NONE> | <NONE> |
| 4623 | U95102 | Xenopus laevis mitotic phosphoprotein 90 mRNA, complete cds | 3.00E-10 | <NONE> | <NONE> | <NONE> |
| 4624 | U95102 | Xenopus laevis mitotic phosphoprotein 90 mRNA, complete cds | 3.00E-10 | <NONE> | <NONE> | <NONE> |
| 4625 | <NONE> | <NONE> | <NONE> | <NONE> | <NONE> | <NONE> |
| 4626 | <NONE> | <NONE> | <NONE> | <NONE> | <NONE> | <NONE> |
| 4627 | X06747 | Human hnRNP core protein A1 | 7e-049 | 87650 | heterogeneous ribonuclear particle protein A1.beta - human >gi|36102 (X06747) protein A1-alpha (AA 1-320) [Homo sapiens] | 6e-005 |
| 4628 | X03559 | Human mRNA for F1-ATPase beta subunit (F-1 beta) > :: dbj|D00022|HUM F1B Homo sapiens mRNA for F1 beta subunit, complete cds | e-100 | 114549 | ATP SYNTHASE BETA CHAIN, MITOCHONDRI AL PRECURSOR >gi|106207|pir||A3 3370 H+- transporting ATP synthase (EC 3.6.1.34) beta chain precursor, mitochondrial - human >gi|179281 (M27132) ATP synthase beta subunit precursor [Homo sapiens] | 2e-024 |
| 4629 | <NONE> | <NONE> | <NONE> | <NONE> | <NONE> | <NONE> |
| 4630 | K00915 | paramecium species 1,168 mt dna dimer: replication init. region. | 7.00E-05 | <NONE> | <NONE> | <NONE> |
| 4631 | K00915 | paramecium species 1,168 mt dna dimer: replication init. region. | 7.00E-05 | <NONE> | <NONE> | <NONE> |
| 4632 | <NONE> | <NONE> | <NONE> | <NONE> | <NONE> | <NONE> |
| 4633 | <NONE> | <NONE> | <NONE> | <NONE> | <NONE> | <NONE> |
| 4634 | Z28261 | S. cerevisiae chromosome XI reading frame ORF YKR036c | 0.042 | 417748 | PROTEIN TRANSPORT PROTEIN SEC13 | 0.0002 |
| 4635 | U95102 | Xenopus laevis mitotic phosphoprotein 90 mRNA, complete cds | 2e-005 | <NONE> | <NONE> | <NONE> |
| 4636 | AF088034 | Homo sapiens full length insert cDNA clone ZC24F03 | 0 | 854598 | (X87611) ORF YJR83.18 [Saccharomyces cerevisiae] | 2e-024 |
| 4637 | M83094 | Homo sapiens cytosolic selenium-dependent glutathione peroxidase gene, complete cds, and rhoh12 gene, 3' | 3.00E-08 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4638 | U95102 | *Xenopus laevis* mitotic phosphoprotein 90 mRNA, complete cds end. | 2e-006 | 1176711 | HYPOTHETICAL 21.6 KD PROTEIN F37A4.2 IN CHROMOSOME III >gi\|1078851\|pir\|\|S 44639 F37A4.2 protein - *Caenorhabditis elegans* >gi\|458960 | 2e-017 |
| 4639 | U95102 | *Xenopus laevis* mitotic phosphoprotein 90 mRNA, complete cds | 2e-006 | 1176711 | HYPOTHETICAL 21.6 KD PROTEIN F37A4.2 IN CHROMOSOME III >gi\|1078851\|pir\|\|S 44639 F37A4.2 protein - *Caenorhabditis elegans* >gi\|458960 | 2e-017 |
| 4640 | U95094 | *Xenopus laevis* XL-INCENP (XL-INCENP) mRNA, complete cds | 2e-006 | <NONE> | <NONE> | <NONE> |
| 4641 | U95094 | *Xenopus laevis* XL-INCENP (XL-INCENP) mRNA, complete cds | 2e-006 | <NONE> | <NONE> | <NONE> |
| 4642 | U95094 | *Xenopus laevis* XL-INCENP (XL-INCENP) mRNA, complete cds | 2e-005 | 4056582 | (AF039530) RepA [Egyptian sugarcane streak virus] | 3.4 |
| 4643 | U96174 | *Onchocerca volvulus* OvB8 mRNA, partial cds | 3.2 | <NONE> | <NONE> | <NONE> |
| 4644 | <NONE> | <NONE> | <NONE> | <NONE> | <NONE> | <NONE> |
| 4645 | U95102 | *Xenopus laevis* mitotic phosphoprotein 90 mRNA, complete cds | 6e-005 | 3236220 | (U62541) immunoreactive 14 kDa protein BA14k [*Brucella abortus*] | 4.5 |
| 4646 | U95102 | *Xenopus laevis* mitotic phosphoprotein 90 mRNA, complete cds | 6e-005 | 3236220 | (U62541) immunoreactive 14 kDa protein BA14k [*Brucella abortus*] | 4.5 |
| 4647 | AL010224 | *Plasmodium falciparum* DNA *** SEQUENCING IN PROGRESS *** from contig 4-04, complete sequence | 0.003 | 2492906 | ANNEXIN VII (SYNEXIN) frog >gi\|790544 (U16365) annexin VII [*Xenopus laevis*] | 1.4 |
| 4648 | L39413 | *Atractylodes japonica* chloroplast NADH dehydrogenase (ndhF) gene, complete cds | 0.003 | <NONE> | <NONE> | <NONE> |
| 4649 | U95094 | *Xenopus laevis* XL-INCENP (XL-INCENP) mRNA, complete | 4e-013 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4650 | U79403 | cds *Meleagris gallopavo* microsatellite repeat sequence | 0.46 | 2498691 | OUTER DENSE FIBER PROTEIN bovine >gi\|1165006 (X69514) outer dense fiber protein protein [*Bos taurus*] | 1.4 |
| 4651 | U27780 | Stealth virus 1 clone C16138 T3.1 | 2 | <NONE> | <NONE> | <NONE> |
| 4652 | U27780 | Stealth virus 1 clone C16138 T3.1 | 2 | <NONE> | <NONE> | <NONE> |
| 4653 | U78817 | *Saccharomyces cerevisiae* killer virus M1, complete genome | 0.026 | <NONE> | <NONE> | <NONE> |
| 4654 | U78817 | *Saccharomyces cerevisiae* killer virus M1, complete genome | 0.026 | <NONE> | <NONE> | <NONE> |
| 4655 | <NONE> | <NONE> | <NONE> | <NONE> | <NONE> | <NONE> |
| 4656 | X07036 | Human mRNA stimulatory GTP-binding protein alpha subunit | 3e-071 | 232142 | GUANINE NUCLEOTIDE-BINDING PROTEIN G(S), ALPHA SUBUNIT (ADENYLATE CYCLASE-STIMULATING G ALPHA PROTEIN) >gi\|71886\|pir\|\|RG PGA2 GTP-binding regulatory protein Gs alpha-2 chain (adenylate cyclase-stimulating) - pig >gi\|1958 (X63893) alpha-stimulatory subunit | 8e-027 |
| 4657 | L05586 | Kinetoplast *Trypanosoma brucei* (IsTaR 1 serodeme) putative NADH dehydrogenase subunit (nd9) mRNA, complete cds. | 0.0001 | 4063042 | (AF068065) GP900; mucin-like glycoprotein [*Cryptosporidium parvum*] | 0.19 |
| 4658 | AF044763 | *Cecropis ariel* microsatellite HrU6 allele 1 repeat region | 3e-006 | <NONE> | <NONE> | <NONE> |
| 4659 | X82630 | *A. longa* plastid rps12, orf126 and orf288 genes | 0.22 | <NONE> | <NONE> | <NONE> |
| 4660 | U68098 | Human poly(A)-binding protein (PABP) gene, exons 6 and 7 | 0.023 | <NONE> | <NONE> | <NONE> |
| 4661 | U68098 | Human poly(A)-binding protein (PABP) gene, exons 6 and 7 | 0.023 | <NONE> | <NONE> | <NONE> |
| 4662 | U95094 | *Xenopus laevis* XL-INCENP (XL-INCENP) mRNA, complete cds | 1e-011 | 1022683 | (U23146) SSeCKS [*Rattus norvegicus*] | 1.4 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4663 | M15353 | *Homo sapiens* cap-binding protein mRNA, complete cds | 0 | <NONE> | <NONE> | <NONE> |
| 4664 | Z57610 | *H. sapiens* CpG DNA, clone 187a10, reverse read cpg187a10.rtla. | 3e-048 | 417134 | HEPATOCYTE NUCLEAR FACTOR 3-BETA [*norvegicus*] | 2.00E-10 |
| 4665 | L11707 | *Hevea brasiliensis* Mn-superoxide dismutase (SODMn) gene, complete cds. | 2.6 | <NONE> | <NONE> | <NONE> |
| 4666 | D42073 | Human mRNA for reticulocalbin, complete cds | 3e-019 | 2072296 | (U95098) mitotic phosphoprotein 44 [*Xenopus laevis*] | 6.4 |
| 4667 | L12350 | Human thrombospondin 2 (THBS2) mRNA, complete cds. | 0 | <NONE> | <NONE> | <NONE> |
| 4668 | L11707 | *Hevea brasiliensis* Mn-superoxide dismutase (SODMn) gene, complete cds. | 2.6 | <NONE> | <NONE> | <NONE> |
| 4669 | AC000043 | *Homo sapiens* Chromosome 22q13 Cosmid Clone p74a8, complete sequence [*Homo sapiens*] | 2e-016 | 134589 | TRANSCRIPTION REGULATORY PROTEIN SNF2 SWI2) (REGULATORY PROTEIN GAM1) (TRANSCRIPTION FACTOR TYE3) >gi\|101629\|pir\|\|S15047 SNF2 protein - yeast protein [*Saccharomyces cerevisiae*] >gi\|172632 (M61703) SNF2 protein [*Saccharomyces cerevisiae*]>gi\|127 | 1.5 |
| 4670 | U95094 | *Xenopus laevis* XL-INCENP (XL-INCENP) mRNA, complete cds | 6e-006 | 69700 | interleukin-1 beta precursor - bovine | 0.6 |
| 4671 | U44975 | *Homo sapiens* DNA-binding protein CPBP (CPBP) mRNA, partial cds | 2e-045 | 1848233 | (U44975) DNA-binding protein CPBP [*Homo sapiens*] | 0.009 |
| 4672 | AF038406 | *Homo sapiens* NADH dehydrogenase-ubiquinone Fe-S protein 8 23 kDa subunit (NDUFS8) gene, nuclear gene encoding mitochondrial protein, complete cds | 0 | 2326168 | (U32107) type VII collagen [*Mus musculus*] | 1.5 |
| 4673 | X67951 | *H. sapiens* mRNA for proliferation- | 0 | 548453 | THIOREDOXIN PEROXIDASE 2 | 2e-083 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | associated gene | | | CELL ENHANCING (FACTOR A) (NKEF-A) >gi\|423025\|pir\|\|A4 6711 proliferation associated gene (pag) protein - human gene product [Homo sapiens] | |
| 4674 | AC001013 | Homo sapiens (subclone 2_d1 from P1 H43) DNA sequence | 2e-017 | 2072961 | (U93568) putative p150 [Homo sapiens] | 0.0001 |
| 4675 | U95094 | Xenopus laevis XL-INCENP (XL-INCENP) mRNA, complete cds | 4e-012 | 1589837 | (U68729) cuticle preprocollagen [Meloidogyne incognita] | 0.035 |
| 4676 | M15353 | Homo sapiens cap-binding protein mRNA, complete cds | 0 | <NONE> | <NONE> | <NONE> |
| 4677 | M37583 | Human histone (H2A.Z) mRNA, complete cds. | 0 | 121994 | HISTONE H2A.Z >gi\|89608\|pir\|\|S03 642 histone H2A.Z - bovine >gi\|92380\|pir\|\|S03 644 histone H2A.Z - rat >gi\|106267\|pir\|\|A3 5881 histone H2A.Z - [human sapiens] >gi\|57808 (X52316) histone H2A.Z (AA 1-127) [taurus] >gi\|184060 (M37583) histone (H2A.Z) [Homo sapien] | 1e-055 |
| 4678 | M15353 | Homo sapiens cap-binding protein mRNA, complete cds | 0 | <NONE> | <NONE> | <NONE> |
| 4679 | Z57610 | H. sapiens CpG DNA, clone 187a10, reverse read cpg187a10.rtla. | 4e-094 | 404764 | (L10409) fork head related protein [Mus musculus] | 4e-024 |
| 4680 | Z57610 | H. sapiens CpG DNA, clone 187a10, reverse read cpg187a10.rtla. | 4e-094 | 404764 | (L10409) fork head related protein [Mus musculus] | 4e-024 |
| 4681 | Z57610 | H. sapiens CpG DNA, clone 187a10, reverse read cpg187a10.rtla. | 4e-094 | 404764 | (L10409) fork head related protein [Mus musculus] | 4e-024 |
| 4682 | L11707 | Hevea brasiliensis Mn-superoxide dismutase (SODMn) gene, complete cds. | 2.6 | <NONE> | <NONE> | <NONE> |
| 4683 | <NONE> | <NONE> | <NONE> | <NONE> | <NONE> | <NONE> |
| 4684 | <NONE> | <NONE> | <NONE> | 2114323 | (D88734) membrane glycoprotein [Equine herpesvirus 1] | 0.052 |
| 4685 | AJ224875 | Homo sapiens | 0 | 2996578 | (AJ224875) | e-118 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | mRNA for putative glucosyltransferase, partial cds | | | glucosyltransferase [Homo sapiens] | |
| 4686 | AB019534 | Homo sapiens gene for cathepsin L2, complete cds | 2e-045 | <NONE> | <NONE> | <NONE> |
| 4687 | J03799 | Human colin carcinoma laminin-binding protein mRNA, complete cds. | e-166 | 34272 | (X15005) pot. lamimin-binding protein (AA 1-300) [Homo sapiens] | 5e-032 |
| 4688 | <NONE> | <NONE> | <NONE> | 2114323 | (D88734) membrane glycoprotein [Equine herpesvirus 1] | 0.052 |
| 4689 | U95098 | Xenopus laevis mitotic phosphoprotein 44 mRNA, partial cds | 9e-009 | 2072296 | (U95098) mitotic phosphoprotein 44 [Xenopus laevis] | 9.8 |
| 4690 | D44598 | Saccharomyces cerevisiae chromosome VI phage 4121 | 1e-009 | 3947877 | (AL034382) putative mitosis and maintenance of ploidy protein [Schizosaccharomyces pombe] | 6e-061 |
| 4691 | AF053520 | Homo sapiens allele 12 fragile site locus | 0.61 | <NONE> | <NONE> | <NONE> |
| 4692 | D16195 | Mouse gene for acrogranin precursor, complete cds | 0.059 | <NONE> | <NONE> | <NONE> |
| 4693 | U90904 | Human clone 23773 mRNA sequence | 0 | 3130153 | (AB008857) calcium2+ sensing receptor | 1.5 |
| 4694 | L22398 | Homo sapiens DNA sequence, repeat region. | 7e-017 | 987050 | (X65335) lacZ gene product [unidentified cloning vector] | 0.1 |
| 4695 | L22398 | Homo sapiens DNA sequence, repeat region. | 7e-017 | 987050 | (X65335) lacZ gene product [unidentified cloning vector] | 0.1 |
| 4696 | J03746 | Human glutathione S-transferase mRNA, complete cds. | e-170 | 121740 | GLUTATHIONE S-TRANSFERASE, MICROSOMAL >gi\|87562\|pir\|\|B28083 glutathione transferase glutathione S-transferase [Homo sapiens] >gi\|1195483 sapiens] >gi\|1621433 (U71213) microsomal glutathione s-transferase [Homo sapiens] | 2e-038 |
| 4697 | AF082283 | Homo sapiens CARD-containing apoptotic signaling protein (BCL10) mRNA, complete cds | 5e-046 | 4049460 | (AJ006288) bcl-10 [Homo sapiens] signaling protein [Homo sapiens] | 0.005 |
| 4698 | D64142 | Human mRNA for histone H1x, | 1e-039 | <NONE> | <NONE> | <NONE> |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4699 | AB001899 | complete cds *Homo sapiens* PACE4 gene, exon 2 | 4e-012 | 3860844 | (AJ235271) NADH DEHYDROGENA SE I CHAIN L | 3.5 |
| 4700 | X16869 | Human mRNA for elongation factor 1-alpha (clone CEF4) | 0 | 1169475 | ELONGATION FACTOR 1-ALPHA 1 | 6e-061 |
| 4701 | U95102 | *Xenopus laevis* mitotic phosphoprotein 90 mRNA, complete cds | 6.00E-05 | <NONE> | <NONE> | <NONE> |
| 4702 | U95094 | *Xenopus laevis* XL-INCENP (XL-INCENP) mRNA, complete cds | 4e-013 | 2501465 | PROBABLE UBIQUITIN CARBOXYL-TERMINAL HYDROLASE FAM (UBIQUITIN THIOLESTERAS E FAM) | 0.0003 |
| 4703 | D44598 | *Saccharomyces cerevisiae* chromosome VI phage 4121 | 1e-009 | 3947877 | (AL034382) putative mitosis and maintenance of ploidy protein [*Schizosaccharom yces pombe*] | 6e-061 |
| 4704 | U95094 | *Xenopus laevis* XL-INCENP (XL-INCENP) mRNA, complete cds | 6e-006 | <NONE> | <NONE> | <NONE> |
| 4705 | U95094 | *Xenopus laevis* XL-INCENP (XL-INCENP) mRNA, complete cds | 1e-012 | 2072296 | (U95098) mitotic phosphoprotein 44 [*Xenopus laevis*] | 6.4 |
| 4706 | AB001899 | *Homo sapiens* PACE4 gene, exon 2 | 4e-012 | 3860844 | (AJ235271) NADH DEHYDROGENA SE I CHAIN L | 3.4 |
| 4707 | <NONE> | <NONE> | <NONE> | <NONE> | <NONE> | <NONE> |
| 4708 | U95102 | *Xenopus laevis* mitotic phosphoprotein 90 mRNA, complete cds | 1e-008 | <NONE> | <NONE> | <NONE> |
| 4709 | U95094 | *Xenopus laevis* XL-INCENP (XL-INCENP) mRNA, complete cds | 1e-009 | 2072296 | (U95098) mitotic phosphoprotein 44 [*Xenopus laevis*] | 6.40E+00 |
| 4710 | L39064 | *Homo sapiens* interleukin 9 receptor precursor (IL9R) gene, complete cds | 1e-006 | 4063042 | (AF068065) GP900; mucin-like glycoprotein | 1e-006 |
| 4711 | U95098 | *Xenopus laevis* mitotic phosphoprotein 44 mRNA, partial cds | 0.0002 | 331908 | (K02714) envelope polyprotein [Friend murine leukemia virus] | 8 |
| 4712 | AF065249 | *Entodinium caudatum* 14-3-3 protein mRNA, partial cds | 1 | <NONE> | <NONE> | <NONE> |
| 4713 | U95102 | *Xenopus laevis* mitotic phosphoprotein 90 mRNA, complete cds | 2e-013 | 2072296 | (U95098) mitotic phosphoprotein 44 [*Xenopus laevis*] | 7.9 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4714 | <NONE> | <NONE> | <NONE> | 186396 | (M94131) mucin [*Homo sapiens*] | 2.5 |
| 4715 | U95094 | *Xenopus laevis* XL-INCENP (XL-INCENP) mRNA, complete cds | 8e-009 | <NONE> | <NONE> | <NONE> |
| 4716 | <NONE> | <NONE> | <NONE> | <NONE> | <NONE> | <NONE> |
| 4717 | Z56314 | *H. sapiens* CpG DNA, clone 10h10, reverse read cpg10h10.rtla. | 4e-012 | 2444024 | (U77782) N-methyl-D-aspartate receptor 2C subunit precursor [*Homo sapiens*] | 9.8 |
| 4718 | D55696 | Human mRNA for cysteine protease, complete cds | e-113 | 2842759 | LEGUMAIN PRECURSOR (ASPARAGINYL ENDOPEPTIDASE) >gi\|1743266\|gnl\|PID\|e286211 (Y09862) legumain [*Homo sapiens*] | 1e-006 |
| 4719 | U95094 | *Xenopus laevis* XL-INCENP (XL-INCENP) mRNA, complete cds | 9e-008 | <NONE> | <NONE> | <NONE> |
| 4720 | D63480 | Human mRNA for KIAA0146 gene, partial cds | 0 | 1469874 | (D63480) The KIAA0146 gene product is novel. [*Homo sapiens*] | 2e-079 |
| 4721 | AB001579 | Rice dwarf virus genomic RNA, segment 2, complete sequence | 1.3 | <NONE> | <NONE> | <NONE> |
| 4722 | <NONE> | <NONE> | <NONE> | 3873550 | (AL033534) serine-rich protein | 2.7 |
| 4723 | AL010156 | *Plasmodium falciparum* DNA *** SEQUENCING IN PROGRESS *** from contig 3-87, complete sequence | 0.77 | <NONE> | <NONE> | <NONE> |
| 4724 | AF059198 | *Homo sapiens* protein kinase/endoribonulcease | 2 | 119110 | EBNA-1 NUCLEAR PROTEIN herpesvirus 4 (strain B95-8) >gi\|1334880 (V01555) BKRF1 encodes EBNA-1 protein, latent cycle gene. [Human herpesvirus 4] | 8e-007 |
| 4725 | <NONE> | <NONE> | <NONE> | <NONE> | <NONE> | <NONE> |
| 4727 | D38616 | Human mRNA for phosphorylase kinase alpha subunit, complete cds | 3.5 | 3522948 | (AC004411) hypothetical protein [*Arabidopsis thaliana*] | 0.18 |
| 4728 | D38616 | Human mRNA for phosphorylase kinase alpha subunit, complete cds | 3.5 | 3522948 | (AC004411) hypothetical protein [*Arabidopsis thaliana*] | 0.18 |
| 4729 | Z11808 | *T. glis* interphotoreceptor retinoid binding | 1.6 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | protein gene, exon 1 | | | | |
| 4730 | AF065988 | *Homo sapiens* keratocan gene, complete cds | 1.4 | <NONE> | <NONE> | <NONE> |
| 4731 | X60026 | *M. domesticus* small nuclear 4.5 S RNA gene | 0.0003 | 2853301 | (AF007194) mucin [*Homo sapiens*] | 5.5 |
| 4732 | M13793 | Mouse 56 kdal protein mRNA from an interferon activated gene, exon 1, 5' end. | 0.3 | 136814 | HYPOTHETICAL PROTEIN UL11 RL11 FAMILY [Human cytomegalovirus] | 2.3 |
| 4733 | D55696 | Human mRNA for cysteine protease, complete cds | e-113 | 2842759 | LEGUMAIN PRECURSOR (ASPARAGINYL ENDOPEPTIDASE) >gi\|1743266\|gnl\|PID\|e286211 (Y09862) legumain [*Homo sapiens*] | 1e-006 |
| 4734 | <NONE> | <NONE> | <NONE> | <NONE> | <NONE> | <NONE> |
| 4735 | <NONE> | <NONE> | <NONE> | 322647 | glycine-rich protein GRP22 - rape >gi\|17821 | 3e-021 |
| 4736 | <NONE> | <NONE> | <NONE> | 188864 | (M74027) mucin [*Homo sapiens*] | 0.002 |
| 4737 | U95102 | *Xenopus laevis* mitotic phosphoprotein 90 mRNA, complete cds | 2e-005 | <NONE> | <NONE> | <NONE> |
| 4738 | AB018270 | *Homo sapiens* mRNA for KIAA0727 protein, partial cds | 0 | 2072296 | (U95098) mitotic phosphoprotein 44 [*Xenopus laevis*] | 1.8 |
| 4739 | AB018270 | *Homo sapiens* mRNA for KIAA0727 protein, partial cds | 0 | 2072296 | (U95098) mitotic phosphoprotein 44 (*Xenopus laevis*] | 1.8 |
| 4740 | AE001382 | *Plasmodium falciparum* chromosome 2, section 19 of 73 of the complete sequence | 0.25 | <NONE> | <NONE> | <NONE> |
| 4741 | AE001382 | *Plasmodium falciparum* chromosome 2, section 19 of 73 of the complete sequence | 0.25 | <NONE> | <NONE> | <NONE> |
| 4742 | X55038 | Mouse mCENP-B gene for centromere autoantigen B | 0.001 | 3879362 | (Z81113) similar to DnaJ, prokaryotic heat shock protein, Zinc finger, C2H2 type; cDNA EST yk290e12.5 comes from this gene; cDNA EST yk290e12.3 comes from this gene; cDNA EST yk447h4.5 comes from this gene; cDNA EST yk474e4 . . . | 7e-007 |
| 4743 | AF054024 | *Rattus norvegicus* | 0.62 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4744 | U95094 | polymorphic marker D9UIA2 sequence *Xenopus laevis* XL-INCENP (XL-INCENP) mRNA, complete cds | 0.0005 | <NONE> | <NONE> | <NONE> |
| 4745 | Z11808 | *T. glis* interphotoreceptor retinoid binding protein gene, exon 1 | 1.6 | <NONE> | <NONE> | <NONE> |
| 4746 | <NONE> | <NONE> | <NONE> | <NONE> | <NONE> | <NONE> |
| 4747 | AF047470 | *Homo sapiens* malate dehydrogenase precursor complete cds | 1e-019 | 2995307 | (AL022268) putative aminotransferase | 0.12 |
| 4748 | AF029890 | *Homo sapiens* hepatitis B virus X interacting protein (XIP) mRNA, complete cds | e-161 | 2745883 | (AF029890) hepatitis B virus X interacting protein [*Homo sapiens*] | 2e-044 |
| 4750 | U95094 | *Xenopus laevis* XL-INCENP (XL-INCENP) mRNA, complete cds | 8e-008 | 1723019 | HYPOTHETICAL 29.6 KD PROTEIN CY251.12C >gi\|1405764\|gnl\|PID\|e249453 (Z74410) hypothetical protein Rv0093c [*Mycobacterium tuberculosis*] | 2.5 |
| 4751 | M37583 | Human histone (H2A.Z) mRNA, complete cds. | 0 | 121994 | HISTONE H2A.Z >gi\|89608\|pir\|\|S03642 histone H2A.Z - bovine >gi\|92380\|pir\|\|S03644 histone H2A.Z - rat >gi\|106267\|pir\|\|A35881 histone H2A.Z - [human sapiens] >gi\|57808 (X52316) histone H2A.Z (AA 1-127) [*taurus*] >gi\|184060 (M37583) histone (H2A.Z) [*Homo sapien*] | 1e-055 |
| 4752 | U95094 | *Xenopus laevis* XL-INCENP (XL-INCENP) mRNA, complete cds | 5e-014 | <NONE> | <NONE> | <NONE> |
| 4753 | X65279 | pWE15 cosmid vector DNA | 7e-079 | 987050 | (X65335) lacZ gene product [unidentified cloning vector] | 1e-013 |
| 4754 | D38549 | Human mRNA for KIAA0068 gene, partial cds | e-169 | <NONE> | <NONE> | <NONE> |
| 4755 | L27835 | *Pangasianodon gigas* growth hormone (GH) mRNA, complete cds. | 1.5 | 538251 | (D00322) polyprotein [Tomato black ring virus] | 5.8 |
| 4756 | U95094 | *Xenopus laevis* XL-INCENP (XL-INCENP) | 0.0002 | 1477565 | (U50078) p619 [*Homo sapiens*] | 8.9 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4757 | U95094 | mRNA, complete cds *Xenopus laevis* XL-INCENP (XL-INCENP) mRNA, complete cds | 0.0002 | 1477565 | (U50078) p619 [*Homo sapiens*] | 8.9 |
| 4758 | U47414 | Human cyclin G2 mRNA, complete cds | e-116 | <NONE> | <NONE> | <NONE> |
| 4759 | AB014560 | *Homo sapiens* mRNA for KIAA0660 protein, complete cds | e-173 | <NONE> | <NONE> | <NONE> |
| 4760 | L35664 | *Homo sapiens* (subclone H8 8_f5 from P1 35 H5 C8) DNA sequence. | 1e-030 | 2072966 | (U93570) p40 [*Homo sapiens*] | 0.001 |
| 4761 | U95094 | *Xenopus laevis* XL-INCENP (XL-INCENP) mRNA, complete cds | 4e-013 | 2072296 | (U95098) mitotic phosphoprotein 44 [*Xenopus laevis*] | 3.1 |
| 4762 | U95094 | *Xenopus laevis* XL-INCENP (XL-INCENP) mRNA, complete cds | 4e-013 | 2072296 | (U95098) mitotic phosphoprotein 44 [*Xenopus laevis*] | 3.1 |
| 4763 | U95094 | *Xenopus laevis* XL-INCENP (XL-INCENP) mRNA, complete cds | 1e-012 | <NONE> | <NONE> | <NONE> |
| 4764 | U95094 | *Xenopus laevis* XL-INCENP (XL-INCENP) mRNA, complete cds | 1e-012 | <NONE> | <NONE> | <NONE> |
| 4765 | M59317 | Mouse low affinity IgE receptor (FceRII) gene sequence. | 1e-006 | 2135765 | mucin 2 precursor, intestinal - human | 0.0003 |
| 4766 | D14034 | Human gene for Zn-alpha2-glycoprotein, complete cds | 3e-008 | 119379 | RETROVIRUS-RELATED ENV POLYPROTEIN | 6e-007 |
| 4767 | <NONE> | <NONE> | <NONE> | <NONE> | <NONE> | <NONE> |
| 4768 | M61185 | Bovine glutamic acid-rich protein mRNA, complete cds. | 0.01 | 2781362 | (AC003113) F24O1.18 [*Arabidopsis thaliana*] | 1.1 |
| 4769 | <NONE> | <NONE> | <NONE> | <NONE> | <NONE> | <NONE> |
| 4770 | Z62012 | *H. sapiens* GpG DNA, clone 61g4, reverse read cpg61g4.rtla | 0.076 | 1582765 | YFW1 gene [*Saccharomyces cerevisiae*] | 2.9 |
| 4771 | M29065 | Human hnRNP A2 protein mRNA. | 0 | 4049652 | (AF063866) ORF MSV017 hypothetical protein [*Melanoplus sanguinipes entomopoxvirus*] | 5.9 |
| 4772 | D12525 | *Homo sapiens* cytochrome P450IA1 gene, 3'flanking region | 6e-016 | 728837 | !!!! ALU SUBFAMILY SQ WARNING ENTRY | 9.6 |
| 4773 | M16660 | Human 90-kDa heat-shock protein gene, cDNA, complete | e-109 | 2119731 | HSP90 - mouse (fragment) protein {C-terminal} [mice, heart, | 1e-023 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | cds. | | | Peptide Partial, 194 aa] [*Mus* sp.] | |
| 4774 | AF043105 | *Homo sapiens* glutathione S-transferase mu 3 | 9e-020 | 728831 | !!!! ALU SUBFAMILY J WARNING ENTRY | 0.63 |
| 4775 | U43374 | Human normal keratinocyte mRNA. | 0 | 120179 | FINQ PROTEIN >gi\|73172\|pir\|\|BV ECFQ finQ protein - *Escherichia coli* plasmid R820a | 9 |
| 4776 | U00684 | Human unknown mRNA. | 2e-014 | 2224667 | (AB002361) KIAA0363 [*Homo sapiens*] | 6.6 |
| 4777 | M22299 | Human T-plastin polypeptide mRNA, complete cds, clone p4. > :: gb\|I08151\| Sequence 1 from Patent EP 0345726 | 4e-008 | <NONE> | <NONE> | <NONE> |
| 4778 | M95623 | *Homo sapiens* hydroxymethylbilane synthase gene, complete cds. | 3e-018 | 3002527 | (AF010144) neuronal thread protein AD7c-NTP [*Homo sapiens*] | 0.52 |
| 4779 | X52329 | pBluescript II KS(−) vector DNA, phagemid excised from lambda ZAPII | 0 | 2117615 | catalase - *Campylobacter jejuni* | 2e-009 |
| 4780 | X52329 | pBluescript II KS(−) vector DNA, phagemid excised from lambda ZAPII | 0 | 2117615 | catalase - *Campylobacter jejuni* | 2e-009 |
| 4781 | AF061034 | *Homo sapiens* FIP2 alternatively translated mRNA, complete cds | 0 | 3127084 | (AF061034) FIP2 [*Homo sapiens*] | 9e-089 |
| 4782 | Z64776 | *H. sapiens* CpG DNA, clone 167d8, forward read cpg167d8.ftlb. | 0.0002 | 1777782 | (U52513) ISG family member [*Homo sapiens*] | 1.8 |
| 4783 | D31786 | *Acyrthosiphon kondoi* endosymbiont DNA, S10 and spc ribosomal protein gene operons, complete and partial cds | 1.1 | 2134310 | cell division control protein CDC37 homolog splice form 1 - chicken | 4e-005 |
| 4784 | L05491 | *Homo sapiens* T-plastin gene, last exon (16). | 0 | 2506254 | T-PLASTIN | 3e-018 |
| 4785 | U95102 | *Xenopus laevis* mitotic phosphoprotein 90 mRNA, complete cds | 8e-007 | <NONE> | <NONE> | <NONE> |
| 4786 | U95102 | *Xenopus laevis* mitotic phosphoprotein 90 mRNA, complete cds | 7e-006 | 3877438 | (Z72510) similar to G-protein coupled receptor [*Caenorhabditis elegans*] | 2 |
| 4787 | L38250 | *Mycoplasma penetrans* p35 lipoprotein and p33 lipoprotein genes, complete | 0.041 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4788 | J03537 | cds<br>Human ribosomal protein S6 mRNA, complete cds. | e-138 | 133978 | 40S RIBOSOMAL PROTEIN S6 protein S6 - rat >gi\|70933\|pir\|\|R3 MS6 ribosomal protein S6 - mouse >gi\|319910\|pir\|\|R3 HU6 ribosomal protein S6 - human >gi\|36148 (X67309) ribosomal protein S6 [*Homo sapiens*] >gi\|54010 (Y00348) ribosomal protein S6 [*Mus musculus*] >g | 3e-033 |
| 4789 | U95102 | *Xenopus laevis* mitotic phosphoprotein 90 mRNA, complete cds | 1e-011 | 2072296 | (U95098) mitotic phosphoprotein 44 [*Xenopus laevis*] | 2.6 |
| 4790 | AF041210 | *Homo sapiens* midline 1 fetal kidney isoform 3 | 0.41 | <NONE> | <NONE> | <NONE> |
| 4791 | U95094 | *Xenopus laevis* XL-INCENP (XL-INCENP) mRNA, complete cds | 3e-010 | 2072296 | (U95098) mitotic phosphoprotein 44 [*Xenopus laevis*] | 3.2 |
| 4792 | S60885 | LYAR=cell growth regulating nucleolar protein | 2e-026 | 2498524 | CELL GROWTH REGULATING NUCLEOLAR PROTEIN >gi\|423488\|pir\|\|A4 0683 cell growth regulating nucleolar protein LYAR - mouse >gi\|300372\|bbs\|13 1782 | 0.43 |
| 4793 | <NONE> | <NONE> | <NONE> | <NONE> | <NONE> | <NONE> |
| 4794 | U28687 | Human zinc finger containing protein ZNF157 | 3e-027 | 1731444 | ZINC FINGER PROTEIN 84 (ZINC FINGER PROTEIN HPF2) >gi\|1020145 (M27878) DNA binding protein | 3e-008 |
| 4795 | AF086438 | *Homo sapiens* full length insert cDNA clone ZD80G11 | 0.0002 | <NONE> | <NONE> | <NONE> |
| 4796 | L28997 | *Homo sapiens* ARL1 mRNA, complete cds | 3e-006 | <NONE> | <NONE> | <NONE> |
| 4797 | U95094 | *Xenopus laevis* XL-INCENP (XL-INCENP) mRNA, complete cds | 3e-008 | 1280126 | (U55375) K03E6.4 [*Caenorhabditis elegans*] | 2e-012 |
| 4798 | AE001415 | *Plasmodium falciparum* chromosome 2, section 52 of 73 of the complete sequence | 0.015 | <NONE> | <NONE> | <NONE> |
| 4799 | D21853 | Human mRNA for KIAA0111 gene, complete cds | 0 | 729821 | EUKARYOTIC INITIATION FACTOR 4A-LIKE NUK-34 | 2e-010 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | (HA0659) >gi|631472|pir||S4 5142 translation initiation factor eIF-4A2 homolog - human >gi|496902 | |
| 4800 | M76425 | *H. sapiens* intron 2 Alu repetitive element. | 0.014 | <NONE> | <NONE> | <NONE> |
| 4801 | X87212 | *H. sapiens* mRNA for cathepsin C | 0 | 1582221 | prepro-cathepsin C [*Homo sapiens*] | 1e-052 |
| 4802 | D80005 | Human mRNA for KIAA0183 gene, partial cds | e-114 | 1136426 | (D80005) KIAA0183 [*Homo sapiens*] | 7e-025 |
| 4803 | AF026029 | *Homo sapiens* poly(A) binding protein II (PABP2) gene, complete cds | 2e-055 | <NONE> | <NONE> | <NONE> |
| 4804 | Z68322 | Human DNA sequence from cosmid L79F5, Huntington's Disease Region, chromosome 4p16.3 | 2e-016 | 2072296 | (U95098) mitotic phosphoprotein 44 [*Xenopus laevis*] | 5.6 |
| 4805 | M63180 | Human threonyl-tRNA synthetase mRNA, complete cds | 0 | 135177 | THREONYL-TRNA SYNTHETASE, CYTOPLASMIC (THREONINE-TRNA LIGASE) (THRRS) (6.1.1.3) - human >gi|1464742 (M63180) threonyl-tRNA synthetase [*Homo sapiens*] | 5e-070 |
| 4806 | U95102 | *Xenopus laevis* mitotic phosphoprotein 90 mRNA, complete cds | 3.7 | <NONE> | <NONE> | <NONE> |
| 4807 | D16431 | Human mRNA for hepatoma-derived growth factor, complete cds | 3e-010 | <NONE> | <NONE> | <NONE> |
| 4808 | AF086168 | *Homo sapiens* full length insert cDNA clone ZB82D09 | e-148 | 1465826 | (U64856) weak similarity to TPR domains [*Caenorhabditis elegans*] | 2e-014 |
| 4809 | U95094 | *Xenopus laevis* XL-INCENP (XL-INCENP) mRNA, complete cds | 4e-012 | 2072296 | (U95098) mitotic phosphoprotein 44 [*Xenopus laevis*] | 4.4 |
| 4810 | M34651 | Pseudorabies virus with upstream and downsteam sequences. | 0.4 | 417134 | HEPATOCYTE NUCLEAR FACTOR 3-BETA [*norvegicus*] | 0.047 |
| 4811 | U95094 | *Xenopus laevis* XL-INCENP (XL-INCENP) mRNA, complete cds | 3e-010 | 1353390 | (U34998) Rad9 [*Coprinus cinereus*] | 3e-010 |
| 4812 | M94314 | *Homo sapiens* ribosomal protein L30 mRNA, complete cds | 1e-064 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4813 | X95276 | *P. falciparum* complete gene map of plastid-like DNA (IR-B) | 0.001 | <NONE> | <NONE> | <NONE> |
| 4814 | X12716 | Human Retrovirus mRNA for LTR (clone cH6) | 5e-024 | <NONE> | <NONE> | <NONE> |
| 4815 | J03537 | Human ribosomal protein S6 mRNA, complete cds. | e-138 | 133978 | 40S RIBOSOMAL PROTEIN S6 protein S6 - rat >gi\|70933\|pir\|\|R3 MS6 ribosomal protein S6 - mouse >gi\|319910\|pir\|\|R3 HU6 ribosomal protein S6-human >gi\|36148 (X67309) ribosomal protein S6 [*Homo sapiens*] >gi\|54010 (Y00348) ribosomal protein S6 [*Mus musculus*]>g | 3e-033 |
| 4816 | <NONE> | <NONE> | <NONE> | <NONE> | <NONE> | <NONE> |
| 4817 | U61945 | *Caenorhabditis elegans* cosmid C49C8. | 1.8 | <NONE> | <NONE> | <NONE> |
| 4818 | <NONE> | <NONE> | <NONE> | <NONE> | <NONE> | <NONE> |
| 4819 | M20020 | Human ribosomal protein S6 mRNA, complete cds. | 7e-072 | 225901 | ribosomal protein S6 [*Rattus norvegicus*] | 2e-015 |
| 4820 | U95102 | *Xenopus laevis* mitotic phosphoprotein 90 mRNA, complete cds | 0.058 | <NONE> | <NONE> | <NONE> |
| 4821 | AL023973 | Human DNA sequence from clone 1033E15 on chromosome 22q13.1-13.2. Contains part of a novel gene, ESTs and a GSS, complete sequence [*Homo sapiens*] | 3e-009 | 2352260 | (AF000949) keratin [*Canis familiaris*] | 0.037 |
| 4822 | M37430 | Pea Chloroplast 4.5S, 5S, 16S and 23S mRNA. | 4.7 | 4093193 | (AF106583) unknown [*Caenorhabditis elegans*] | 4.8 |
| 4823 | M63488 | Human replication protein A 70 kDa subunit mRNA complete cds. | 0 | 1350579 | REPLICATION PROTEIN A 70 KD DNA-BINDING SUBUNIT (RP-A) (RF-A) (REPLICATION FACTOR-A PROTEIN 1) (SINGLE-STRANDED DNA-BINDING PROTEIN) subunit [*Homo sapiens*] | 8e-079 |
| 4824 | X83791 | *C. tentans* BR1 gene | 1.2 | <NONE> | <NONE> | <NONE> |
| 4825 | U67576 | *Methanococcus* | 4 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | *jannaschii* section 118 of 150 of the complete genome | | | | |
| 4826 | U95094 | *Xenopus laevis* XL-INCENP (XL-INCENP) mRNA, complete cds | 1e-009 | <NONE> | <NONE> | <NONE> |
| 4827 | X65319 | Cloning vector pCAT-Enhancer | 2e-077 | 987050 | (X65335) lacZ gene product [unidentified cloning vector] | 2e-011 |
| 4828 | X03558 | Human mRNA for elongation factor 1 alpha subunit | 0 | 1169475 | ELONGATION FACTOR 1-ALPHA 1 | e-109 |
| 4829 | X76538 | *H. sapiens* Mpv17 mRNA | 6.00E-98 | 730059 | MPV17 PROTEIN >gi\|631208\|pir\|S45343 glomerulosclerosis protein Mpv17 - human | 3e-010 |
| 4830 | <NONE> | <NONE> | <NONE> | <NONE> | <NONE> | <NONE> |
| 4831 | <NONE> | <NONE> | <NONE> | 2078483 | (U43200) antifreeze glycopeptide AFGP polyprotein precursor [*Boreogadus saida*] | 0.014 |
| 4832 | X83617 | *H. sapiens* mRNA for RanBP1 | 3.4 | 3924670 | (AC004990). supported by Genscan and several ESTs: C83049 | 3e-040 |
| 4833 | U95094 | *Xenopus laevis* XL-INCENP (XL-INCENP) mRNA, complete cds | 1e-011 | 3024677 | ISOLEUCYL-TRNA SYNTHETASE isoleucyl-tRNA synthetase (ileS) [*Helicobacter pylori*] | 0.005 |
| 4834 | J02763 | Human calcyclin gene, complete cds. | 1e-043 | <NONE> | <NONE> | <NONE> |
| 4835 | L10910 | *Homo sapiens* splicing factor (CC1.3) mRNA, complete cds. | 0.00E+00 | <NONE> | <NONE> | <NONE> |
| 4836 | X53586 | Human mRNA for integrin alpha 6 | 2e-099 | 2072296 | (U95098) mitotic phosphoprotein 44 [*Xenopus laevis*] | 5 |
| 4837 | Z57594 | *H. sapiens* CpG DNA, clone 186c5, reverse read cpg186c5.rtlb. | 1.4 | <NONE> | <NONE> | <NONE> |
| 4838 | <NONE> | <NONE> | <NONE> | <NONE> | <NONE> | <NONE> |
| 4839 | U95102 | *Xenopus laevis* mitotic phosphoprotein 90 mRNA, complete cds | 7e-007 | <NONE> | <NONE> | <NONE> |
| 4840 | Y00371 | Human hsc70 gene for 71 kd heat shock cognate protein > :: gb\|AR013986\|AR013986 Sequence 15 from patent U.S. Pat. No. 5773245 | e-145 | 987050 | (X65335) lacZ gene product [unidentified cloning vector] | 7e-011 |
| 4841 | AF074991 | *Homo sapiens* | 0.0005 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4842 | AF055030 | full length insert cDNA YH88A03 Homo sapiens clone 24538 mRNA sequence | 2e-049 | 2842711 | ZINC-FINGER PROTEIN UB1-D4 [sapiens] | 2e-016 |
| 4843 | U95094 | Xenopus laevis XL-INCENP (XL-INCENP) mRNA, complete cds | 2e-005 | 1353531 | (U38906) ORF14 [Bacteriophage rlt] | 7.1 |
| 4844 | Z57588 | H. sapiens CpG DNA, clone 186b7, reverse read cpg186b7.rtlb. | 0.41 | <NONE> | <NONE> | <NONE> |
| 4845 | X65319 | Cloning vector pCAT-Enhancer | 9e-051 | 987050 | (X65335) lacZ gene product [unidentified cloning vector] | 0.37 |
| 4846 | X78411 | B. pasteurii ureA, ureB and ureC genes. | 3.1 | <NONE> | <NONE> | <NONE> |
| 4847 | U95102 | Xenopus laevis mitotic phosphoprotein 90 mRNA, complete cds | 3e-009 | 2224697 | (AB002376) KIAA0378 [Homo sapiens] | 5e-008 |
| 4848 | U78729 | Homo sapiens mad protein homolog Smad2 gene, exon 6 | 4.7 | <NONE> | <NONE> | <NONE> |
| 4849 | D55696 | Human mRNA for cysteine protease, complete cds | 0 | 2842759 | LEGUMAIN PRECURSOR (ASPARAGINYL ENDOPETIDASE) >gi\|1743266\|gnl\|PID\|e286211 (Y09862) legumain [Homo sapiens] | 3e-030 |
| 4850 | U95097 | Xenopus laevis mitotic phosphoprotein 43 mRNA, partial cds | 0.43 | 3005603 | (AF053141) progesterone receptor [Equus caballus] | 2.2 |
| 4851 | U46118 | Rattus norvegicus cytochrome P450 3A9 mRNA, complete cds | 0.38 | <NONE> | <NONE> | <NONE> |
| 4852 | U95102 | Xenopus laevis mitotic phosphoprotein 90 mRNA, complete cds | 2e-006 | 2495726 | HYPOTHETICAL PROTEIN KIAA0254 [sapiens] | 1e-005 |
| 4853 | L10911 | Homo sapiens splicing factor (CC1.4) mRNA, complete cds. | e-117 | <NONE> | <NONE> | <NONE> |
| 4854 | D00132 | Acremonium chrysogenum ARS DNA fragment | 1.7 | 130998 | SALIVARY PROLINE-RICH PROTEIN PRECURSOR (CLONE CP7) [CONTAINS: BASIC PEPTIDE P-F] glycoprotein precursor PRB2 - human (fragment) precursor [Homo sapiens] | 0.45 |
| 4855 | U95102 | Xenopus laevis mitotic phosphoprotein | 4e-011 | 2072296 | (U95098) mitotic phosphoprotein 44 [Xenopus laevis] | 5.9 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4856 | <NONE> | 90 mRNA, complete cds <NONE> | <NONE> | <NONE> | <NONE> | <NONE> |
| 4857 | AC002186 | Homo sapiens (subclone 1_fl2 from P1 H115) DNA sequence | 1e-041 | 2072966 | (U93570) p40 [Homo sapiens] | 4e-013 |
| 4858 | AF053520 | Homo sapiens allele 12 fragile site locus | 0.61 | <NONE> | <NONE> | <NONE> |
| 4859 | X65319 | Cloning vector pCAT-Enhancer | 2e-077 | 987050 | (X65335) lacZ gene product [unidentified cloning vector] | 2e-011 |
| 4860 | AJ005866 | Homo sapiens mRNA for putative Sqv-7-like protein, partial | e-179 | 4008517 | (AJ005866) Sqv-7-like protein [Homo sapiens] | 3e-049 |
| 4861 | AF052165 | Homo sapiens clone 24522 mRNA sequence | 4e-072 | 2065177 | (Y12790) Supt5h protein [Homo sapiens] sapiens] | 1e-021 |
| 4862 | M90058 | Human serglycin gene, exons 1, 2, and 3. | 0.005 | <NONE> | <NONE> | <NONE> |
| 4863 | U17662 | Human neurofibromatosis 1 (NF1) gene, exons 4c and 5 and partial cds | 1.3 | <NONE> | <NONE> | <NONE> |
| 4864 | U64453 | Human ELK1 pseudogene (ELK2) and immunoglobulin heavy chain gamma pseudogene (IGHGP) | 3e-018 | <NONE> | <NONE> | <NONE> |
| 4865 | U95102 | Xenopus laevis mitotic phosphoprotein 90 mRNA, complete cds | 2e-005 | <NONE> | <NONE> | <NONE> |
| 4866 | X16826 | Drosophila melanogaster DNA for 60C beta tubulin gene making beta 3 tubulin isoform | 2.2 | <NONE> | <NONE> | <NONE> |
| 4867 | U95094 | Xenopus laevis XL-INCENP (XL-INCENP) mRNA, complete cds | 4e-009 | <NONE> | <NONE> | <NONE> |
| 4868 | X65319 | Cloning vector pCAT-Enhancer | 8e-081 | 987050 | (X65335) lacZ gene product [unidentified cloning vector] | 3e-015 |
| 4869 | AL031322 | S. pombe chromosome II cosmid c17D1 | 0.38 | <NONE> | <NONE> | <NONE> |
| 4870 | M11560 | Human aldolase A mRNA, complete cds. | 0 | 553861 | (J05517) aldolase A [Mus musculus] | 2e-066 |
| 4871 | U28831 | Human protein immuno-reactive with anti-PTH polyclonal antibodies mRNA, partial cds. > :: gb\|I40055\|I40055 Sequence 1 from patent U.S. Pat. No. | e-106 | 896065 | (U28831) protein that is immuno-reactive with anti-PTH polyclonal antibodies [Homo sapiens] | 1e-014 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4872 | U95102 | 5618695 *Xenopus laevis* mitotic phosphoprotein 90 mRNA, complete cds | 2e-005 | <NONE> | <NONE> | <NONE> |
| 4873 | <NONE> | <NONE> | <NONE> | 107112 | mucin, tracheal (AMN-22) - human (fragment) | 4e-009 |
| 4874 | U95094 | *Xenopus laevis* XL-INCENP (XL-INCENP) mRNA, complete cds | 1e-011 | <NONE> | <NONE> | <NONE> |
| 4875 | U95094 | *Xenopus laevis* XL-INCENP (XL-INCENP) mRNA, complete cds | 1e-011 | <NONE> | <NONE> | <NONE> |
| 4876 | D85752 | *Enterococcus faecalis* plasmid pPD1 bacA, bacB, bacC, bacD, bacE, bacF, bacG, bacH and bacI genes, complete cds | 0.042 | 1123087 | (U42436) C49H3.3 gene product [*Caenorhabditis elegans*] | 0.001 |
| 4877 | AC001443 | *Homo sapiens* (subclone 2_f10 from BAC 2913 | 1e-033 | 2072961 | (U93568) putative p150 [*Homo sapiens*] | 3e-007 |
| 4878 | U95102 | *Xenopus laevis* mitotic phosphoprotein 90 mRNA, complete cds | 4e-012 | <NONE> | <NONE> | <NONE> |
| 4879 | S81433 | heme oxygenase-2 {5' region, alternative splicing} | 4.2 | <NONE> | <NONE> | <NONE> |
| 4880 | M34312 | *S. cerevisiae* telomeric sequence DNA, clone YLP108CA-4-ii. | 5e-010 | 188864 | (M74027) mucin [*Homo sapiens*] | 2e-007 |
| 4881 | AF075079 | *Homo sapiens* full length insert cDNA YQ80A08 | 1.00E-12 | 2072296 | (U95098) mitotic phosphoprotein 44 [*Xenopus laevis*] | 4.6 |
| 4882 | U95102 | *Xenopus laevis* mitotic phosphoprotein 90 mRNA, complete cds | 0.015 | 3176689 | (AC003671) Contains similarity to ubiquitin carboxyl-terminal hydrolase 14 gb|Z35927 from *S. cerevisiae*. [*Arabidopsis thaliana*] | 4.5 |
| 4883 | U95102 | *Xenopus laevis* mitotic phosphoprotein 90 mRNA, complete cds | 0.12 | <NONE> | <NONE> | <NONE> |
| 4884 | U95102 | *Xenopus laevis* mitotic phosphoprotein 90 mRNA, complete cds | 7e-007 | <NONE> | <NONE> | <NONE> |
| 4885 | U95162 | *Xenopus laevis* mitotic phosphoprotein 90 mRNA, complete cds | 7e-007 | <NONE> | <NONE> | <NONE> |
| 4886 | U74586 | *Rattus norvegicus* double-stranded RNA specific | 3.5 | 2828280 | (AL021687) putative protein [*Arabidopsis* | 4e-008 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | adenosine deaminase (RED2) mRNA, complete cds | | | *thaliana*] >gi|2832633|gnl|PID|e1249651 (AL021711) putative protein [*Arabidopsis thaliana*] | |
| 4887 | U95094 | *Xenopus laevis* XL-INCENP (XL-INCENP) mRNA, complete cds | 5e-014 | 2497599 | LAMININ BETA-2 CHAIN PRECURSOR | 5.4 |
| 4888 | D78572 | House mouse; *Musculus domesticus* mRNA for membrane glycoprotein, complete cds > :: dbj|E12950|E12950 cDNA GA3-43 encoding novel polypeptide which appear when differentiate from embryo-tumor cell P19 to nerve cell | 7e-017 | 1545807 | (D78572) membrane glycoprotein [*Mus musculus*] | 1.2 |
| 4889 | L07273 | *Rattus norvegicus* carboxypeptidase E (CPE) gene, exon 1. | 3.2 | <NONE> | <NONE> | <NONE> |
| 4890 | Z46629 | *Homo sapiens* SOX9 mRNA. > :: gb|G28593|G28593 human STS SHGC-35378. | e-132 | <NONE> | <NONE> | <NONE> |
| 4891 | M30802 | Human aromatase cytochrome P-450 gene, exon 8. | 3.3 | <NONE> | <NONE> | <NONE> |
| 4892 | M28699 | *Homo sapiens* nucleolar phosphoprotein B23 (NPM1) mRNA, complete cds. | 5e-088 | 2072296 | (U95098) mitotic phosphoprotein 44 [*Xenopus laevis*] | 5.2 |
| 4893 | M89955 | Human 5-HT1D-type serotonin receptor gene, complete cds. | 0 | 2494923 | 5-HYDROXYTRYPTAMINE 1D RECEPTOR 1D [*Cavia porcellus*] | 3e-008 |
| 4894 | U95102 | *Xenopus laevis* mitotic phosphoprotein 90 mRNA, complete cds | 0.0002 | <NONE> | <NONE> | <NONE> |
| 4895 | AF004230 | *Homo sapiens* monocyte/macrophage Ig-related receptor MIR-7 (MIR cl-7) mRNA, complete cds | 2e-012 | <NONE> | <NONE> | <NONE> |
| 4896 | D50463 | Mouse SDR1 mRNA, complete cds | 0 | 1806276 | (X99337) glycoprotein 55 [*Rattus norvegicus*] | e-103 |
| 4897 | <NONE> | <NONE> | <NONE> | <NONE> | <NONE> | <NONE> |
| 4898 | AB014597 | *Homo sapiens* mRNA for KIAA0697 protein, partial | 2e-067 | 3327208 | (AB014597) KIAA0697 protein [*Homo sapiens*] | 9e-051 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4899 | AF047598 | cds Homo sapiens origin recognition complex subunit 4 (ORC4L) mRNA, complete cds | e-110 | 2736149 | (AF022108) putative replication initiator origin recognition complex subunit Orc4Lp [Homo sapiens] subunit 4; Orc4p [Homo sapiens] | 7e-005 |
| 4900 | U95102 | Xenopus laevis mitotic phosphoprotein 90 mRNA, complete cds | 7e-007 | <NONE> | <NONE> | <NONE> |
| 4901 | U95102 | Xenopus laevis mitotic phosphoprotein 90 mRNA, complete cds | 7e-007 | <NONE> | <NONE> | <NONE> |
| 4902 | U22325 | Mus musculus faciogenital dysplasis (Fgd1) mRNA, complete cds. | 1.20E+00 | <NONE> | <NONE> | <NONE> |
| 4903 | U22325 | Mus musculus faciogenital dysplasis (Fgd1) mRNA, complete cds. | 1.20E+00 | <NONE> | <NONE> | <NONE> |
| 4904 | U22325 | Mus musculus faciogenital dysplasis (Fgd1) mRNA, complete cds. | 1.20E+00 | <NONE> | <NONE> | <NONE> |
| 4905 | U26162 | Human myosin regulatory light chain mRNA, complete cds. | 0 | 228542 | myosin:SUBUNIT =regulatory light chain | 3e-068 |
| 4906 | <NONE> | <NONE> | <NONE> | <NONE> | <NONE> | <NONE> |
| 4907 | U95094 | Xenopus laevis XL-INCENP (XL-INCENP) mRNA, complete cds | 1e-011 | 3822225 | (AF079183) RING-H2 finger protein RHG1a [Arabidopsis thaliana] | 4e-006 |
| 4908 | X65319 | Cloning vector pCAT-Enhancer | 1e-075 | 987050 | (X65335) lacZ gene product [unidentified cloning vector] | 8e-019 |
| 4909 | AJ010475 | Arabidopsis thaliana mRNA for DEAD box RNA helicase, RH28 | 0.62 | <NONE> | <NONE> | <NONE> |
| 4910 | U48364 | Mus musculus muscle-specific transcriptional activator alpha-NAC gp220 (Naca) mRNA, complete cds | 0.2 | <NONE> | <NONE> | <NONE> |
| 4911 | <NONE> | <NONE> | <NONE> | <NONE> | <NONE> | <NONE> |
| 4912 | J03750 | Mouse single stranded DNA binding protein p9 mRNA, complete cds. | e-135 | 1709514 | ACTIVATED RNA POLYMERASE II TRANSCRIPTIONAL COACTIVATOR PIS (PC4) (P14) cofactor p15 - human >gi|531395 (U12979) PC4 [Homo sapiens] | 1e-020 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4913 | U70263 | Border disease virus strain BD31, complete genome | 3.2 | <NONE> | >gi\|619161 (X79805) PC4, p15 [*Homo sapiens*] <NONE> | <NONE> |
| 4914 | AB012086 | Canine herpesvirus gene for immediate-early protein, complete cds | 0.37 | <NONE> | <NONE> | <NONE> |
| 4915 | X05908 | Human mRNA for lipocortin | e-162 | 113944 | ANNEXIN I (LIPOCORTIN I) (CALPACTIN II) (CHROMOBINDIN 9) (P35) (PHOSPHOLIPASE A2 INHIBITORY PROTEIN) >gi\|71756\|pir\|\|LUHU annexin I - human >gi\|34388 | 9e-041 |
| 4916 | <NONE> | <NONE> | <NONE> | <NONE> | <NONE> | <NONE> |
| 4917 | U90911 | Human clone 23652 mRNA sequence | 0.13 | <NONE> | <NONE> | <NONE> |
| 4918 | U95094 | *Xenopus laevis* XL-INCENP (XL-INCENP) mRNA, complete cds | 8e-007 | <NONE> | <NONE> | <NONE> |
| 4919 | X57830 | *H. sapiens* serotonin 5-HT2 receptor mRNA > :: gb\|G28536\|G28536 human STS SHGC-31576. | 4e-011 | <NONE> | <NONE> | <NONE> |
| 4920 | U67559 | *Methanococcus jannaschii* section 101 of 150 of the complete genome | 3.5 | <NONE> | <NONE> | <NONE> |
| 4921 | M20020 | Human ribosomal protein S6 mRNA, complete cds. | 0 | 133978 | 40S RIBOSOMAL PROTEIN S6 protein S6 - rat >gi\|70933\|pir\|\|R3MS6 ribosomal protein S6 - mouse >gi\|319910\|pir\|\|R3HU6 ribosomal protein S6 - human >gi\|36148 (X67309) ribosomal protein S6 [*Homo sapiens*] >gi\|54010 (Y00348) ribosomal protein S6 [*Mus musculus*]>g | 2e-072 |
| 4922 | U95102 | *Xenopus laevis* mitotic phosphoprotein 90 mRNA, complete cds | 6e-006 | <NONE> | <NONE> | <NONE> |
| 4923 | U95102 | *Xenopus laevis* mitotic phosphoprotein 90 mRNA, complete cds | 6e-006 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4924 | X76683 | Plasmid vector pHM2 betalactamase gene | e-160 | 987050 | (X65335) lacZ gene product [unidentified cloning vector] | 3e-015 |
| 4925 | <NONE> | <NONE> | <NONE> | <NONE> | <NONE> | <NONE> |
| 4926 | U95098 | *Xenopus laevis* mitotic phosphoprotein 44 mRNA, partial cds | 0.002 | <NONE> | <NONE> | <NONE> |
| 4927 | D50369 | *Homo sapiens* mRNA for low molecular mass ubiquinone-binding protein, complete cds | e-152 | 3024781 | UBIQUINOL-CYTOCHROME C REDUCTASE COMPLEX UBIQUINONE-BINDING PROTEIN QP-C PROTEIN) (COMPLEX III SUBUNIT VII) >gi|2605590 (D50369) low molecular mass ubiquinone-binding protein [*Homo sapiens*] | 6e-023 |
| 4928 | M63391 | Human desmin gene, complete cds. | 4e-013 | <NONE> | <NONE> | <NONE> |
| 4929 | D38417 | Mouse mRNA for arylhydrocarbon receptor, complete cds | e-110 | <NONE> | <NONE> | <NONE> |
| 4930 | U38253 | *Rattus norvegicus* initiation factor eIF-2B gamma subunit (eIF-2B gamma) mRNA, complete cds | e-175 | 2494312 | TRANSLATION INITIATION FACTOR EIF-2B GAMMA SUBUNIT (EIF-2B GDP-GTP EXCHANGE FACTOR) subunit [*Rattus norvegicus*] | 4e-040 |
| 4931 | D38417 | Mouse mRNA for arylhydrocarbon receptor, complete cds | e-110 | <NONE> | <NONE> | <NONE> |
| 4932 | U50767 | *Mus musculus* alpha 1 type I collagen gene, partial cds and 3' flanking region. | 1.2 | <NONE> | <NONE> | <NONE> |
| 4933 | <NONE> | <NONE> | <NONE> | <NONE> | <NONE> | <NONE> |
| 4934 | U86137 | *Mus musculus* telomerase protein-1 mRNA, complete cds | 1.70E-011 | 3327268 | (AB014597) KIAA0697 protein [*Homo sapiens*] | 9e-066 |
| 4935 | S57980 | Crp1=cystatin-related protein-1 [rats, Genomic, 7673 nt] | 0.041 | <NONE> | <NONE> | <NONE> |
| 4936 | <NONE> | <NONE> | <NONE> | <NONE> | <NONE> | <NONE> |
| 4937 | AB012047 | *Arabidopsis thaliana* gene for sulfate transporter, complete cds, clone:AST56 | 0.14 | 3915658 | ATP-DEPENDENT RNA HELICASE A helicase II [*Homo sapiens*] | 6.1 |
| 4938 | U95102 | *Xenopus laevis* mitotic phosphoprotein 90 mRNA, complete cds | 2e-007 | <NONE> | <NONE> | <NONE> |
| 4939 | AB018374 | *Mus musculus* | 3e-037 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4940 | AF001498 | GARP34 mRNA, complete cds Campylobacter jejuni polysaccharide biosynthesis protein homolog gene, partial cds, galactosyl transferase homolog, UDP-galactose phosphate transferase homolog, acetyl transferase homolog and aminotransferase homolog gen . . . | 3e-005 | <NONE> | <NONE> | <NONE> |
| 4941 | J04617 | Human elongation factor EF-1-alpha gene, complete cds. > :: dbj\|E02629\|E0629 DNA of human polypeptide chain elongation factor-1 alpha | 3e-090 | <NONE> | <NONE> | <NONE> |
| 4942 | Z54349 | H. sapiens MN/CA9 GENE | 2e-007 | <NONE> | <NONE> | <NONE> |
| 4943 | AF077374 | Homo sapiens small proline-rich protein (SPRR3) gene, exons 1, 2, and 3 and complete cds | 1.3 | <NONE> | <NONE> | <NONE> |
| 4944 | X59828 | Human chromosome 22 flanking hypervariable simple repeat DNA (clone HZREP42) | 0.0003 | <NONE> | <NONE> | <NONE> |
| 4945 | U95094 | Xenopus laevis XL-INCENP (XL-INCENP) mRNA, complete cds | 1.00E-09 | 124180 | TRANSCRIPTIONAL REGULATOR IE63 human herpesvirus 1 (strain 17) [herpesvirus 1] >gi\|221713 (D00374) immediate early transcriptional modulating protein IE63 (gene UL54) [herpesvirus 1] | 5.8 |
| 4946 | U95094 | Xenopus laevis XL-INCENP (XL-INCENP) mRNA, complete cds | 1.00E-09 | 124180 | TRANSCRIPTIONAL REGULATOR IE63 human herpesvirus 1 (strain 17) [herpesvirus 1] >gi\|221713 (D00374) immediate early transcriptional modulating protein IE63 (gene UL54) [herpesvirus 1] | 5.8 |
| 4947 | X76683 | Plasmid vector pHM2 | 8e-092 | 987050 | (X65335) lacZ gene product | 3e-015 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4948 | <NONE> | betalactamase gene <NONE> | <NONE> | <NONE> | [unidentified cloning vector] <NONE> | <NONE> |
| 4949 | U95094 | *Xenopus laevis* XL-INCENP (XL-INCENP) mRNA, complete cds | 2.00E-04 | <NONE> | <NONE> | <NONE> |
| 4950 | X16972 | *Drosophila melanogaster* cecropin gene cluster | 1.20E-01 | 1362688 | morphogen Xhh precursor - African clawed frog >gi\|790938 (L39213) morphogen [*Xenopus laevis*] | 1.9 |
| 4951 | U12022 | Human calmodulin (CALM1) gene, exons 2, 3, 4, 5 and 6, and complete cds | 0 | 2072296 | (U95098) mitotic phosphoprotein 44 [*Xenopus laevis*] | 5.9 |
| 4952 | X56536 | Rabbit mRNA for pH regulatory protein (Na+/H+ exchanger), partial | 2.3 | 119110 | EBNA-1 NUCLEAR PROTEIN herpesvirus 4 (strain B95-8) >gi\|1334880 (V01555) BKRF1 encodes EBNA-1 protein, latent cycle gene. [Human herpesvirus 4] | 4e-018 |
| 4953 | AF037438 | *Homo sapiens* short chain L-3-hydroxyacyl-CoA dehydrogenase (SCHAD) gene, complete cds | 2e-006 | <NONE> | <NONE> | <NONE> |
| 4954 | U95094 | *Xenopus laevis* XL-INCENP (XL-INCENP) mRNA, complete cds | 4e-012 | 2072296 | (U95098) mitotic phosphoprotein 44 [*Xenopus laevis*] | 3.4 |
| 4955 | AB000467 | *Homo sapiens* mRNA, partial cds, clone:RES4-25 | 2e-012 | <NONE> | <NONE> | <NONE> |
| 4956 | U31525 | Human glycogenin mRNA, complete cds | 0 | 1707996 | GLYCOGENIN <gi\|2135280\|pir\|JC4695 glycogenin glucosyltransferase (EC 2.4.1.186) - human | 5e-042 |
| 4957 | <NONE> | <NONE> | <NONE> | <NONE> | <NONE> | <NONE> |
| 4958 | AF003836 | *Mesocricetus auratus* isopentenyl diphosphate:dimethylallyl diphosphate isomerase mRNA, complete cds | 1.30E+00 | <NONE> | <NONE> | <NONE> |
| 4959 | <NONE> | <NONE> | <NONE> | <NONE> | <NONE> | <NONE> |
| 4960 | <NONE> | <NONE> | <NONE> | <NONE> | <NONE> | <NONE> |
| 4961 | U95102 | *Xenopus laevis* mitotic phosphoprotein 90 mRNA, complete cds | 4.90E-02 | <NONE> | <NONE> | <NONE> |
| 4962 | U95102 | *Xenopus laevis* mitotic phosphoprotein | 4.90E-02 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 4963 | L32537 | 90 mRNA, complete cds Homo sapiens (clone XP6G6B) mRNA, partial EST. | 5.00E-03 | <NONE> | <NONE> | <NONE> |
| 4964 | L32537 | Homo sapiens (clone XP6G6B) mRNA, partial EST. | 5.00E-03 | <NONE> | <NONE> | <NONE> |
| 4965 | X63787 | T. thermophila gene for snRNA U3-2 | 0.41 | <NONE> | <NONE> | <NONE> |
| 4966 | <NONE> | <NONE> | <NONE> | <NONE> | <NONE> | <NONE> |
| 4967 | U27341 | Bos taurus endothelin converting enzyme-2 Sequence 1 from patent U.S. Pat. No. 5736376 | 7e-015 | <NONE> | <NONE> | <NONE> |
| 4968 | U35114 | Human apolipoprotein E (APOE) gene, hepatic control region HCR-2 | 9e-005 | <NONE> | <NONE> | <NONE> |
| 4969 | M86374 | Rat tropoelastin gene, intron 25 (partial). | 0.13 | <NONE> | <NONE> | <NONE> |
| 4970 | U95102 | Xenopus laevis mitotic phosphoprotein 90 mRNA, complete cds | 2e-007 | <NONE> | <NONE> | <NONE> |
| 4971 | U95102 | Xenopus laevis mitotic phosphoprotein 90 mRNA, complete cds | 2e-007 | <NONE> | <NONE> | <NONE> |
| 4972 | U95102 | Xenopus laevis mitotic phosphoprotein 90 mRNA, complete cds | 2e-007 | <NONE> | <NONE> | <NONE> |
| 4973 | U95102 | Xenopus laevis mitotic phosphoprotein 90 mRNA, complete cds | 7.00E-07 | <NONE> | <NONE> | <NONE> |
| 4974 | U95102 | Xenopus laevis mitotic phosphoprotein 90 mRNA, complete cds | 7.00E-07 | <NONE> | <NONE> | <NONE> |
| 4975 | U95102 | Xenopus laevis mitotic phosphoprotein 90 mRNA, complete cds | 7.00E-07 | <NONE> | <NONE> | <NONE> |
| 4976 | U95102 | Xenopus laevis mitotic phosphoprotein 90 mRNA, complete cds | 0.005 | 2995290 | (AL022268) putative transmembrane transport protein [Streptomyces coelicolor] | 1.50E-02 |
| 4977 | U95102 | Xenopus laevis mitotic phosphoprotein 90 mRNA, complete cds | 0.005 | 2995290 | (AL022268) putative transmembrane transport proteln [Streptomyces coelicolor] | 1.50E-02 |
| 4978 | U95102 | Xenopus laevis mitotic phosphoprotein | 0.005 | 2995290 | (AL022268) putative transmembrane | 1.50E-02 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | 90 mRNA, complete cds | | | transport protein [*Streptomyces coelicolor*] | |
| 4979 | U95094 | *Xenopus laevis* XL-INCENP (XL-INCENP) mRNA, complete cds | 2.00E-05 | 2983512 | (AE000718) putative protein [*Aquifex aeolicus*] | 2.2 |
| 4980 | X56536 | Rabbit mRNA for pH regulatory protein (Na+/H+ exchanger), partial | 2.3 | 119110 | EBNA-1 NUCLEAR PROTEIN herpesvirus 4 (strain B95-8) >gi|1334880 V01555) BKRF1 encodes EBNA-1 protein, latent cycle gene. [Human herpesvirus 4] | 4e-018 |
| 4981 | Z11508 | *A. thaliana* rpl15 gene for plastid ribosomal protein CL15 | 5.00E-03 | 3283910 | (AF070638) unknown [Homo sapiens] | 2.5 |
| 4982 | X95834 | *H. sapiens* DNA sequence surrounding NotI site, clone NRLA143D | 7e-070 | 1588365 | signal peptidase:SUBUNIT=12 kD [*Homo sapiens*] | 1e-043 |
| 4983 | U95102 | *Xenopus laevis* mitotic phosphoprotein 90 mRNA, complete cds | 2e-007 | 4008081 | (AF106835) putative DnaJ [*Methylovorus* sp. strain SS1] | 3e-010 |
| 4984 | <NONE> | <NONE> | <NONE> | <NONE> | <NONE> | <NONE> |
| 4985 | U43626 | Human chromosome 15q11-q13 putative DNA replication origin in the g-aminobutyric acid receptor b3 and a5 gene cluster | 2e-018 | 2197085 | (AF003535) ORF2-like protein [*Homo sapiens*] | 0.0002 |
| 4986 | <NONE> | <NONE> | <NONE> | <NONE> | <NONE> | <NONE> |
| 4987 | D21272 | Rice mRNA for ADP-glucose pyrophosphorylase | 1.1 | 1708084 | EXOGLUCANASE B PRECURSOR 1,4-beta-cellobiosidase (EC 3.2.1.91) precursor - *Cellulomonas fimi* >gi|790698 (L38827) beta-1,4-cellobiohydrolase [*Cellulomonas fimi*] | 5.8 |
| 4988 | U59706 | *Gallus gallus* alternatively spliced AMPA glutamate receptor, isoform GluR2 flop, (GluR2) mRNA, partial cds. | 0.015 | <NONE> | <NONE> | <NONE> |
| 4989 | AF086033 | *Homo sapiens* full length insert cDNA clone YW26E09 | e-174 | <NONE> | <NONE> | <NONE> |
| 4990 | L31840 | *Rattus norvegicus* nuclear pore complex protein NUP107 mRNA, complete cds. | e-179 | 1709212 | NUCLEAR PORE COMPLEX PROTEIN NUP107 | 2e-083 |
| 4991 | AF052144 | *Homo sapiens* | e-170 | 1174415 | SPIDROIN 2 | 4.8 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | clone 24573 and 24786 mRNA sequences | | | (DRAGLINE SILK FIBROIN 2) >gi\|345426\|pir\|A4 4112 spidroin 2, dragline silk fibroin - orb spider (*Nephila clavipes*) (fragment) [*clavipes*] | |
| 4992 | M22406 | Human intestinal mucin mRNA, partial cds, clone SMUC 42. | 0.085 | 188864 | (M74027) mucin [*Homo sapiens*] | 1e-009 |
| 4993 | <NONE> | <NONE> | <NONE> | <NONE> | <NONE> | <NONE> |
| 4994 | U24697 | *Chironomus samoensis nanos* homolog (Cs nos) gene, complete cds. | 0.13 | 3880999 | (AL021492) Y45F10D.11 [*Caenorhabditis elegans*] | 7e-022 |
| 4995 | M64716 | Human ribosomal protein S25 mRNA, complete cds. | 4e-074 | 2943738 | (AB011550) *Drosophila* Policomblike-related gene containing PHD fingers. [*Mus musculus*] | 4e-011 |
| 4996 | X54326 | *H. sapiens* mRNA for glutaminyl-tRNA synthetase | 0 | 135104 | MULTIFUNCTIONAL AMINOACYL-TRNA SYNTHETASE (CONTAINS: GLUTAMYL-TRNA SYNTHETASE glutamyl-prolyl-tRNA synthetase - human >gi\|31958 | 1e-088 |
| 4997 | Z12112 | pWE15A cosmid vector DNA | 2e-028 | 987050 | (X65335) lacZ gene product [unidentified cloning vector] | 2e-007 |
| 4998 | Z62939 | *H. sapiens* CpG DNA, clone 75f1, forward read cpg75f1.ftlb. | 3e-010 | <NONE> | <NONE> | <NONE> |
| 4999 | <NONE> | <NONE> | <NONE> | 2134574 | mucin - rhesus macaque (fragment) >gi\|437055 | 5e-005 |
| 5000 | U95102 | *Xenopus laevis* mitotic phosphoprotein 90 mRNA, complete cds | 9e-009 | <NONE> | <NONE> | <NONE> |
| 5001 | Z93950 | *H. sapiens* DNA; chromosome Y repeat regions | 0.15 | <NONE> | <NONE> | <NONE> |
| 5002 | X64037 | *H. sapiens* mRNA for RNA polymerase II associated protein RAP74 | 5e-056 | <NONE> | <NONE> | <NONE> |
| 5003 | M37583 | Human histone (H2A.Z) mRNA, complete cds. | e-132 | 121994 | HISTONE H2A.Z >gi\|89608\|pir\|S03 642 histone H2A.Z - bovine >gi\|92380\|pir\|S03 644 histone H2A.Z - rat >gi\|106267\|pir\|A3 5881 histone H2A.Z - [human sapiens] >gi\|57808 | 2e-044 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | (X52316) histone H2A.Z (AA 1-127) [taurus] >gi|184060 (M37583) histone (H2A.Z) [Homo sapien] | |
| 5004 | U95102 | Xenopus laevis mitotic phosphoprotein 90 mRNA, complete cds | 4e-011 | <NONE> | <NONE> | <NONE> |
| 5005 | U95102 | Xenopus laevis mitotic phosphoprotein 90 mRNA, complete cds | 4e-011 | <NONE> | <NONE> | <NONE> |
| 5006 | M94764 | Glycine max cv. Dare nodulin 26 gene fragment. | 0.043 | <NONE> | <NONE> | <NONE> |
| 5007 | Z34287 | B. subtilis (SO113) genomic DNA (5425bp) | 1.2 | <NONE> | <NONE> | <NONE> |
| 5008 | X76683 | Plasmid vector pHM2 betalactamase gene | 6e-078 | 987050 | (X65335) lacZ gene product [unidentified cloning vector] | 2e-014 |
| 5009 | D17577 | Mouse mRNA for kinesin-like protein (Kif1b), complete cds | e-109 | 2497524 | KINESIN-LIKE PROTETN KIF1B mouse >gi|407339|gnl|PID|d1005029 (D17577) Kif1b [Mus musculus] | 9e-041 |
| 5010 | X91192 | H. sapiens PLC beta 3 gene (exon 1) and SOM172 gene (exon 1) | 1e-096 | 3294231 | (AJ223970) mono-methyl transferase | 3 |
| 5011 | D88271 | Human (lambda) DNA for immunogloblin light chain | 1e-021 | <NONE> | <NONE> | <NONE> |
| 5012 | <NONE> | <NONE> | <NONE> | <NONE> | <NONE> | <NONE> |
| 5013 | <NONE> | <NONE> | <NONE> | <NONE> | <NONE> | <NONE> |
| 5014 | AF052133 | Homo sapiens clone 23970 mRNA sequence | 0 | 2072296 | (U95098) mitotic phosphoprotein 44 [Xenopus laevis] | 5.9 |
| 5015 | M21731 | Human lipocortin-V mRNA, complete cds. | e-169 | 999934 | Annexin V (Lipocortin V, Endonexin Ii, Placental Anticoagulant Protein) Mutant With Glu 17 Replaced By Gly, Glu 78 Replaced By Gln (E17g, E78q) Complexed With Calcium | 4e-005 |
| 5016 | M21731 | Human lipocortin-V mRNA, complete cds. | e-169 | 999934 | Annexin V (Lipocortin V, Endonexin Ii, Placental Anticoagulant Protein) Mutant With Glu 17 Replaced By Gly, Glu 78 Replaced By Gln (E17g, E78q) Complexed With Calcium | 4e-005 |
| 5017 | <NONE> | <NONE> | <NONE> | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 5018 | L44118 | Homo sapiens proximal CMT1A-REP repeat | 0.0005 | <NONE> | <NONE> | <NONE> |
| 5019 | Y16849 | Bacillus sp. D3 xynA and abfA genes and ORF1 | 2e-015 | <NONE> | <NONE> | <NONE> |
| 5020 | U95094 | Xenopus laevis XL-INCENP (XL-INCENP) mRNA, complete cds | 2e-006 | 465975 | PUTATIVE ATP-DEPENDENT RNA HELICASE T26G10.1 IN CHROMOSOME III >gi\|482102\|pir\|\|S40731 ATP-dependent RNA helicase homolog T26G10.1 - Caenorhabditis elegans >gi\|3880293\|gnl\|PID\|e1349766 1397–1495 which introduced stop codon at 3' splice; 5' splice looks v. | 9e-005 |
| 5021 | U95094 | Xenopus laevis XL-INCENP (XL-INCENP) mRNA, complete cds | 2e-006 | <NONE> | <NONE> | <NONE> |
| 5022 | U02455 | Cloning vector rpDR2, complete sequence. | 0.35 | 2132302 | hypothetical protein YPR144c - yeast similarity near C-terminus to RNA Polymerase beta subunit (Swiss Prot. accession number P11213) and CCAAT-binding transcription factor (PIR accession number A36368) [Saccharomyces cerevisiae] | 1e-031 |
| 5023 | X97999 | H. sapiens mRNA for transcription factor IID, subunit TAFII55 | 0 | 3024690 | TRANSCRIPTION INITIATION FACTOR TFIID 55 KD SUBUNIT (TAFII-55) (TAFII55) factor IID [Homo sapiens] | 4e-083 |
| 5024 | X71642 | M. musculus GEG-154 mRNA | 3e-092 | <NONE> | <NONE> | <NONE> |
| 5025 | X71642 | M. musculus GEG-154 mRNA | 3e-092 | <NONE> | <NONE> | <NONE> |
| 5026 | AB018270 | Homo sapiens mRNA for KIAA0727 protein, partial cds | 4e-061 | 2072296 | (U95098) mitotic phosphoprotein 44 [Xenopus laevis] | 7.6 |
| 5027 | D90086 | Human pyruvate dehydrogenase (EC 1.2.4.1) beta subunit gene, exons 1–10 | 4e-011 | 2143936 | probable regulatory protein 322 - rat | 7.7 |
| 5028 | U95102 | Xenopus laevis mitotic phosphoprotein 90 mRNA, complete cds | 0.002 | <NONE> | <NONE> | <NONE> |
| 5029 | X65319 | Cloning vectors | 2e-081 | 987050 | (X65335) lacZ | 3e-015 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | pCAT-Enhancer | | | gene product [unidentified cloning vector] | |
| 5030 | <NONE> | <NONE> | <NONE> | 188864 | (M74027) mucin [*Homo sapiens*] | 0.001 |
| 5031 | U95094 | *Xenopus laevis* XL-INCENP (XL-INCENP) mRNA, complete cds | 0.0002 | 3258141 | (AP000007) 138aa long hypothetical protein [*Pyrococcus horikoshii*] | 9.6 |
| 5032 | X98001 | *H. sapiens* mRNA for geranylgeranyl transferase II | e-129 | 2506788 | GERANYLGERANYL TRANSFERASE TYPE II BETA SUBUNIT (RAB GERANYLGERANYLTRANSFERASE BETA SUBUNIT) (RAB GERANYL-GERANYLTRANSFERASE BETA SUBUNIT) transferase II [*Homo sapiens*] | 3e-026 |
| 5033 | U72789 | Human cosmid U197H5, complete sequence [*Homo sapiens*] | 5e-023 | <NONE> | <NONE> | <NONE> |
| 5034 | U72789 | Human cosmid U197H5, complete sequence [*Homo sapiens*] | 5e-023 | <NONE> | <NONE> | <NONE> |
| 5035 | U19239 | *Choristoneura fumiferana* entomopoxvirus spheroidin gene, complete cds, G4R gene, partial cds, and nucleoside triphosphate phosphohydrolase (NPH I) gene, partial cds | 3.8 | <NONE> | <NONE> | <NONE> |
| 5036 | U95098 | *Xenopus laevis* mitotic phosphoprotein 44 mRNA, partial cds | 8e-009 | 2690166 | (AE000788) *B. burgdorferi* predicted coding region BBK23 | 4 |
| 5037 | U66871 | Human enhancer of rudimentary homolog mRNA, complete cds | 0 | 2498336 | ENHANCER OF RUDIMENTARY HOMOLOG homologous to DROER protein [*Homo sapiens*] >gi|1519519 sapiens] | 6e-057 |
| 5038 | <NONE> | <NONE> | <NONE> | <NONE> | <NONE> | <NONE> |
| 5039 | X99728 | *H. sapiens* NDUFV3 gene, exon 3 | 3e-092 | 2829450 | NADH-UBIQUINONE OXIDOREDUCTASE 9 KD SUBUNIT PRECURSOR (COMPLEX I-9 KD) (CI-9 KD) | 1e-015 |
| 5040 | X78730 | *M. musculus* DNA for the flanking sequences of the hypothalamic | 2 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 5041 | X84373 | GRH first exons H. sapiens mRNA for nuclear factor RIP140 > :: gb|G28540|G28540 human STS SHGC-31616. | e-155 | <NONE> | <NONE> | <NONE> |
| 5042 | <NONE> | <NONE> | <NONE> | <NONE> | <NONE> | <NONE> |
| 5043 | X82272 | Human endogenous retrovirus env mRNA | 8e-081 | 1196429 | (M14123) pol/env ORF (bases 3878-8257) first start codon at 4172; Xxx; putative [Homo sapiens] | 6e-058 |
| 5044 | AF029982 | Mus musculus sarco(endo)plasmic reticulum calcium ATPase (SERCA2) gene, promoter region, exons 1-3, and partial cds | 0.003 | 3873550 | (AL033534) serine-rich protein | 0.018 |
| 5045 | <NONE> | <NONE> | <NONE> | <NONE> | <NONE> | <NONE> |
| 5046 | Y12781 | Homo sapiens mRNA for transducin (beta) like 1 protein | 1e-084 | 3021409 | (Y12781) transducin (beta) like 1 protein [Homo sapiens] | 2e-064 |
| 5047 | S63912 | D10S102=FBRNP [human, fetal brain, mRNA, 3043 nt] | 4e-084 | <NONE> | <NONE> | <NONE> |
| 5048 | X91192 | H. sapiens PLC beta 3 gene (exon 1) and SOM172 gene (exon 1) | 1e-096 | 3294231 | (AJ223970) mono-methyl transferase | 3 |
| 5049 | X03558 | Human mRNA for elongation factor 1 alpha subunit | 0 | 1169475 | ELONGATION FACTOR 1-ALPHA 1 | e-108 |
| 5050 | L31783 | Mus musculus uridine kinase mRNA, partial cds | 3e-029 | 1718058 | URIDINE KINASE (URIDINE MONOPHOSPHO KINASE) >gi|471981 (L31783) uridine kinase | 4e-011 |
| 5051 | X75652 | A. longa plastid genes for tRNAs, ribosomal protein, rRNA and elongation factor | 1.3 | <NONE> | <NONE> | <NONE> |
| 5052 | Z93123 | M. acuminata mRNA; clone pBAN UD75 | 1.1 | <NONE> | <NONE> | <NONE> |
| 5053 | D16901 | Human HepG2 3' region cDNA, clone hmd2h05 | 1.5 | <NONE> | <NONE> | <NONE> |
| 5054 | U95094 | Xenopus laevis XL-INCENP (XL-INCENP) mRNA, complete cds | 1e-011 | 2072296 | (U95098) mitotic phosphoprotein 44 [Xenopus laevis] | 5.7 |
| 5055 | AF043252 | Homo sapiens mitochondrial outer membrane protein (Tom40) gene, nuclear gene encoding mitochondrial protein, exons 7, 8 and 9 | e-106 | 3941342 | (AF043250) mitochondrial outer membrane protein [Homo sapiens] >gi|3941347 (AF043253) mitochondrial outer membrane protein [Homo | 6e-007 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 5056 | X66494 | R. norvegicus CHOT1 mRNA | 1e-012 | 1545807 | sapiens] >gi\|4105703 (AF050154) D19S1177E [Homo sapiens] (D78572) membrane glycoprotein [Mus musculus] | 3e-007 |
| 5057 | <NONE> | <NONE> | <NONE> | <NONE> | <NONE> | <NONE> |
| 5058 | U95094 | Xenopus laevis XL-INCENP (XL-INCENP) mRNA, complete cds | 2e-007 | 3513368 | (AB017202) entactin-2 [Mus musculus] | 3e-005 |
| 5059 | U77107 | Fundulus lineolatus cytochrome b (cytb) gene, mitochondrial gene encoding mitochondrial protein, partial cds | 0.37 | 3947877 | (AL034382) putative mitosis and maintenance of ploidy protein [Schizosaccharomyces pombe] | 7e-026 |
| 5060 | X52317 | Human mRNA for histone H2A.Z | 5e-014 | <NONE> | <NONE> | <NONE> |
| 5061 | U95102 | Xenopus laevis mitotic phosphoprotein 90 mRNA, complete cds | 3e-008 | <NONE> | <NONE> | <NONE> |
| 5062 | U95094 | Xenopus laevis XL-INCENP (XL-INCENP) mRNA, complete cds | 1.2 | <NONE> | <NONE> | <NONE> |
| 5063 | U95102 | Xenopus laevis mitotic phosphoprotein 90 mRNA, complete cds | 0.0002 | <NONE> | <NONE> | <NONE> |
| 5064 | U95102 | Xenopus laevis mitotic phosphoprotein 90 mRNA, complete cds | 1e-011 | 2072296 | (U95098) mitotic phosphoprotein 44 [Xenopus laevis] | 1.5 |
| 5065 | U95102 | Xenopus laevis mitotic phosphoprotein 90 mRNA, complete cds | 0.0002 | <NONE> | <NONE> | <NONE> |
| 5066 | X15943 | Human calcitonin/alpha-CGRP gene | 1e-012 | 1575563 | (U66464) hematopoietic progenitor kinase [Homo sapiens] | 5.6 |
| 5067 | AF001175 | Homo sapiens ribonuclease P protein subunit p14 (Rpp14) mRNA, complete cds | 0 | 4100563 | (AF001175) ribonuclease P protein subunit p14 [Homo sapiens] | 2e-032 |
| 5068 | L29260 | Arabidopsis thaliana 1-amino-1-cyclopropanecarboxylate synthase (ACS5) gene, complete cds. | 0.41 | <NONE> | <NONE> | <NONE> |
| 5069 | X57268 | Mouse DNA for t-haplotype-specific elements (located in H-2 complex, ETn | 1.2 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 5070 | U95094 | related) *Xenopus laevis* XL-INCENP (XL-INCENP) mRNA, complete cds | 1e-010 | 2072296 | (U95098) mitotic phosphoprotein 44 [*Xenopus laevis*] | 5.5 |
| 5071 | Y11896 | *M. musculus* mRNA for Brx gene, partial | 3e-018 | 2196874 | (Y11896) BRX protein [*Mus musculus*] | 3e-011 |
| 5072 | Y00711 | Human mRNA for lactate dehydrogenase B (LDH-B) | 0 | 126041 | L-LACTATE DEHYDROGENASE H CHAIN dehydrogenase B (AA 1 - 334) [*Homo sapiens*] >gi\|1200083 | e-102 |
| 5073 | AF065482 | *Homo sapiens* sorting nexin 2 (SNX2) mRNA, complete cds | 0 | 3152938 | (AF065482) sorting nexin 2 [*Homo sapiens*] | 3e-072 |
| 5074 | M86374 | *Rat tropoelastin* gene, intron 25 (partial). | 0.13 | <NONE> | <NONE> | <NONE> |
| 5075 | D50418 | Mouse mRNA for AREC3, partial cds | 6e-047 | 2495271 | SKELETAL MUSCLE-SPECIFIC ARE BINDING PROTEIN AREC3 (HOMEOBOX PROTEIN SIX4) M18) - mouse >gi\|1255626\|gnl\|PID\|d1009550 (D50416) AREC3 | 2e-006 |
| 5076 | D17448 | *Microcystis aeruginosa* plasmid pMA2 DNA, complete genome sequence | 0.13 | <NONE> | <NONE> | <NONE> |
| 5077 | M29548 | Human elongation factor 1-alpha (EF1A) mRNA, partial cds. | e-166 | 1169475 | ELONGATION FACTOR 1-ALPHA 1 | 6e-010 |
| 5078 | AF081496 | *Homo sapiens* kinetochore protein BUB3 (BUB3) mRNA, complete cds | 6e-044 | 2921873 | (AF047472) spleen mitotic checkpoint BUB3 [*Homo sapiens*] protein BUB3 [*Homo sapiens*] | 3e-006 |
| 5079 | U95094 | *Xenopus laevis* XL-INCENP (XL-INCENP) mRNA, complete cds | 7e-007 | <NONE> | <NONE> | <NONE> |
| 5080 | <NONE> | <NONE> | <NONE> | <NONE> | <NONE> | <NONE> |
| 5081 | M14123 | Human endogenous retrovirus HERV-K10. | 2e-065 | 1196429 | (M14123) pol/env ORF (bases 3878-8257) first start codon at 4172; Xxx; putative [*Homo sapiens*] | 6e-037 |
| 5082 | <NONE> | <NONE> | <NONE> | <NONE> | <NONE> | <NONE> |
| 5083 | D30655 | *Homo sapiens* mRNA for eukaryotic initiation factor 4AII, complete cds | 0 | 673433 | (X56953) protein synthesis initiation factor 4A [*Mus musculus*] | 2e-092 |
| 5084 | X16869 | Human mRNA for elongation factor 1-alpha (clone CEF4) | 5e-045 | 3122072 | ELONGATION FACTOR 1-ALPHA 1 chicken >gi\|488468 (L00677) | 1e-009 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 5085 | <NONE> | <NONE> | <NONE> | <NONE> | elongation factor 1 alpha <NONE> | <NONE> |
| 5086 | <NONE> | <NONE> | <NONE> | <NONE> | <NONE> | <NONE> |
| 5087 | U78310 | Homo sapiens pescadillo mRNA, complete cds | e-122 | 2194203 | (U78310) pescadillo [Homo sapiens] | 9e-009 |
| 5088 | <NONE> | <NONE> | <NONE> | <NONE> | <NONE> | <NONE> |
| 5089 | U95094 | Xenopus laevis XL-INCENP (XL-INCENP) mRNA, complete cds | 2e-005 | <NONE> | <NONE> | <NONE> |
| 5090 | U09368 | Human zinc finger protein ZNF140 | 0 | 1731416 | ZINC FINGER PROTEIN 140 human >gi\|487787 (U09368) zinc finger protein ZNF140 | 2e-062 |
| 5091 | M98509 | Human NFB genomic fragment. | 1e-010 | <NONE> | <NONE> | <NONE> |
| 5092 | AB002322 | Human mRNA for KIAA0324 gene, partial cds | e-130 | 2996650 | (AC004493) KIAA0324 [Homo sapiens] | 9e-018 |
| 5093 | AJ007670 | Homo sapiens mRNA for LGMD2B protein | 2e-014 | 403460 | (L24521) transformation-related protein [Homo sapiens] | 3.8 |
| 5094 | X16869 | Human mRNA for elongation factor 1-alpha (clone CEF4) | 0 | 181967 | (M29548) elongation factor 1-alpha [Homo sapiens] | 2e-036 |
| 5095 | U95094 | Xenopus laevis XL-INCENP (XL-INCENP) mRNA, complete cds | 7e-007 | <NONE> | <NONE> | <NONE> |
| 5096 | U95102 | Xenopus laevis mitotic phosphoprotein 90 mRNA, complete cds | 0.0005 | <NONE> | <NONE> | <NONE> |
| 5097 | U95094 | Xenopus laevis XL-INCENP (XL-INCENP) mRNA, complete cds | 2e-006 | <NONE> | <NONE> | <NONE> |
| 5098 | U95094 | Xenopus laevis XL-INCENP (XL-INCENP) mRNA, complete cds | 2e-006 | <NONE> | <NONE> | <NONE> |
| 5099 | U45421 | Borrelia burgdorferi 2.9-1 locus, ORF 5-8, ORF-A-D, REP+, REP-, and lipoprotein (LP) genes, complete cds | 0.014 | 3510605 | (AF044267) gyrase subunit B [Chlamydia trachomatis]. | 3.4 |
| 5100 | L54057 | Homo sapiens CLP mRNA, partial cds. | 0 | <NONE> | <NONE> | <NONE> |
| 5101 | D14660 | Human mRNA for KIAA0104 gene, complete cds | 0 | 1350786 | PUTATIVE 60S RIBOSOMAL PROTEIN sapiens] >gi\|3947438 (AC005034) ribosomal protein-like | e-111 |
| 5102 | X78627 | H. sapiens mRNA | 0 | 1082873 | translin - human | 5e-068 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | for translin. | | | >gi|607130 (X78627) translin [Homo sapiens] >gi|1586346|prf||2 203413A recombination hotspot-binding protein [Homo sapiens] | |
| 5103 | U95102 | Xenopus laevis mitotic phosphoprotein 90 mRNA, complete cds | 0.0001 | <NONE> | <NONE> | <NONE> |
| 5104 | M12585 | Mouse alpha-1 antitrypsin gene, segment 1. | 2e-006 | 3873550 | (AL033534) serine-rich protein | 1.7 |
| 5105 | X52967 | Human mRNA for ribosomal protein L7 | 0 | 423072 | ribosomal protein L7 - human | 7e-061 |
| 5106 | U95094 | Xenopus laevis XL-INCENP (XL-INCENP) mRNA, complete cds | 7e-007 | <NONE> | <NONE> | <NONE> |
| 5107 | X78722 | M. musculus GLUT2 gene for glucose transporter | 0.34 | 1685115 | (U68754) putative transcription factor [Dictyostelium discoideum] | 3.8 |
| 5108 | AF002677 | Dictyostelium discoideum DEAD-box RNA helicase | 0.28 | 3293508 | (AF069188) NADH dehydrogenase 1 [Ephedrus laevicollis] | 0.81 |
| 5109 | AB018263 | Homo sapiens mRNA for KIAA0720 protein, partial cds | 0.87 | 107240 | oncogene 1 (tre-2 locus) (clone 210) - human | 0.19 |
| 5110 | AF017115 | Homo sapiens cytochrome c oxidase subunit IV precursor (COX4) gene, nuclear gene encoding mitochondrial protein, complete cds | 0.77 | <NONE> | <NONE> | <NONE> |
| 5111 | AE001383 | Plasmodium falciparum chromosome 2, section 20 of 73 of the complete sequence | 0.15 | 2315754 | (AF016681) No definition line found [Caenorhabditis elegans] | 9.6 |
| 5112 | D49577 | Pig mRNA for rearranged T-cell receptor delta-chain/Vdelta1.14-Ddeltas-Jdelta1, partial cds | 0.91 | <NONE> | <NONE> | <NONE> |
| 5113 | U63810 | Homo sapiens WD40 protein Ciao 1 mRNA, complete cds | 0.0 | 3219331 | (AC004020) Unknown gene product [Homo sapiens] | 3e-92 |
| 5114 | AF085858 | Homo sapiens full length insert cDNA clone YN49B07 | e-172 | 3329465 | (AF064553) NSD1 protein [Mus musculus] | 8e-54 |
| 5115 | X01682 | Mouse gene for cytochrome P3-450 | 0.026 | 1381394 | (U40989) tat interactive protein [Homo sapiens] | 4.0 |
| 5116 | AE001432 | Plasmodium | 1.5 | 3873713 | (Z74026) cDNA | 9e-11 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | *falciparum* chromosome 2, section 69 of 73 of the complete sequence | | | EST yk452h4.3 comes from this gene; cDNA EST yk452h4.5 comes from this gene | |
| 5117 | U31973 | Human phosphodiesterase A' subunit (PDE6C) mRNA, complete cds. > :: gb\|G28549\|G285 49 human STS SHGC-31657. | 2.3 | 136976 | PROTEIN UL87 >gi\|76594\|pir\|\|S09 851 hypothetical protein UL87 - human cytomegalovirus cytomegalovirus] | 8.1 |
| 5118 | X02212 | Chicken alpha-cardiac actin gene | 2.6 | <NONE> | <NONE> | <NONE> |
| 5119 | AE000838 | *Methanobacterium thermoautotrophicum* from bases 494834 to 505698 (section 44 of 148) of the complete genome | 0.89 | 765086 | (D30786) feline CD9 [*Felis catus*] | 1.4 |
| 5120 | U89744 | *Rattus norvegicus* putative cell surface antigen mRNA, complete cds | 0.68 | 728850 | GLUCOAMYLASE S1/S2 PRECURSOR (GLUCAN 1,4-ALPHA-GLUCOSIDASE) (1,4-ALPHA-D-GLUCAN GLUCOHYDROLASE) >gi\|626156\|pir\|\|S4 8478 glucan 1,4-alpha-glucosidase (EC 3.2.1.3) - yeast sta1, len: 1367, CAI: 0.3, AMYH_YEAST P08640 GLUCOAMYLASE S1 (EC 3.2.1.3) [*Saccharomyc* | 9e-06 |
| 5121 | J04974 | Human alpha-2 type XI collagen mRNA (COL11A2). | 1.2 | 114887 | BREAKPOINT CLUSTER REGION PROTEIN protein, splice form 1 - human >gi\|29421 (X02596) bcr gene product [*Homo sapiens*] | 9.4 |
| 5122 | AL021806 | *Homo sapiens* DNA sequence from PAC 779B17 on chromosome 22q13.1. Contains exon trap, complete sequence | 0.046 | 2827756 | EPHRIN TYPE-A RECEPTOR 1 PRECURSOR | 1.9 |
| 5123 | X68826 | *P. sativum* mRNA for fructose 1,6 biphosphatase | 0.95 | 1314248 | (U24681) NADH:cytochrome c reductase [synthetic construct] | 2e-05 |
| 5124 | M14431 | Bacteriophage phi-29 gene-16 gene, complete cds. | 0.035 | <NONE> | <NONE> | <NONE> |
| 5125 | U17033 | Human 180 kDa transmembrane PLA2 receptor mRNA, complete | 0.36 | 722372 | (U23139) similar to beta transducin proteins containing TRP- | 3e-08 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | cds. | | | ASP domains [*Caenorhabditis elegans*] | |
| 5126 | Z50202 | *P. vulgaris* arc5-1 gene | 0.007 | 1151256 | (U43319) transmembrane receptor [*Mus musculus*] | 0.13 |
| 5127 | AF013711 | *Homo sapiens* 22 kDa actin-binding protein | 2e-10 | <NONE> | <NONE> | <NONE> |
| 5128 | AF086324 | *Homo sapiens* full length insert cDNA clone ZD53E07 | 5e-09 | 3318653 | (U83192) post-synaptic density protein 95 [*Homo sapiens*] | 0.001 |
| 5129 | D90117 | *T. thermophila* mRNA for citrate synthase (EC 4.1.3.7) | 0.63 | <NONE> | <NONE> | <NONE> |
| 5130 | D45105 | *Metschnikowia reukaufii* 26S rRNA, partial sequence | 0.78 | <NONE> | <NONE> | <NONE> |
| 5131 | D85088 | *Ectoplana limuli* DNA for 18s ribosomal RNA | 0.41 | 267408 | PROBABLE DNA PACKAGING PROTEIN packaging protein [Human herpesvirus 4] | 7.2 |
| 5132 | X89886 | *P. patens* mRNA for 5-aminolevulinate dehydratase | 0.41 | 3875246 | (Z81490) similar to WD domain, G-beta repeats (2 domains); cDNA EST EMBL:T00482 comes from this gene; cDNA EST EMBL:T00923 comes from this gene; cDNA EST yk449d4.3 comes from this gene; cDNA EST yk449d4.5 comes from this gen . . . | 2e-22 |
| 5133 | AB014564 | *Homo sapiens* mRNA for KIAA0664 protein, partial cds | 0.0 | 2981221 | (AF053091) eyelid [*Drosophila melanogaster*] | 0.076 |
| 5134 | AE001403 | *Plasmodium falciparum* chromosome 2, section 40 of 73 of the complete sequence | 0.003 | 2495297 | HYPOTHETICAL 26.3 KD HOMEOBOX PROTEIN C02F12.5 IN CHROMOSOME X >gi\|1109893 (U41545) strong similarity to homeobox proteins; similar to inhibitor domain of tissue factor pathway inhibitor | 3.7 |
| 5135 | U92574 | *Fugu rubripes* homeobox protein HOXB-1 (FrHOXB-1) gene, complete cds | 0.54 | <NONE> | <NONE> | <NONE> |
| 5136 | U31118 | *Xenopus laevis* cytoplasmic myosin II regulatory light | 0.26 | 3879530 | (Z49130) cDNA EST yk486b9.3 comes from this gene; cDNA EST | 8e-07 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 5137 | L49035 | chain mRNA, complete cds *Gorilla gorilla* ABC-transporter (TAP2) mRNA, complete cds | 0.21 | 4007066 | yk486b9.5 comes from this gene (AJ131571) X protein [Hepatitis B virus] | 1.3 |
| 5138 | AF068628 | *Mus musculus* DNA cytosine-5 methyltransferase 3B3 (Dnmt3b) mRNA, alternatively spliced, complete cds | 4e-04 | <NONE> | <NONE> | <NONE> |
| 5139 | M64982 | Human fibrinogen alpha chain gene, complete mRNAs. | 0.062 | <NONE> | <NONE> | <NONE> |
| 5140 | M19262 | Rat clathrin light chain (LCB3) mRNA, complete cds. | 0.25 | 2088802 | (AF003151) D1007.4 gene product [*Caenorhabditis elegans*] | 0.012 |
| 5141 | X94947 | *L. esculentum* mRNA for homeobox protein | 3.7 | 2315770 | (AF016683) K09F6.1 gene product [*Caenorhabditis elegans*] | 0.096 |
| 5142 | <NONE> | <NONE> | <NONE> | <NONE> | <NONE> | <NONE> |
| 5143 | M33782 | Human TFEB protein mRNA, partial cds. | 0.36 | <NONE> | <NONE> | <NONE> |
| 5144 | AB011098 | *Homo sapiens* mRNA for KIAA0526 protein, complete cds | 2e-07 | 2501115 | TBX2 PROTEIN (T-BOX PROTEIN 2) | 0.90 |
| 5145 | AF039029 | *Homo sapiens* snurportin1 mRNA, complete cds | 0.0 | 3834390 | (AF039029) snurportin1 [*Homo sapiens*] | e-108 |
| 5146 | U22970 | Human interferon-inducible peptide (6-16) gene, complete cds | 0.21 | <NONE> | <NONE> | <NONE> |
| 5147 | D63880 | Human mRNA for KIAA0159 gene, complete cds | 2e-64 | <NONE> | <NONE> | <NONE> |
| 5148 | AB011174 | *Homo sapiens* mRNA for KIAA0602 protein, partial cds | e-164 | 3043728 | (AB011174) KIAA0602 protein [*Homo sapiens*] | 2e-53 |
| 5149 | AF053551 | *Homo sapiens* metaxin 2 (MTX2) mRNA, nuclear gene encoding mitochondrial protein, complete cds | 0.0 | 3283049 | (AF053551) metaxin 2 [*Homo sapiens*] | 1e-76 |
| 5150 | Y13382 | *Arabidopsis thaliana* ferrochelatase-I gene and promoter sequence | 0.012 | <NONE> | <NONE> | <NONE> |
| 5151 | AF044854 | *Colias eurytheme* large subunit ribosomal RNA gene, partial | 1.3 | <NONE> | <NONE> | <NONE> |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | sequence; tRNA-Val gene, complete sequence; and small subunit ribosomal RNA gene, partial sequence, mitochondrial genes for mitochondrial RNAs | | | | |
| 5152 | AF005059 | *Toxoplasma gondii* p97 mRNA, complete cds | 0.90 | 2570049 | (Y08701) Pinin [*Mus musculus*] | 1.3 |
| 5153 | D84307 | Human mRNA for phosphoethanolamine cytidylyltransferase, complete cds | 0.013 | <NONE> | <NONE> | <NONE> |
| 5154 | D38050 | Aspen prxA3a gene for peroxidase, complete cds | 0.018 | 1723942 | HYPOTHETICAL 20.8 KD PROTEIN IN COX4-GTS1 INTERGENIC REGION >gi\|2131614\|pir\|\|S61134 hypothetical protein YGL183c - yeast (*Saccharomyces cerevisiae*) >gi\|1143564\|gnl\|PID\|e199057 (X91489) putative HMG box [*Saccharomyces cerevisiae*] | 0.39 |
| 5155 | AL010208 | *Plasmodium falciparum* DNA *** SEQUENCING IN PROGRESS *** from contig 3-103, complete sequence | 0.13 | 1850115 | (Z86089) fadD2 [*Mycobacterium tuberculosis*] | 1.5 |
| 5156 | U07807 | Human metallothionein IV (MTIV) gene, complete cds. | 0.004 | <NONE> | <NONE> | <NONE> |
| 5157 | AF048991 | *Homo sapiens* MutS homolog 5 (MSH5) gene, exons 13 through 25 and complete cds | 0.001 | 3986756 | (AF109905) NG23 [*Mus musculus*] | 0.007 |
| 5158 | U39079 | *Schizosaccharomyces pombe* ARS binding protein 1 | 0.50 | <NONE> | <NONE> | <NONE> |
| 5159 | X01706 | Mouse intracisternal A-particle (IAP) gene 62 long terminal repeat (LTR) | 0.41 | 2224713 | (AB002384) KIAA0386 [*Homo sapiens*] | 8e-04 |
| 5160 | AF030558 | *Rattus norvegicus* phosphatidylinositol 5-phosphate 4-kinase gamma mRNA, complete cds | 8e-13 | <NONE> | <NONE> | <NONE> |
| 5161 | L06453 | *Strongylocentrotus* | 0.33 | 3914031 | BETA- | 0.087 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | *purpuratus* (clone C) high mobility group I protein (HMG1 homologue) gene, complete cds. | | | GALACTOSIDE SPECIFIC LECTIN I A CHAIN (MLA) (ML-I A) (RRNA N-GLYCOSIDASE) | |
| 5162 | Z68320 | *Caenorhabditis elegans* cosmid W07A12, complete sequence [*Caenorhabditis elegans*] | 0.28 | 2500558 | PUTATIVE RIBONUCLEASE III (RNASE III) >gi\|3876420\|gnl\|PID\|e1346063 (Z81070) similar to ribonuclease [*Caenorhabditis elegans*] | 2e-25 |
| 5163 | U40397 | *Mus musculus* serum amyloid A-4 protein (Saa4) gene, complete cds | 5e-04 | <NONE> | <NONE> | <NONE> |
| 5164 | X00367 | *Chlamydomonas chloroplast* DNA region with ARS element 03 (ARS = autonomously replicating sequence) | 0.046 | <NONE> | <NONE> | <NONE> |
| 5165 | U43838 | *Glycine max* choline kinase GmCK1p mRNA, complete cds | 1.2 | 132918 | 50S RIBOSOMAL PROTEIN L35, CHLOROPLAST PRECURSOR (CL35) >gi\|81486\|pir\|\|A36107 ribosomal protein L35 precursor, chloroplast - spinach *oleracea*] | 2.4 |
| 5166 | U67590 | *Methanococcus jannaschii* section 132 of 150 of the complete genome | 0.097 | <NONE> | <NONE> | <NONE> |
| 5167 | AB006787 | *Mus musculus* mRNA for apoptosis signal-regulating kinase 1, complete cds | 0.39 | 1263187 | (U24215) HOMODA hydrolase [*Pseudomonas putida*] *putida*] | 0.83 |
| 5168 | U43567 | *Trypanosoma cruzi* kinetoplast maxicircle DNA, clone TRCKPMAX | 0.054 | <NONE> | <NONE> | <NONE> |
| 5169 | U04706 | *Bos taurus* 50 kDa protein (adp50) mRNA, complete cds. | 0.0 | 2498104 | ADRENAL MEDULLA 50 KD PROTEIN | 8e-83 |
| 5170 | L14684 | *Rattus norvegicus* nuclear-encoded mitochondrial elongation factor G mRNA, complete cds. | e-137 | 585084 | ELONGATION FACTOR G, MITOCHONDRIAL PRECURSOR (MEF-G) >gi\|543383\|pir\|\|S40780 translation elongation factor G, mitochondrial - rat >gi\|310102 | 3e-59 |
| 5171 | U01120 | Human glucose-6-phosphatase mRNA, complete cds. > | 2e-04 | 544361 | GLUCOSE-6-PHOSPHATASE (G6PASE) 3.1.3.9) - human >gi\|452444 (U01120) glucose- | 4e-12 |

TABLE 2-continued

| SEQ ID | Nearest Neighbor (BlastN vs. Genbank | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 5172 | D87671 | Rat mRNA for TIP120, complete cds | e-144 | 1799570 | 6-phosphatase [*Homo sapiens*] (D87671) TIP120 [*Rattus norvegicus*] | 3e-69 |
| 5173 | U22296 | *Rattus norvegicus* casein kinase 1 gamma 1 isoform mRNA, complete cds | e-120 | 3024053 | CASEIN KINASE I, GAMMA 1 ISOFORM kinase 1 gamma 1 isoform [*Rattus norvegicus*] | 8e-54 |
| 5174 | Y07648 | *A. thaliana* nit2 gene, nit1 gene and nit3 gene | 0.007 | 2429486 | (AF025464) No definition line found [*Caenorhabditis elegans*] | 9.5 |
| 5175 | AB013721 | *Oryctolagus cuniculus* mRNA for mitsugumin 23, complete cds | 3e-91 | 3628745 | (AB013721) mitsugumin 23 [*Oryctolagus cuniculus*] | 0.006 |
| 5176 | M74069 | *Saccharomyces cerevisiae* endochitinase (CTS1-1) gene, complete cds. | 2.5 | <NONE> | <NONE> | <NONE> |
| 5177 | Z61469 | *H. sapiens* CpG DNA, clone 52h1, forward read cpg52h1.ft1a. | 1e-77 | 1184072 | (U40766) COL-1 [*Meloidogyne incognita*] | 0.002 |
| 5178 | AF015043 | *Homo sapiens* EH-binding protein mRNA, partial cds | 0.0 | 2492914 | APOLIPOPROTEIN C-IV PRECURSOR cluster E-C1-C2 linked gene [*Mus musculus*] | 3.0 |
| 5179 | X74560 | *H. sapiens* (clone pS2) sequence | 3e-04 | 3687469 | (AL031798) putative diphthine synthase | 3e-23 |
| 5180 | X94768 | *H. sapiens* RP3 gene (XLRP gene 3) | 1e-05 | <NONE> | <NONE> | <NONE> |
| 5181 | X80937 | *M. musculus* mRNA for RIP1 protein | 0.48 | 107750 | synapsin Ib - human | 3e-04 |
| 5182 | M12759 | Human Ig J chain gene, exons 3 and 4. | 0.036 | <NONE> | <NONE> | <NONE> |
| 5183 | M30773 | Human calcineurin B mRNA, complete cds | 0.002 | 3878494 | (Z79602) predicted using Genefinder; Similarity to Yeast hypothetical protein YAE2 gene; cDNA EST EMBL:M88949 comes from this gene | 3e-06 |
| 5184 | U08831 | Human immunodeficiency virus type 1, sample 019 from Thailand (E2TH019W.01di 1sCD), envelope glycoprotein c2v3 region (env) gene, partial cds. | 0.015 | <NONE> | <NONE> | <NONE> |
| 5185 | Z98303 | Human DNA sequence from BAC 140H19 on chromosome Xq24-25. Contains STS | 0.005 | <NONE> | <NONE> | <NONE> |
| 5186 | AE000952 | *Archaeoglobus* | 2e-07 | 3257245 | (AP000003) 571aa | 5e-08 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | *fulgidus* section 155 of 172 of the complete genome | | | long hypothetical oxaloacetate decarboxylase alpha chain [*Pyrococcus horikoshii*] | |
| 5187 | L48476 | *Homo sapiens* (subclone 3_e10 from P1 H21) DNA sequence. | 2e-04 | 3877439 | (Z72510) similarity to yeast UTR3 protein (Swiss Prot accession number P21374); cDNA EST EMBL:D72822 comes from this gene; cDNA EST EMBL:D75763 comes from this gene; cDNA EST yk274e3.3 comes from this gene; cDNA EST yk274e3 . . . | 0.19 |
| 5188 | U95102 | *Xenopus laevis* mitotic phosphoprotein 90 mRNA, complete cds | 3e-09 | <NONE> | <NONE> | <NONE> |
| 5189 | AF055022 | *Homo sapiens* clone 24684 mRNA sequence | e-102 | 2708743 | (AC003952) putative Tal-1-like reverse transcriptase | 4.0 |
| 5190 | AJ009761 | *Homo sapiens* mRNA for putative dimethyladenosine transferase, partial | e-121 | 4050050 | (AF102147) putative dimethyladenosine transferase [*Homo sapiens*] | 8e-48 |
| 5191 | Y08238 | *H. pylori* clpB gene | 0.27 | 1572756 | (U70848) - C43G2.1 gene product [*Caenorhabditis elegans*] | 1e-21 |
| 5192 | <NONE> | <NONE> | <NONE> | 2828280 | (AL021687) putative protein [*Arabidopsis thaliana*] >gi\|2832633\|gnl\|PID\|e1249651 (AL021711) putative protein [*Arabidopsis thaliana*] | 9e-36 |
| 5193 | J00747 | Rat insulin-1 (ins-1) gene. | 6e-05 | 4154522 | (AE001441) putative [*Helicobacter pylori*] | 3.2 |
| 5194 | U64454 | Human 3' of immunoglobulin heavy chain locus | 0.83 | 281204 | gene LF3 protein - human herpesvirus 4 virus] | 0.069 |
| 5195 | AB002383 | Human mRNA for KIAA0385 gene, complete cds | 8e-13 | 2498318 | DXS6673E PROTEIN retardation candidate gene [*Homo sapiens*] | 2e-24 |
| 5196 | M81840 | Human NRL gene product mRNA, complete cds. | 0.029 | 3875740 | (Z81497) similar to mannosyl-oligosaccharide alpha-1,2-mannosidase; cDNA EST EMBL:D67155 comes from this gene; cDNA EST | 6e-18 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | | | | EMBL:D64219 comes from this gene; cDNA EST yk260e12.3 comes from this gene; cDNA EST yk260e12.5 comes f . . . | |
| 5197 | U12523 | *Rattus norvegicus* ultraviolet B radiation-activated UV98 mRNA, partial sequence. | 1e-10 | 3219914 | HYPOTHETICAL 16.8 KD PROTEIN C30D10.04 IN CHROMOSOME II >gi\|2276353\|gnl\|PID\|e330328 *pombe*] | 2e-11 |
| 5198 | AB017026 | *Mus musculus* mRNA for oxysterol-binding protein, complete cds | 0.0 | 3551523 | (AB017026) oxysterol-binding protein | e-120 |
| 5199 | U83981 | *Homo sapiens* apoptosis associated protein (GADD34) mRNA, complete cds | e-119 | 3258618 | (U83981) apoptosis associated protein [*Homo sapiens*] | 7e-26 |
| 5200 | U37580 | *Streptomyces coelicolor* phosphotyrosine protein phosphatase (ptpA) gene, putative cystathionine gamma-lyase (cysA) gene, and LysR-like protein gene, complete cds | 0.048 | 2459916 | (AF005859) anon2D7 [*Drosophila melanogaster*] | 0.18 |
| 5201 | D00723 | Human mRNA for hydrogen carrier protein, a component of an enzyme complex, glycine synthase (EC 2.1.2.10) | 3e-19 | <NONE> | <NONE> | <NONE> |
| 5202 | X89366 | *A. thaliana* DNA for 40 kDa protein gene | 0.025 | 1209669 | (U38810) CAGR1 [*Homo sapiens*] >gi\|3098420 (AF040945) homeotic regulator homolog MAB21 [*Mus musculus*] | 0.008 |
| 5203 | AF067158 | HIV-1 isolate 301905 from India, complete genome | 2.4 | <NONE> | <NONE> | <NONE> |
| 5204 | U09954 | Human ribosomal protein L9 gene, 5' region and complete cds. | 5e-37 | <NONE> | <NONE> | <NONE> |
| 5205 | AF029984 | *Lycopersicon esculentum* COP1 homolog (COP1) mRNA, complete cds | 7e-37 | 4090943 | (AF029984) COP1 homolog [*Lycopersicon esculentum*] | 2e-49 |
| 5206 | U43076 | *Mus musculus* cdc37 homolog mRNA, complete cds | 2e-17 | 2655422 | (AF035530) CDC37 [*Gallus gallus*] | 2e-22 |
| 5207 | U07745 | *Lycopersicon esculentum* | 4e-32 | 533707 | (U12536) 3-methylcrotonyl- | 4e-49 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | biotin-containing subunit of methylcrotonyl-CoA carboxylase mRNA, partial cds. | | | CoA carboxylase precursor | |
| 5208 | X74465 | Human papillomavirus type 10 genomic DNA | 1.3 | 3879121 | (Z70310) predicted using Genefinder; Similarity to Mouse ankyrin (PIR Acc. No. S37771); cDNA EST EMBL:T01923 comes from this gene; cDNA EST EMBL:D32335 comes from this gene; cDNA EST EMBL:D32723 comes from this gene; cDNA ES . . . Genefinder; Similarity to M | 2e-56 |
| 5209 | X99261 | A. evecta gene encoding blue-light photoreceptor, intron | 0.14 | 2257939 | (AF005665) properdin [Homo sapiens] | 7.6 |
| 5210 | M35296 | Human tyrosine kinase arg gene mRNA. | 1.1 | 1125781 | (U42841) short region of weak similarity to chicken limb deformity protein (PIR:S24286) [Caenorhabditis elegans] | 0.61 |
| 5211 | Z57610 | H. sapiens CpG DNA, clone 187a10, reverse read cpg187a10.rt1a. | e-102 | 404764 | (L10409) fork head related protein [Mus musculus] | 1e-16 |
| 5212 | X85753 | Homo sapiens mRNA for CDK8 protein kinase > :: emb|A61243|A61 243 Sequence 1 from Patent WO9709432 | 6e-59 | 1171821 | NADH-UBIQUINONE OXIDOREDUCTASE CHAIN 5 >gi|559499|gnl|PID|e1192548 (X54253) ND5 protein | 9.5 |
| 5213 | U27341 | Bos taurus endothelin converting enzyme-2 Sequence 1 from U.S. Pat. No. 5736376 | 7e-61 | 2136744 | endothelin converting enzyme-2 - bovine | 3e-29 |
| 5214 | U63648 | Mus musculus p160 myb-binding protein (P160) mRNA, complete cds | 4e-58 | 2645205 | (U63648) p160 myb-binding protein [Mus musculus] | 2e-34 |
| 5215 | AF035940 | Homo sapiens MAGOH mRNA, complete cds | e-140 | 2306969 | (AF007860) xl-Mago [Xenopus laevis] | 3e-76 |
| 5216 | X80045 | O. aries mRNA for acetyl-CoA carboxylase | 2e-54 | 542750 | acetyl-CoA carboxylase (EC 6.4.1.2) - human sapiens] >gi|740964|prf||2006242A Ac-CoA carboxylase | 8e-10 |
| 5217 | Z46372 | R. norvegicus | e-134 | 3876360 | (Z68315) | 3e-12 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| 5218 | AF035940 | Homo sapiens MAGOH mRNA, complete cds | e-143 | 2330011 | Similarity to Human MAP kinase phosphatase-1 (SW:PTN7_HUMAN) [Caenorhabditis elegans] (AF007862) mm-Mago [Mus musculus] >gi\|2909828 (AF035939) similar to mago nashi [Mus musculus] >gi\|2909830 | 7e-81 |
| 5219 | Z72521 | Human DNA sequence from cosmid N29F4 on chromosome 22q11.2-qter contains STS | 6e-04 | <NONE> | <NONE> | <NONE> |
| 5220 | S74340 | {clone E572, estrogen induced gene} [rats, Sprague-Dawley, hypothalamus, mRNA Partial, 130 nt] | 4e-29 | <NONE> | <NONE> | <NONE> |
| 5221 | AL008711 | Human DNA sequence from PAC 390N22 on chromosome Xp22.2 | 0.33 | 1184707 | (U40868) folylpolyglutamate synthetase [Homo sapiens] | 7.9 |
| 5222 | AE000012 | Mycoplasma pneumoniae section 12 of 63 of the complete genome | 0.15 | <NONE> | <NONE> | <NONE> |
| 5223 | D78333 | Human mRNA for testis-specific TCP20, complete cds | e-113 | 2501141 | T-COMPLEX PROTEIN 1, ZETA-LIKE SUBUNIT (TCP-1-ZETA-LIKE) (CCT-ZETA-LIKE) TCP20 [Homo sapiens] | 2e-42 |
| 5224 | AF042333 | Oryza sativa 24-methylene lophenol C24(1)methyltransferase mRNA, complete cds | 0.003 | 3883124 | (AF082300) arabinogalactan-protein [Arabidopsis thaliana] | 0.006 |
| 5225 | U15426 | Human anonymous mRNA sequence with CCA repeat region. | 4e-06 | 1123105 | (U42438) similar to S. cerevisiae longevity-assurance protein 1 (SP:P38703) [Caenorhabditis elegans] | 0.34 |
| 5226 | AF052497 | Homo sapiens clone B18 unknown mRNA | 0.003 | 1144514 | (U34781) Antho-LWamidII preprohormone [Anthopleura elegantissima] >gi\|1586846\|prf\|\|2 204411A prepro-hormone | 4.3 |
| 5227 | D86590 | Zinnia elegans mRNA for cinnamyl alcohol dehydrogenase, partial cds | 0.13 | <NONE> | <NONE> | <NONE> |
| 5228 | AF081144 | Rattus norvegicus | 5e-14 | 1718004 | TEGUMENT | 1.4 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | CL1AA mRNA, complete cds | | | PROTEIN UL49 HOMOLOG herpesvirus 1] >gi\|995634 (Z54206) UL49 [Bovine herpesvirus 1] >gi\|2653299\|gnl\|PID\|e1187295 (AJ004801) virion protein (tegument) [Bovine herpesvirus type 1.1] | |
| 5229 | M63016 | Human X chromosome enhancer-like sequence. | 6e-04 | <NONE> | <NONE> | <NONE> |
| 5230 | L24755 | *Mus musculus* bone morphogenetic protein (Bmp-1) mRNA, complete cds. | 1.2 | <NONE> | <NONE> | <NONE> |
| 5231 | <NONE> | <NONE> | <NONE> | 2828280 | (AL021687) putative protein [*Arabidopsis thaliana*] >gi\|2832633\|gnl\|PID\|e1249651 (AL021711) putative protein [*Arabidopsis thaliana*] | 9e-36 |
| 5232 | U27341 | *Bos taurus* endothelin converting enzyme-2 Sequence 1 from U.S. Pat. No. 5736376 | 1e-22 | 2136744 | endothelin converting enzyme-2 - bovine | 2e-09 |
| 5233 | M81840 | Human NRL gene product mRNA, complete cds. | 0.030 | 3875740 | (Z81497) similar to mannosyl-oligosaccharide alpha-1,2-mannosidase; cDNA EST EMBL:D67155 comes from this gene; cDNA EST EMBL:D64219 comes from this gene; cDNA EST yk260e12.3 comes from this gene; cDNA EST yk260e12.5 comes f . . . | 6e-18 |
| 5234 | AJ000097 | *Homo sapiens* mRNA for EYA1B gene | 2.7 | 3395586 | (AL031179) similarity to phosphomannomutases [*Schizosaccharomyces pombe*] | 6e-38 |
| 5235 | U30788 | *Rattus norvegicus* Tclone4 mRNA | 1e-68 | 3523162 | (AF076292) TGF-beta/activin signal transducer FAST-1p | 1.4 |
| 5236 | U88964 | Human HEM45 mRNA, complete cds | 0.0 | 2062680 | (U88964) HEM45 [*Homo sapiens*] | 7e-77 |
| 5237 | AF061016 | *Homo sapiens* UDP-glucose dehydrogenase (UGDH) mRNA, | 0.0 | 3127127 | (AF061016) UDP-glucose dehydrogenase [*Homo sapiens*] | 5e-90 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | complete cds | | | dehydrogenase [*Homo sapiens*] | |
| 5238 | D43921 | Mouse AZ1 mRNA for pre-acrosome localization protein, complete cds | 3e-15 | 2137118 | acrosomal protein AZ1 - mouse localization protein [*Mus musculus*] | 0.007 |
| 5239 | AF056022 | *Homo sapiens* p60 katanin mRNA, complete cds | 0.0 | 3283072 | (AF056022) p60 katanin [*Homo sapiens*] | 2e-60 |
| 5240 | U77949 | Human Cdc6-related protein (HsCDC6) mRNA, complete cds | 1e-83 | <NONE> | <NONE> | <NONE> |
| 5241 | AJ005016 | *Homo sapiens* mRNA for putative ABC transporter, partial | 0.0 | 3005931 | (AJ005016) ABC transporter [*Homo sapiens*] | 3e-70 |
| 5242 | X56756 | Sheep mRNA for tumor necrosis factor alpha | 4.5 | <NONE> | <NONE> | <NONE> |
| 5243 | AF020833 | *Homo sapiens* eukaryotic translation initiation factor 3 subunit (p42) mRNA, complete cds | 0.0 | 2460200 | (AF020833) eukaryotic translation initiation factor 3 subunit [*Homo sapiens*] | e-158 |
| 5244 | X69878 | *H. sapiens* Flt4 mRNA for transmembrane tyrosine kinase | 4e-43 | <NONE> | <NONE> | <NONE> |
| 5245 | M27826 | Human endogenous retroviral protease mRNA, complete cds. | 1e-66 | <NONE> | <NONE> | <NONE> |
| 5246 | U20285 | Human Gps1 (GSP1) mRNA, complete cds | 2e-54 | 644879 | (U20285) Gps1 [*Homo sapiens*] | 8e-20 |
| 5247 | AF049528 | *Homo sapiens* huntingtin-interacting protein HYPA/FBP11 (HYPA) mRNA, partial cds | 5e-75 | 3341990 | (AF049528) huntingtin-interacting protein HYPA/FBP11 | 2e-20 |
| 5248 | U87277 | Human splicing factor SRp30c gene, exon 1 | 0.14 | 267449 | HYPOTHETICAL 12.5 KD PROTEIN ZK637.2 IN CHROMOSOME III >gi\|102507\|pir\|\|S1 5787 hypothetical protein 1 (cosmid ZK637) - *Caenorhabditis elegans* Genefinder; cDNA EST yk217b5.3 comes from this gene; cDNA EST yk217b5.5 comes from this gene; cDNA EST yk340g12.3 | 1e-08 |
| 5249 | D16919 | Human HepG2 3' region cDNA, | e-164 | 3152559 | (AC002986) Similarity to A. | 2e-52 |

TABLE 2-continued

| SEQ ID | Nearest Neighbor (BlastN vs. Genbank) | | | Nearest Neighbor (BlastX vs. Non-Redundant Proteins) | | |
|---|---|---|---|---|---|---|
| | ACCESSION | DESCRIPTION | P VALUE | ACCESSION | DESCRIPTION | P VALUE |
| | | clone hmd3e06 | | | *thaliana* gene product F21M12.20, gb\|AC000132. EST gb\|Z25651 comes from this gene. [*Arabidopsis thaliana*] | |
| 5250 | AJ006064 | *Rattus norvegicus* mRNA for coronin-like protein | e-142 | 3757680 | (AJ006064) coronin-like protein [*Rattus norvegicus*] | 5e-73 |
| 5251 | AB011000 | *Mus musculus* mRNA for choline/ethanolamine kinase, complete cds | 1e-18 | 2780752 | (AB006607) choline/ethanolamine kinase | 0.001 |
| 5252 | X80169 | *M. musculus* mRNA for 200 kD protein | 0.0 | 1717793 | PROTEIN TSG24 (MEIOTIC CHECK POINT REGULATOR) >gi\|1083553\|pir\|\|A 55117 tsg24 protein - mouse | e-150 |

TABLE 3

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 3920 | 393.E10.sp6:148957 | 7tm_1 | 531 | 710 | 9520 | for |
| 2667 | 172.F10.sp6:133946 | 7tm_2 | 45 | 724 | 8708 | rev |
| 2758 | 177.C6.sp6:134733 | 7tm_2 | 41 | 697 | 9828 | rev |
| 2933 | 184.C7.sp6:135556 | 7tm_2 | 3 | 834 | 8987 | for |
| 3129 | 121.E12.sp6:131940 | 7tm_2 | 245 | 1324 | 9550 | rev |
| 3365 | 172.A7.sp6:133883 | 7tm_2 | 94 | 761 | 8743 | rev |
| 3418 | 123.F9.sp6:132333 | 7tm_2 | 203 | 585 | 8785 | rev |
| 3419 | 123.F9.sp6:132333 | 7tm_2 | 203 | 585 | 8785 | rev |
| 3597 | 394.G2.sp6:149165 | 7tm_2 | 73 | 793 | 9209 | for |
| 3648 | 370.C5.sp6:141726 | 7tm_2 | 76 | 770 | 9269 | for |
| 3686 | 370.B1.sp6:141710 | 7tm_2 | 89 | 662 | 8791 | for |
| 3695 | 368.A12.sp6:141322 | 7tm_2 | 121 | 719 | 9015 | rev |
| 3696 | 368.A12.sp6:141322 | 7tm_2 | 121 | 719 | 9015 | rev |
| 4172 | 219.C10.sp6:139007 | 7tm_2 | 46 | 774 | 11394 | rev |
| 4216 | 368.D11.sp6:141357 | 7tm_2 | 66 | 775 | 9384 | rev |
| 4228 | 368.A11.sp6:141321 | 7tm_2 | 7 | 1079 | 9097 | for |
| 4441 | 99.F7.sp6:131296 | 7tm_2 | 534 | 1265 | 10956 | rev |
| 4442 | 99.F7.sp6:131296 | 7tm_2 | 534 | 1265 | 10956 | rev |
| 4482 | 100.D2.sp6:131459 | 7tm_2 | 122 | 1404 | 9296 | rev |
| 4495 | 395.B12.sp6:149307 | 7tm_2 | 79 | 1432 | 10427 | rev |
| 4525 | 90.B4.sp6:130874 | 7tm_2 | 4 | 691 | 9435 | for |
| 4616 | 100.D5.sp6:131462 | 7tm_2 | 655 | 1349 | 9255 | for |
| 4653 | 100.D7.sp6:131464 | 7tm_2 | 357 | 1346 | 11461 | rev |
| 4654 | 100.D7.sp6:131464 | 7tm_2 | 357 | 1346 | 11461 | rev |
| 4658 | 100.H6.sp6:131511 | 7tm_2 | 119 | 1035 | 10001 | rev |
| 4659 | 100.G6.sp6:131499 | 7tm_2 | 363 | 1188 | 9901 | rev |
| 4660 | 100.F6.sp6:131487 | 7tm_2 | 50 | 1127 | 8799 | for |
| 4661 | 100.F6.sp6:131487 | 7tm_2 | 50 | 1127 | 8799 | for |
| 4710 | 367.H9.sp6:141210 | 7tm_2 | 143 | 1266 | 11883 | rev |
| 4755 | 370.F4.sp6:141761 | 7tm_2 | 78 | 704 | 8942 | for |
| 4856 | 367.H11.sp6:141212 | 7tm_2 | 176 | 1227 | 9975 | rev |
| 4885 | 123.E10.sp6:132322 | 7tm_2 | 210 | 691 | 9071 | rev |
| 4900 | 123.E10.sp6:132322 | 7tm_2 | 210 | 691 | 9071 | rev |
| 4901 | 123.E10.sp6:132322 | 7tm_2 | 210 | 691 | 9071 | rev |
| 2656 | 176.H11.sp6:134606 | ANK | 207 | 290 | 4450 | for |
| 2555 | 180.C9.sp6:135947 | asp | 156 | 670 | 6710 | for |
| 3632 | 368.H11.sp6:141405 | asp | 136 | 1226 | 6880 | rev |

TABLE 3-continued

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 4205 | 368.B5.sp6:141327 | asp | 309 | 806 | 6073 | for |
| 4251 | 369.D6.sp6:141546 | asp | 434 | 1332 | 6263 | rev |
| 4253 | 396.F9.sp6:149544 | asp | 97 | 1106 | 5999 | rev |
| 4261 | 216.G10.sp6:139247 | asp | 74 | 703 | 6188 | rev |
| 4365 | 122.H12.sp6:132168 | asp | 152 | 1040 | 6183 | rev |
| 4498 | 80.H6.sp6:130297 | asp | 61 | 418 | 5944 | rev |
| 4664 | 172.E5.sp6:133929 | asp | 219 | 976 | 6434 | for |
| 4718 | 185.D9.sp6:135762 | asp | 31 | 872 | 5944 | rev |
| 4733 | 185.D9.sp6:135762 | asp | 31 | 872 | 5944 | rev |
| 4746 | 176.B10.sp6:134533 | asp | 253 | 1446 | 6079 | rev |
| 4822 | 177.F3.sp6:134766 | asp | 0 | 894 | 6336 | rev |
| 4854 | 184.F11.sp6:135596 | asp | 61 | 737 | 6416 | rev |
| 4856 | 367.H11.sp6:141212 | asp | 81 | 1187 | 6182 | rev |
| 4929 | 180.E6.sp6:135968 | asp | 81 | 706 | 6150 | for |
| 4931 | 180.E6.sp6:135968 | asp | 81 | 706 | 6150 | for |
| 2723 | 180.F2.sp6:135976 | ATPases | 135 | 627 | 11664 | for |
| 2842 | 217.H11.sp6:139452 | ATPases | 2 | 701 | 5972 | for |
| 3019 | 216.B1.sp6:139178 | ATPases | 170 | 616 | 6150 | for |
| 3046 | 121.B8.sp6:131900 | ATPases | 13 | 635 | 5867 | rev |
| 3190 | 80.D2.sp6:130245 | ATPases | 13 | 386 | 6068 | for |
| 3290 | 176.C6.sp6:134541 | ATPases | 85 | 579 | 5883 | for |
| 3670 | 369.C10.sp6:141538 | ATPases | 329 | 730 | 6206 | for |
| 3998 | 394.H8.sp6:149183 | ATPases | 21 | 571 | 5954 | rev |
| 4119 | 218.F11.sp6:138852 | ATPases | 313 | 816 | 6057 | for |
| 4159 | 219.A7.sp6:138980 | ATPases | 88 | 662 | 6145 | for |
| 4223 | 368.F9.sp6:141379 | ATPases | 178 | 648 | 5937 | for |
| 4384 | 181.G11.sp6:135354 | ATPases | 362 | 769 | 5900 | rev |
| 4473 | 369.B4.sp6:141520 | ATPases | 4 | 412 | 14130 | for |
| 4540 | 218.C8.sp6:138813 | ATPases | 12 | 576 | 5782 | rev |
| 4560 | 404.G6.sp6:162933 | ATPases | 86 | 605 | 6001 | rev |
| 4689 | 367.H8.sp6:141209 | ATPases | 17 | 476 | 5905 | rev |
| 4785 | 184.E5.sp6:135578 | ATPases | 184 | 632 | 5943 | for |
| 4792 | 184.C6.sp6:135555 | ATPases | 333 | 813 | 5773 | for |
| 4847 | 184.B11.sp6:135548 | ATPases | 14 | 498 | 6140 | for |
| 5041 | 377.C1.sp6:141918 | ATPases | 4 | 655 | 5933 | for |
| 3404 | 176.F10.sp6:134581 | Bcl-2 | 69 | 356 | 16419 | for |
| 4036 | 367.F5.sp6:141182 | bromodomain | 40 | 210 | 8810 | for |
| 4489 | 369.D3.sp6:141543 | bromodomain | 63 | 230 | 10270 | for |
| 3408 | 172.E1.sp6:133925 | BZIP | 146 | 298 | 4066 | for |
| 3951 | 393.G5.sp6:148976 | BZIP | 116 | 304 | 5931 | for |
| 4850 | 172.E9.sp6:133933 | BZIP | 91 | 260 | 4366 | for |
| 3618 | 370.B12.sp6:141721 | cyclin | 118 | 324 | 8980 | for |
| 3895 | 395.G6.sp6:149361 | cyclin | 11 | 281 | 6930 | for |
| 4536 | 395.G8.sp6:149363 | cyclin | 12 | 279 | 5950 | for |
| 4455 | 99.F5.sp6:131294 | Cys-protease | 72 | 348 | 18479 | for |
| 4684 | 180.D1.sp6:135951 | Cys-protease | 38 | 992 | 10103 | rev |
| 4688 | 180.D1.sp6:135951 | Cys-protease | 38 | 992 | 10103 | rev |
| 4801 | 177.E4.sp6:134755 | Cys-protease | 48 | 326 | 19999 | for |
| 4659 | 100.G6.sp6:131499 | DAG_PE_bind | 605 | 702 | 6290 | rev |
| 4821 | 377.C8.sp6:141925 | Dead_box_helic | 172 | 828 | 7867 | rev |
| 5083 | 216.A1.sp6:139166 | Dead_box_helic | 44 | 589 | 26532 | for |
| 2734 | 177.G4.sp6:134779 | EFhand | 79 | 153 | 3780 | for |
| 2893 | 185.A1.sp6:135718 | EFhand | 287 | 358 | 2580 | rev |
| 3775 | 377.A5.sp6:141898 | EFhand | 477 | 563 | 3010 | for |
| 4056 | 367.B7.sp6:141136 | EFhand | 225 | 272 | 2500 | rev |
| 4152 | 218.B10.sp6:138803 | EFhand | 40 | 114 | 2640 | rev |
| 4153 | 218.B10.sp6:130003 | EFhand | 40 | 114 | 2640 | rev |
| 4154 | 218.C10.sp6:138815 | EFhand | 39 | 113 | 2640 | rev |
| 4905 | 393.H12.sp6:148995 | EFhand | 145 | 231 | 4640 | for |
| 4943 | 219.A9.sp6:138982 | EFhand | 685 | 750 | 2550 | rev |
| 2849 | 218.B5.sp6:138798 | Ets_Nterm | 340 | 531 | 10400 | for |
| 2728 | 180.A2.sp6:135916 | FNtypeII | 291 | 423 | 6400 | rev |
| 3018 | 216.C1.sp6:139190 | FNtypeII | 501 | 634 | 6460 | for |
| 4496 | 218.G1.sp6:138854 | FNtypeII | 20 | 141 | 6180 | rev |
| 4914 | 393.H8.sp6:148991 | FNtypeII | 448 | 576 | 6110 | for |
| 2504 | 181.C3.sp6:135298 | G-alpha | 66 | 715 | 8084 | rev |
| 3290 | 176.C6.sp6:134541 | G-alpha | 62 | 690 | 9062 | for |
| 4288 | 121.B4.sp6:131896 | G-alpha | 46 | 447 | 21415 | for |
| 4444 | 217.D12.sp6:139405 | G-alpha | 15 | 702 | 40404 | for |
| 4562 | 404.B7.sp6:162874 | G-alpha | 120 | 682 | 8424 | for |
| 2503 | 180.A11.sp6:135925 | helicase_C | 165 | 479 | 4494 | for |
| 4469 | 369.C4.sp6:141532 | helicase_C | 559 | 756 | 3732 | rev |

TABLE 3-continued

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 5020 | 185.D12.sp6:135765 | helicase_C | 381 | 534 | 5000 | for |
| 4241 | 396.H8.sp6:149567 | homeobox | 80 | 230 | 5170 | for |
| 2550 | 180.E5.sp6:135967 | mkk | 342 | 612 | 5791 | for |
| 3407 | 172.F1.sp6:133937 | mkk | 94 | 669 | 5688 | rev |
| 3451 | 123.A2.sp6:132266 | mkk | 26 | 378 | 7889 | for |
| 3600 | 394.B3.sp6:149106 | mkk | 32 | 782 | 9544 | for |
| 3646 | 370.H4.sp6:141785 | mkk | 18 | 307 | 9394 | for |
| 3680 | 369.G11.sp6:141587 | mkk | 182 | 725 | 5375 | for |
| 4175 | 219.H10.sp6:139067 | mkk | 280 | 723 | 15454 | for |
| 4205 | 368.B5.sp6:141327 | mkk | 249 | 725 | 5502 | for |
| 4278 | 181.C9.sp6:135304 | mkk | 168 | 880 | 5551 | rev |
| 4322 | 121.F6.sp6:131946 | mkk | 111 | 730 | 5399 | for |
| 4777 | 177.E2.sp6:134753 | mkk | 288 | 636 | 5720 | rev |
| 4482 | 100.D2.sp6:131459 | PDEase | 849 | 1195 | 5945 | for |
| 2578 | 181.H11.sp6:135366 | protkinase | 116 | 710 | 5531 | for |
| 2712 | 177.G7.sp6:134782 | protkinase | 6 | 511 | 5445 | for |
| 2835 | 218.C1.sp6:138806 | protkinase | 127 | 747 | 5492 | for |
| 2843 | 218.E1.sp6:138830 | protkinase | 64 | 726 | 5592 | rev |
| 2971 | 217.F4.sp6:139421 | protkinase | 83 | 702 | 5818 | rev |
| 3009 | 217.A4.sp6:139361 | protkinase | 57 | 682 | 5395 | rev |
| 3084 | 121.E2.sp6:131930 | protkinase | 69 | 658 | 5593 | rev |
| 3226 | 100.D8.sp6:131465 | protkinase | 174 | 620 | 5453 | for |
| 3274 | 100.C3.sp6:131448 | protkinase | 228 | 736 | 5616 | for |
| 3356 | 172.B5.sp6:133893 | protkinase | 148 | 715 | 5381 | for |
| 3377 | 172.B6.sp6:133894 | protkinase | 119 | 775 | 5616 | for |
| 3451 | 123.A2.sp6:132266 | protkinase | 24 | 384 | 9797 | for |
| 3600 | 394.B3.sp6:149106 | protkinase | 357 | 780 | 11395 | for |
| 3635 | 377.G11.sp6:141976 | protkinase | 117 | 739 | 5992 | for |
| 3646 | 370.H4.sp6:141785 | protkinase | 24 | 275 | 8338 | for |
| 3665 | 370.F2.sp6:141759 | protkinase | 33 | 800 | 5658 | for |
| 3669 | 369.B10.sp6:141526 | protkinase | 1 | 482 | 5504 | rev |
| 3700 | 369.D2.sp6:141542 | protkinase | 28 | 661 | 5428 | for |
| 3710 | 369.G6.sp6:141582 | protkinase | 71 | 631 | 5751 | for |
| 3791 | 396.C11.sp6:149510 | protkinase | 27 | 709 | 5793 | rev |
| 3905 | 393.H7.sp6:148990 | protkinase | 88 | 680 | 5470 | rev |
| 3919 | 393.D10.sp6:148945 | protkinase | 72 | 594 | 5617 | for |
| 4044 | 367.G4.sp6:141193 | protkinase | 30 | 699 | 5439 | for |
| 4072 | 368.B2.sp6:141324 | protkinase | 44 | 800 | 5556 | for |
| 4117 | 218.D11.sp6:138828 | protkinase | 38 | 781 | 6423 | for |
| 4175 | 219.H10.sp6:139067 | protkinase | 277 | 717 | 15720 | for |
| 4373 | 216.E5.sp6:139218 | protkinase | 115 | 710 | 5537 | for |
| 4569 | 100.C10.sp6:131455 | protkinase | 56 | 783 | 5556 | rev |
| 4755 | 370.F4.sp6:141761 | protkinase | 39 | 803 | 5635 | for |
| 4760 | 370.F3.sp6:141760 | protkinase | 188 | 775 | 5771 | for |
| 4807 | 184.H3.sp6:135612 | protkinase | 23 | 699 | 5515 | for |
| 5059 | 180.B5.sp6:135931 | protkinase | 182 | 671 | 5718 | rev |
| 5102 | 393.F4.sp6:148963 | protkinase | 28 | 650 | 5345 | for |
| 3671 | 369.D10.sp6:141550 | ras | 12 | 332 | 9802 | for |
| 3936 | 393.A3.sp6:148902 | Thioredox | 0 | 263 | 5887 | rev |
| 3927 | 393.F11.sp6:148970 | TNFR_c6 | 151 | 261 | 6445 | for |
| 2956 | 184.E10.sp6:135583 | transmembrane4 | 19 | 483 | 8339 | rev |
| 2981 | 217.E6.sp6:139411 | transmembrane4 | 83 | 728 | 8417 | for |
| 3836 | 396.C9.sp6:149508 | transmembrane4 | 300 | 924 | 9444 | rev |
| 4038 | 367.A6.sp6:141123 | transmembrane4 | 32 | 495 | 8407 | rev |
| 4364 | 123.A1.sp6:132265 | transmembrane4 | 1289 | 1548 | 8114 | rev |
| 4406 | 122.C1.sp6:132097 | transmembrane4 | 6 | 535 | 8122 | for |
| 4431 | 122.E4.sp6:132124 | transmembrane4 | 10 | 530 | 8829 | for |
| 4441 | 99.F7.sp6:131296 | transmembrane4 | 613 | 1253 | 9443 | rev |
| 4442 | 99.F7.sp6:131296 | transmembrane4 | 613 | 1253 | 9443 | rev |
| 4653 | 100.D7.sp6:131464 | transmembrane4 | 335 | 1207 | 8255 | rev |
| 4654 | 100.D7.sp6:131464 | transmembrane4 | 335 | 1207 | 8255 | rev |
| 4710 | 367.H9.sp6:141210 | transmembrane4 | 398 | 1130 | 8352 | rev |
| 4944 | 180.H7.sp6:136005 | transmembrane4 | 356 | 983 | 8356 | rev |
| 3381 | 176.D9.sp6:134556 | trypsin | 164 | 764 | 9670 | rev |
| 4684 | 180.D1.sp6:135951 | trypsin | 371 | 1229 | 10479 | rev |
| 4688 | 180.D1.sp6:135951 | trypsin | 371 | 1229 | 10479 | rev |
| 2754 | 177.H6.sp6:134793 | WD_domain | 345 | 437 | 6510 | for |
| 3046 | 121.B8.sp6:131900 | WD_domain | 98 | 193 | 6400 | fbr |
| 3227 | 100.B10.sp6:131443 | WD_domain | 544 | 642 | 6590 | for |
| 4243 | 121.A8.sp6:131888 | WD_domain | 93 | 188 | 6400 | for |
| 5046 | 185.F10.sp6:135787 | WD_domain | 382 | 480 | 5880 | for |
| 3129 | 121.E12.sp6:131940 | Wnt_dev_sign | 101 | 821 | 12160 | rev |

TABLE 3-continued

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 3173 | 99.G6.sp6:131307 | Wnt_dev_sign | 49 | 880 | 12334 | rev |
| 3390 | 176.C9.sp6:134544 | Wnt_dev_sign | 249 | 854 | 11038 | rev |
| 3391 | 176.C9.sp6:134544 | Wnt_dev_sign | 249 | 854 | 11038 | rev |
| 3656 | 370.G6.sp6:141775 | Wnt_dev_sign | 211 | 785 | 11490 | rev |
| 3836 | 396.C9.sp6:149508 | Wnt_dev_sign | 282 | 1017 | 12318 | rev |
| 4253 | 396.F9.sp6:149544 | Wnt_dev_sign | 482 | 1298 | 11217 | rev |
| 4330 | 122.A2.sp6:132074 | Wnt_dev_sign | 94 | 933 | 12383 | rev |
| 4359 | 123.B2.sp6:132278 | Wnt_dev_sign | 538 | 1435 | 11785 | for |
| 4364 | 123.A1.sp6:132265 | Wnt_dev_sign | 760 | 1544 | 12660 | rev |
| 4375 | 122.G10.sp6:132154 | Wnt_dev_sign | 29 | 884 | 11603 | rev |
| 4385 | 122.A2.sp6:132074 | Wnt_dev_sign | 94 | 933 | 12383 | rev |
| 4409 | 121.F12.sp6:131952 | Wnt_dev_sign | 9 | 734 | 11167 | rev |
| 4441 | 99.F7.sp6:131296 | Wnt_dev_sign | 560 | 1399 | 13749 | rev |
| 4442 | 99.F7.sp6:131296 | Wnt_dev_sign | 560 | 1399 | 13749 | rev |
| 4535 | 395.F10.sp6:149353 | Wnt_dev_sign | 100 | 907 | 11535 | rev |
| 4586 | 123.A4.sp6:132268 | Wnt_dev_sign | 80 | 1122 | 11249 | rev |
| 4605 | 404.D5.sp6:162896 | Wnt_dev_sign | 31 | 816 | 11304 | rev |
| 4653 | 100.D7.sp6:131464 | Wnt_dev_sign | 467 | 1314 | 11882 | rev |
| 4654 | 100.D7.sp6:131464 | Wnt_dev_sign | 467 | 1314 | 11882 | rev |
| 4665 | 177.B11.sp6:134726 | Wnt_dev_sign | 137 | 1266 | 12708 | rev |
| 4668 | 177.B11.sp6:134726 | Wnt_dev_sign | 137 | 1266 | 12708 | rev |
| 4682 | 177.B11.sp6:134726 | Wnt_dev_sign | 137 | 1266 | 12708 | rev |
| 4710 | 367.H9.sp6:141210 | Wnt_dev_sign | 692 | 1481 | 12886 | rev |
| 4718 | 185.D9.sp6:135762 | Wnt_dev_sign | 129 | 890 | 11145 | rev |
| 4724 | 377.D2.sp6:141931 | Wnt_dev_sign | 400 | 1227 | 11044 | rev |
| 4733 | 185.D9.sp6:135762 | Wnt_dev_sign | 129 | 890 | 11145 | rev |
| 4856 | 367.H11.sp6:141212 | Wnt_dev_sign | 295 | 1669 | 13366 | rev |
| 4866 | 377.D4.sp6:141933 | Wnt_dev_sign | 549 | 1380 | 14522 | rev |
| 4925 | 219.B12.sp6:138997 | Wnt_dev_sign | 312 | 1214 | 13188 | rev |
| 4959 | 219.B12.sp6:138997 | Wnt_dev_sign | 312 | 1214 | 13188 | rev |
| 3409 | 172.D1.sp6:133913 | Y_phosphatase | 476 | 804 | 6932 | for |
| 3418 | 123.F9.sp6:132333 | Y_phosphatase | 28 | 439 | 6096 | rev |
| 3419 | 123.F9.sp6:132333 | Y_phosphatase | 28 | 439 | 6096 | rev |
| 3657 | 370.H6.sp6:141787 | Y_phosphatase | 148 | 554 | 6481 | for |
| 3804 | 404.B10.sp6:162877 | Y_phosphatase | 104 | 466 | 6446 | rev |
| 3806 | 404.D10.sp6:162901 | Y_phosphatase | 9 | 614 | 6516 | for |
| 3974 | 395.F2.sp6:149345 | Y_phosphatase | 164 | 645 | 6093 | rev |
| 4238 | 121.E9.sp6:131937 | Y_phosphatase | 240 | 777 | 6147 | rev |
| 4263 | 216.F10.sp6:139235 | Y_phosphatase | 21 | 504 | 6342 | for |
| 4343 | 122.E9.sp6:132129 | Y_phosphatase | 381 | 807 | 6036 | rev |
| 4363 | 123.B1.sp6:132277 | Y_phosphatase | 61 | 510 | 6229 | rev |
| 4434 | 219.F4.sp6:139037 | Y_phosphatase | 2 | 261 | 10353 | for |
| 4473 | 369.B4.sp6:141520 | Y_phosphatase | 231 | 768 | 6110 | rev |
| 4629 | 404.E11.sp6:162914 | Y_phosphatase | 580 | 920 | 6005 | rev |
| 5094 | 217.A3.sp6:139360 | Y_phosphatase | 263 | 622 | 6222 | rev |
| 2738 | 177.A6.sp6:134709 | Zincfing_C2H2 | 65 | 127 | 4380 | for |
| 2760 | 177.A6.sp6:134709 | Zincfing_C2H2 | 65 | 127 | 4380 | for |
| 2832 | 218.B2.sp6:138795 | Zincfing_C2H2 | 94 | 156 | 4940 | for |
| 3736 | 377.H8.sp6:141985 | Zincfing_C2H2 | 495 | 557 | 4850 | for |
| 3762 | 377.G2.sp6:141967 | Zincfing_C2H2 | 52 | 114 | 4380 | for |
| 3763 | 377.G2.sp6:141967 | Zincfing_C2H2 | 52 | 114 | 4380 | for |
| 4794 | 377.G4.sp6:141969 | Zincfing_C2H2 | 247 | 308 | 3930 | for |
| 5090 | 185.C4.sp6:135745 | Zincfing_C2H2 | 238 | 300 | 4540 | for |
| 3774 | 377.E4.sp6:141945 | Zincfing_C3HC4 | 128 | 244 | 9335 | for |
| 4477 | 181.E3.sp6:135322 | Zincfing_C3HC4 | 321 | 445 | 8221 | for |

TABLE 19

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 3 | RTA00000197AF.e.24.1 | 39250 | 2 | 0 | 0 | 0 | 0 | 0 | 0 | 0 |
| 7 | RTA00000197AR.e.12.1 | 22095 | 3 | 0 | 0 | 0 | 0 | 0 | 0 | 0 |
| 16 | RTA00000196AF.e.16.1 | 39252 | 2 | 0 | 0 | 0 | 0 | 0 | 0 | 0 |
| 18 | RTA00000196AF.c.17.1 | 39602 | 2 | 0 | 0 | 0 | 0 | 0 | 0 | 0 |
| 21 | RTA00000131A.g.19.2 | 36535 | 2 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 22 | RTA00000187AR.o.10.2 | 8984 | 4 | 3 | 0 | 0 | 0 | 2 | 0 | 0 |
| 23 | RTA00000198R.b.08.1 | 22636 | 3 | 0 | 0 | 0 | 0 | 0 | 0 | 0 |
| 26 | RTA00000200R.g.09.1 | 22785 | 3 | 0 | 0 | 0 | 0 | 0 | 0 | 0 |
| 29 | RTA00000200AF.b.19.1 | 22847 | 3 | 0 | 0 | 0 | 0 | 0 | 0 | 0 |
| 31 | RTA00000200F.m.15.1 | 22601 | 3 | 0 | 0 | 0 | 1 | 0 | 0 | 0 |
| 37 | RTA00000181AF.n.15.2 | 86128 | 1 | 0 | 0 | 0 | 0 | 0 | 0 | 0 |
| 38 | RTA00000196R.k.07.1 | 22443 | 2 | 0 | 0 | 0 | 0 | 0 | 0 | 1 |
| 40 | RTA00000200AR.e.02.1 | 36059 | 2 | 0 | 0 | 0 | 1 | 1 | 1 | 0 |
| 48 | RTA00000177AR.a.23.5 | 6995 | 4 | 2 | 0 | 0 | 0 | 0 | 0 | 0 |
| 49 | RTA00000198R.o.05.1 | 26702 | 2 | 0 | 0 | 0 | 0 | 0 | 0 | 0 |
| 50 | RTA00000201R.a.02.1 | 35362 | 2 | 0 | 0 | 0 | 0 | 0 | 0 | 0 |
| 61 | RTA00000197AF.h.11.1 | 22264 | 3 | 0 | 0 | 0 | 0 | 0 | 0 | 0 |
| 66 | RTA00000199F.c.09.2 | 16824 | 3 | 1 | 0 | 0 | 0 | 0 | 0 | 0 |
| 75 | RTA00000180AR.h.19.2 | 84182 | 1 | 0 | 0 | 0 | 0 | 0 | 0 | 0 |
| 78 | RTA00000199R.f.09.1 | 22907 | 3 | 0 | 0 | 0 | 0 | 0 | 0 | 0 |
| 79 | RTA00000199AF.p.4.1 | 10282 | 3 | 3 | 0 | 0 | 0 | 0 | 0 | 0 |
| 85 | RTA00000200R.o.03.1 | 22807 | 3 | 0 | 0 | 0 | 0 | 0 | 0 | 0 |
| 86 | RTA00000189AF.l.22.1 | 33333 | 1 | 1 | 0 | 0 | 0 | 0 | 0 | 0 |
| 87 | RTA00000195AF.d.20.1 | 37574 | 2 | 0 | 0 | 0 | 0 | 0 | 0 | 0 |
| 92 | RTA00000198AF.j.18.1 | 22759 | 3 | 0 | 0 | 0 | 0 | 0 | 0 | 0 |
| 95 | RTA00000180AF.g.3.1 | 9024 | 5 | 2 | 0 | 0 | 0 | 0 | 0 | 0 |
| 102 | RTA00000199R.j.08.1 | 37844 | 2 | 0 | 0 | 0 | 0 | 0 | 0 | 0 |
| 103 | RTA00000199F.e.10.1 | 22906 | 3 | 0 | 0 | 0 | 0 | 0 | 1 | 0 |
| 105 | RTA00000179AF.g.12.3 | 36390 | 2 | 0 | 0 | 0 | 0 | 0 | 0 | 0 |
| 108 | RTA00000183AR.h.23.2 | 18957 | 3 | 0 | 0 | 0 | 0 | 0 | 0 | 0 |
| 109 | RTA00000197AF.d.12.1 | 39546 | 2 | 0 | 0 | 0 | 0 | 0 | 0 | 0 |
| 116 | RTA00000181AR.k.24.3 | 7005 | 8 | 2 | 0 | 0 | 0 | 0 | 0 | 0 |
| 119 | RTA00000181AR.k.24.2 | 7005 | 8 | 2 | 0 | 0 | 0 | 0 | 0 | 0 |
| 124 | RTA00000199AR.m.06.1 | 19122 | 3 | 0 | 0 | 0 | 0 | 0 | 0 | 0 |
| 129 | RTA00000134A.d.10.1 | 18957 | 3 | 0 | 0 | 0 | 0 | 0 | 0 | 0 |
| 137 | RTA00000181AF.m.4.3 | 13238 | 4 | 1 | 0 | 0 | 0 | 0 | 0 | 0 |
| 141 | RTA00000196AF.c.6.1 | 23148 | 3 | 0 | 0 | 0 | 0 | 0 | 0 | 0 |
| 142 | RTA00000198AF.k.19.1 | 75879 | 1 | 0 | 0 | 0 | 0 | 0 | 0 | 0 |
| 143 | RTA00000199R.h.09.1 | 76020 | 1 | 0 | 0 | 0 | 0 | 0 | 0 | 0 |
| 144 | RTA00000198AF.o.18.1 | 13018 | 4 | 0 | 0 | 0 | 1 | 0 | 0 | 0 |
| 148 | RTA00000199F.h.17.2 | 36254 | 2 | 0 | 0 | 0 | 0 | 0 | 0 | 0 |
| 149 | RTA00000181AR.h.06.3 | 87226 | 1 | 0 | 0 | 0 | 0 | 0 | 0 | 0 |
| 166 | RTA00000198AF.f.21.1 | 22676 | 3 | 0 | 0 | 0 | 0 | 0 | 0 | 0 |
| 173 | RTA00000200AR.b.07.1 | 17125 | 4 | 0 | 0 | 0 | 0 | 0 | 0 | 0 |
| 178 | RTA00000200F.o.03.1 | 22807 | 3 | 0 | 0 | 0 | 0 | 0 | 0 | 0 |
| 180 | RTA00000199AF.j.12.1 | 22461 | 3 | 0 | 0 | 0 | 0 | 0 | 0 | 0 |
| 185 | RTA00000195AF.d.4.1 | 22766 | 3 | 0 | 0 | 0 | 0 | 0 | 0 | 0 |
| 194 | RTA00000200R.k.01.1 | 40049 | 2 | 0 | 0 | 0 | 0 | 0 | 0 | 0 |
| 195 | RTA00000198AF.c.10.1 | 77149 | 1 | 0 | 0 | 0 | 0 | 0 | 0 | 0 |
| 198 | RTA00000197AR.e.07.1 | 86969 | 1 | 0 | 0 | 0 | 0 | 0 | 0 | 0 |
| 199 | RTA00000199R.c.09.1 | 16824 | 3 | 1 | 0 | 0 | 0 | 0 | 0 | 0 |
| 206 | RTA00000181AF.o.04.2 | 22205 | 3 | 0 | 0 | 0 | 0 | 0 | 0 | 0 |
| 207 | RTA00000199AF.l.19.1 | 22460 | 3 | 0 | 0 | 0 | 0 | 0 | 0 | 0 |
| 208 | RTA00000198AF.h.22.1 | 22366 | 2 | 1 | 0 | 0 | 0 | 0 | 0 | 0 |
| 211 | RTA00000199AF.m.15.1 | 10101 | 3 | 0 | 0 | 0 | 0 | 0 | 0 | 0 |
| 212 | RTA00000197AF.j.9.1 | 13236 | 4 | 1 | 0 | 0 | 0 | 0 | 0 | 0 |
| 230 | RTA00000185AR.b.18.1 | 12171 | 3 | 2 | 0 | 0 | 0 | 0 | 0 | 0 |
| 235 | RTA00000201AF.a.02.1 | 35362 | 2 | 0 | 0 | 0 | 0 | 0 | 0 | 0 |
| 236 | RTA00000183AR.h.23.1 | 18957 | 3 | 0 | 0 | 0 | 0 | 0 | 0 | 0 |
| 238 | RTA00000187AR.k.12.1 | 78415 | 1 | 0 | 0 | 0 | 0 | 0 | 0 | 0 |
| 242 | RTA00000198AF.m.17.1 | 77992 | 1 | 0 | 0 | 0 | 0 | 0 | 0 | 0 |
| 243 | RTA00000181AF.m.15.3 | 12081 | 4 | 0 | 0 | 0 | 0 | 0 | 0 | 0 |
| 248 | RTA00000198R.c.14.1 | 39814 | 2 | 0 | 0 | 0 | 0 | 0 | 0 | 0 |
| 249 | RTA00000200R.o.03.2 | 22807 | 3 | 0 | 0 | 0 | 0 | 0 | 0 | 0 |
| 251 | RTA00000192AF.n.13.1 | 8210 | 2 | 6 | 0 | 0 | 0 | 0 | 0 | 0 |
| 256 | RTA00000184AR.e.15.1 | 16347 | 4 | 0 | 0 | 0 | 0 | 0 | 0 | 0 |
| 260 | RTA00000198R.m.17.1 | 77992 | 1 | 0 | 0 | 0 | 0 | 0 | 0 | 0 |
| 270 | RTA00000178R.l.08.1 | 39648 | 2 | 0 | 0 | 0 | 0 | 0 | 0 | 0 |
| 278 | RTA00000198AF.p.16.1 | 71877 | 1 | 0 | 0 | 0 | 0 | 0 | 0 | 0 |
| 280 | RTA00000193AF.b.18.1 | 7542 | 8 | 0 | 0 | 2 | 1 | 0 | 1 | 0 |
| 284 | RTA00000199F.d.10.2 | 22049 | 3 | 0 | 0 | 0 | 0 | 0 | 0 | 0 |
| 287 | RTA00000200AF.b.07.1 | 17125 | 4 | 0 | 0 | 0 | 0 | 0 | 0 | 0 |
| 288 | RTA00000181AR.i.06.3 | 19119 | 3 | 0 | 0 | 0 | 0 | 0 | 0 | 0 |
| 289 | RTA00000196F.k.07.1 | 22443 | 2 | 0 | 0 | 0 | 0 | 0 | 0 | 1 |
| 294 | RTA00000198AF.k.23.1 | 8995 | 2 | 5 | 0 | 0 | 0 | 0 | 0 | 0 |
| 296 | RTA00000196AF.f.20.1 | 22774 | 3 | 0 | 0 | 0 | 0 | 0 | 0 | 0 |
| 300 | RTA00000195AF.c.12.1 | 37582 | 2 | 0 | 0 | 0 | 0 | 0 | 0 | 0 |
| 302 | RTA00000186AF.d.1.2 | 40044 | 2 | 0 | 0 | 1 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 307 | RTA00000200F.n.05.2 | 18989 | 3 | 0 | 0 | 0 | 0 | 0 | 0 | 0 |
| 308 | RTA00000178AF.j.20.1 | 15066 | 4 | 0 | 0 | 0 | 0 | 0 | 0 | 0 |
| 310 | RTA00000188AF.m.08.1 | 22155 | 3 | 0 | 0 | 0 | 0 | 0 | 0 | 0 |
| 315 | RTA00000199R.d.23.1 | 37477 | 2 | 0 | 0 | 0 | 0 | 0 | 0 | 0 |
| 319 | RTA00000200F.n.05.1 | 18989 | 3 | 0 | 0 | 0 | 0 | 0 | 0 | 0 |
| 320 | RTA00000196AF.m.13.1 | 16290 | 4 | 0 | 0 | 0 | 0 | 0 | 0 | 0 |
| 325 | RTA00000182AF.d.18.4 | 37435 | 2 | 0 | 0 | 0 | 0 | 0 | 0 | 0 |
| 328 | RTA00000200AF.g.09.1 | 22785 | 3 | 0 | 0 | 0 | 0 | 0 | 0 | 0 |
| 330 | RTA00000177AR.m.17.4 | 14391 | 3 | 1 | 0 | 0 | 0 | 0 | 0 | 0 |
| 331 | RTA00000197AR.c.20.1 | 16282 | 4 | 0 | 0 | 0 | 0 | 0 | 0 | 0 |
| 337 | RTA00000177AR.m.17.3 | 14391 | 3 | 1 | 0 | 0 | 0 | 0 | 0 | 0 |
| 342 | RTA00000196AF.d.10.1 | 22256 | 3 | 0 | 0 | 0 | 0 | 0 | 0 | 0 |
| 343 | RTA00000201F.a.18.1 | 16837 | 2 | 2 | 0 | 0 | 0 | 0 | 0 | 0 |
| 344 | RTA00000198AF.o.02.1 | 68756 | 1 | 0 | 0 | 0 | 0 | 0 | 0 | 0 |
| 345 | RTA00000187AF.h.21.1 | 39171 | 2 | 0 | 0 | 0 | 0 | 0 | 0 | 0 |
| 347 | RTA00000199F.b.03.2 | 38340 | 2 | 0 | 0 | 0 | 0 | 0 | 0 | 0 |
| 358 | RTA00000198AF.g.7.1 | 13386 | 3 | 2 | 0 | 0 | 0 | 0 | 0 | 0 |
| 362 | RTA00000197AR.c.24.1 | 82498 | 1 | 0 | 0 | 0 | 0 | 0 | 0 | 0 |
| 371 | RTA00000197F.e.7.1 | 86969 | 1 | 0 | 0 | 0 | 0 | 0 | 0 | 0 |
| 378 | RTA00000181AF.k.24.3 | 7005 | 8 | 2 | 0 | 0 | 0 | 0 | 0 | 0 |
| 382 | RTA00000200AF.j.6.1 | 22902 | 3 | 0 | 0 | 0 | 0 | 0 | 0 | 0 |
| 384 | RTA00000196AF.h.17.1 | 39215 | 2 | 0 | 0 | 0 | 0 | 0 | 0 | 0 |
| 392 | RTA00000185AF.b.11.2 | 9024 | 5 | 2 | 0 | 0 | 0 | 0 | 0 | 0 |
| 397 | RTA00000198AF.b.22.1 | 38956 | 2 | 0 | 0 | 0 | 0 | 0 | 0 | 0 |
| 399 | RTA00000186AF.m.15.2 | 40122 | 2 | 0 | 0 | 0 | 0 | 0 | 0 | 0 |
| 406 | RTA00000199F.f.09.2 | 22907 | 3 | 0 | 0 | 0 | 0 | 0 | 0 | 0 |
| 408 | RTA00000183AR.l.15.1 | 39383 | 2 | 0 | 0 | 0 | 0 | 0 | 0 | 0 |
| 413 | RTA00000200F.a.12.1 | 16751 | 4 | 0 | 0 | 0 | 0 | 0 | 0 | 0 |
| 416 | RTA00000199F.a.5.1 | 22134 | 3 | 0 | 0 | 0 | 0 | 0 | 0 | 0 |
| 418 | RTA00000187AR.k.01.1 | 78356 | 1 | 0 | 0 | 0 | 0 | 0 | 0 | 0 |
| 424 | RTA00000187AR.j.24.1 | 78356 | 1 | 0 | 0 | 0 | 0 | 0 | 0 | 0 |
| 426 | RTA00000199AF.o.19.1 | 36927 | 2 | 0 | 0 | 0 | 0 | 0 | 0 | 0 |
| 429 | RTA00000196F.i.19.1 | 39498 | 2 | 0 | 0 | 0 | 0 | 0 | 0 | 0 |
| 430 | RTA00000198R.k.23.1 | 8995 | 2 | 5 | 0 | 0 | 0 | 0 | 0 | 0 |
| 432 | RTA00000198AF.o.05.1 | 26702 | 2 | 0 | 0 | 0 | 0 | 0 | 0 | 0 |
| 433 | RTA00000198R.j.18.1 | 22759 | 3 | 0 | 0 | 0 | 0 | 0 | 0 | 0 |
| 435 | RTA00000182AR.c.22.1 | 16283 | 3 | 0 | 0 | 0 | 0 | 0 | 0 | 0 |
| 438 | RTA00000180AR.g.03.4 | 9024 | 5 | 2 | 0 | 0 | 0 | 0 | 0 | 0 |
| 451 | RTA00000200AF.b.20.1 | 40403 | 2 | 0 | 0 | 0 | 0 | 0 | 0 | 0 |
| 455 | RTA00000198AF.d.12.1 | 21142 | 2 | 1 | 0 | 0 | 0 | 0 | 0 | 0 |
| 456 | RTA00000200AF.b.12.1 | 22053 | 3 | 0 | 0 | 0 | 0 | 0 | 0 | 0 |
| 457 | RTA00000191AR.l.7.2 | 14391 | 3 | 1 | 0 | 0 | 0 | 0 | 0 | 0 |
| 461 | RTA00000190AF.e.13.1 | 38961 | 2 | 0 | 0 | 0 | 0 | 0 | 0 | 0 |
| 462 | RTA00000196AF.n.17.1 | 12477 | 4 | 1 | 0 | 0 | 0 | 0 | 0 | 0 |
| 467 | RTA00000195AF.b.19.1 | 77678 | 1 | 0 | 0 | 0 | 0 | 0 | 0 | 0 |
| 475 | RTA00000187AR.m.3.3 | 17055 | 4 | 0 | 0 | 0 | 0 | 0 | 0 | 0 |
| 476 | RTA00000200R.g.15.1 | 22898 | 3 | 0 | 0 | 0 | 0 | 0 | 0 | 0 |
| 482 | RTA00000187AF.j.7.1 | 78091 | 1 | 0 | 0 | 0 | 0 | 0 | 0 | 0 |
| 485 | RTA00000196AF.c.14.1 | 23105 | 3 | 0 | 0 | 0 | 0 | 0 | 0 | 0 |
| 486 | RTA00000190AR.p.22.2 | 16368 | 4 | 0 | 0 | 0 | 0 | 0 | 0 | 0 |
| 492 | RTA00000198AF.b.8.1 | 22636 | 3 | 0 | 0 | 0 | 0 | 0 | 0 | 0 |
| 493 | RTA00000177AF.m.17.1 | 14391 | 3 | 1 | 0 | 0 | 0 | 0 | 0 | 0 |
| 494 | RTA00000200AF.k.1.1 | 40049 | 2 | 0 | 0 | 0 | 0 | 0 | 0 | 0 |
| 498 | RTA00000190AF.h.12.1 | 12977 | 5 | 0 | 0 | 0 | 0 | 0 | 0 | 0 |
| 499 | RTA00000199F.b.22.2 | 17018 | 4 | 0 | 0 | 0 | 0 | 0 | 0 | 0 |
| 508 | RTA00000187AF.i.14.2 | 19406 | 2 | 1 | 0 | 0 | 0 | 0 | 0 | 0 |
| 511 | RTA00000196AF.g.10.1 | 12498 | 3 | 1 | 1 | 0 | 0 | 0 | 0 | 0 |
| 517 | RTA00000184AF.e.14.1 | 16347 | 4 | 0 | 0 | 0 | 0 | 0 | 0 | 0 |
| 522 | RTA00000178AR.h.17.2 | 23824 | 2 | 1 | 0 | 0 | 0 | 0 | 0 | 0 |
| 531 | RTA00000195F.a.3.1 | 27179 | 2 | 0 | 0 | 0 | 0 | 0 | 0 | 0 |
| 544 | RTA00000196F.j.13.1 | 23170 | 3 | 0 | 0 | 0 | 0 | 0 | 0 | 0 |
| 547 | RTA00000196AF.g.8.1 | 39665 | 2 | 0 | 0 | 0 | 0 | 0 | 0 | 0 |
| 549 | RTA00000198AF.c.16.1 | 26801 | 2 | 0 | 0 | 0 | 0 | 0 | 0 | 0 |
| 553 | RTA00000201F.b.22.1 | 35728 | 2 | 0 | 0 | 0 | 0 | 0 | 0 | 1 |
| 559 | RTA00000197AF.p.20.1 | 22795 | 3 | 0 | 0 | 0 | 0 | 0 | 0 | 0 |
| 563 | RTA00000192AR.o.16.2 | 9061 | 5 | 2 | 0 | 0 | 0 | 0 | 0 | 0 |
| 565 | RTA00000191AF.c.10.1 | 40422 | 2 | 0 | 0 | 0 | 0 | 0 | 0 | 0 |
| 568 | RTA00000196AF.p.01.2 | 87143 | 1 | 0 | 0 | 0 | 0 | 0 | 0 | 0 |
| 578 | RTA00000180AF.g.17.1 | 16653 | 3 | 1 | 0 | 0 | 0 | 0 | 0 | 0 |
| 583 | RTA00000190AR.h.12.2 | 12977 | 5 | 0 | 0 | 0 | 0 | 0 | 0 | 0 |
| 585 | RTA00000198AF.n.18.1 | 16715 | 3 | 1 | 0 | 0 | 0 | 0 | 0 | 0 |
| 586 | RTA00000199R.o.11.1 | 23172 | 3 | 0 | 0 | 0 | 0 | 0 | 0 | 0 |
| 588 | RTA00000191AF.b.4.1 | 14936 | 3 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 589 | RTA00000192AF.l.1.1 | 16392 | 3 | 0 | 0 | 0 | 0 | 0 | 0 | 0 |
| 593 | RTA00000196R.c.14.2 | 23105 | 3 | 0 | 0 | 0 | 0 | 0 | 0 | 0 |
| 595 | RTA00000195R.a.06.1 | 35265 | 2 | 0 | 1 | 0 | 0 | 0 | 0 | 0 |
| 602 | RTA00000195AF.b.21.1 | 39055 | 2 | 0 | 0 | 0 | 0 | 0 | 0 | 0 |
| 612 | RTA00000197AR.e.22.1 | 78758 | 1 | 0 | 0 | 0 | 0 | 0 | 0 | 0 |
| 615 | RTA00000197R.p.20.1 | 22795 | 3 | 0 | 0 | 0 | 0 | 0 | 0 | 0 |
| 618 | RTA00000192AF.a.14.1 | 6874 | 6 | 3 | 0 | 0 | 1 | 0 | 0 | 0 |
| 623 | RTA00000198R.b.24.1 | 19047 | 3 | 0 | 0 | 0 | 0 | 0 | 0 | 0 |
| 627 | RTA00000199F.h.15.2 | 22269 | 3 | 0 | 0 | 0 | 0 | 0 | 0 | 0 |
| 628 | RTA00000198AF.g.16.1 | 6602 | 1 | 1 | 0 | 0 | 0 | 0 | 0 | 0 |
| 634 | RTA00000192AF.j.6.1 | 11494 | 4 | 0 | 0 | 0 | 0 | 0 | 0 | 0 |
| 635 | RTA00000181AF.p.7.3 | 38773 | 2 | 0 | 0 | 0 | 0 | 0 | 0 | 0 |
| 637 | RTA00000200AF.g.15.1 | 22898 | 3 | 0 | 0 | 0 | 0 | 0 | 0 | 0 |
| 643 | RTA00000184AF.c.9.1 | 16245 | 4 | 0 | 0 | 0 | 0 | 0 | 0 | 0 |
| 645 | RTA00000177AF.k.9.1 | 16245 | 4 | 0 | 0 | 0 | 0 | 0 | 0 | 0 |
| 649 | RTA00000190AR.l.19.2 | 88204 | 1 | 0 | 0 | 0 | 0 | 0 | 0 | 0 |
| 662 | RTA00000201R.a.15.1 | 57347 | 1 | 0 | 0 | 0 | 0 | 0 | 0 | 0 |
| 664 | RTA00000195R.a.23.1 | 86432 | 1 | 0 | 0 | 0 | 0 | 0 | 0 | 0 |
| 670 | RTA00000186AF.p.17.3 | 38383 | 2 | 0 | 0 | 0 | 0 | 0 | 0 | 0 |
| 674 | RTA00000197AR.e.24.1 | 39250 | 2 | 0 | 0 | 0 | 0 | 0 | 0 | 0 |
| 683 | RTA00000187AR.j.01.1 | 79028 | 1 | 0 | 0 | 0 | 0 | 0 | 0 | 0 |
| 686 | RTA00000201F.f.07.1 | 51116 | 1 | 0 | 0 | 0 | 0 | 0 | 0 | 0 |
| 694 | RTA00000201R.c.19.1 | 22357 | 2 | 1 | 0 | 0 | 0 | 0 | 0 | 0 |
| 702 | RTA00000177AR.b.8.5 | 17062 | 3 | 0 | 0 | 0 | 0 | 0 | 0 | 0 |
| 712 | RTA00000201F.b.21.1 | 9071 | 3 | 4 | 0 | 0 | 0 | 0 | 0 | 0 |
| 717 | RTA00000200F.o.10.2 | 36432 | 2 | 0 | 0 | 0 | 0 | 0 | 0 | 0 |
| 718 | RTA00000196F.l.14.2 | 23144 | 3 | 0 | 0 | 0 | 0 | 0 | 0 | 0 |
| 725 | RTA00000197AF.b.1.1 | 12134 | 1 | 1 | 0 | 0 | 0 | 0 | 0 | 0 |
| 733 | RTA00000200AF.d.20.1 | 26600 | 2 | 0 | 0 | 0 | 0 | 0 | 0 | 0 |
| 743 | RTA00000178AF.k.9.1 | 16342 | 3 | 0 | 0 | 0 | 0 | 0 | 0 | 0 |
| 748 | RTA00000198AF.b.24.1 | 19047 | 3 | 0 | 0 | 0 | 0 | 0 | 0 | 0 |
| 757 | RTA00000406F.d.16.1 | 15040 | 2 | 2 | 0 | 0 | 0 | 0 | 0 | 0 |
| 760 | RTA00000408F.o.12.2 | 78578 | 1 | 0 | 0 | 0 | 0 | 0 | 0 | 0 |
| 761 | RTA00000119A.j.15.1 | 79623 | 1 | 0 | 0 | 0 | 0 | 0 | 0 | 0 |
| 762 | RTA00000413F.d.12.1 | 66467 | 1 | 0 | 0 | 0 | 0 | 0 | 0 | 0 |
| 763 | RTA00000423F.i.12.1 | 9118 | 4 | 3 | 0 | 0 | 0 | 0 | 0 | 0 |
| 766 | RTA00000411F.k.05.1 | 64777 | 1 | 0 | 0 | 0 | 0 | 0 | 0 | 0 |
| 769 | RTA00000419F.b.09.1 | 78128 | 1 | 0 | 0 | 0 | 0 | 0 | 0 | 0 |
| 772 | RTA00000411F.m.15.1 | 78014 | 1 | 0 | 0 | 0 | 0 | 0 | 0 | 0 |
| 774 | RTA00000123A.k.23.1 | 80313 | 1 | 0 | 0 | 0 | 0 | 0 | 0 | 0 |
| 777 | RTA00000130A.m.15.1 | 81630 | 1 | 0 | 0 | 0 | 0 | 0 | 0 | 0 |
| 778 | RTA00000411F.k20.1 | 64973 | 1 | 0 | 0 | 0 | 0 | 0 | 0 | 0 |
| 780 | RTA00000418F.k.05.1 | 73021 | 1 | 0 | 0 | 0 | 0 | 0 | 0 | 0 |
| 781 | RTA00000423F.h.18.1 | 37972 | 2 | 0 | 0 | 0 | 0 | 0 | 0 | 0 |
| 783 | RTA00000422F.p.06.2 | 39282 | 2 | 0 | 0 | 0 | 0 | 0 | 0 | 0 |
| 784 | RTA00000404F.n.16.2 | 39095 | 2 | 0 | 0 | 0 | 0 | 0 | 0 | 0 |
| 785 | RTA00000411F.m.24.1 | 77568 | 1 | 0 | 0 | 0 | 0 | 0 | 0 | 0 |
| 786 | RTA00000134A.j.10.1 | 81383 | 1 | 0 | 0 | 0 | 0 | 0 | 0 | 0 |
| 787 | RTA00000409F.j.02.1 | 76417 | 1 | 0 | 0 | 0 | 0 | 0 | 0 | 0 |
| 788 | RTA00000403F.j.15.1 | 23840 | 2 | 1 | 0 | 0 | 0 | 0 | 0 | 0 |
| 789 | RTA00000411F.n.11.1 | 77276 | 1 | 0 | 0 | 0 | 0 | 0 | 0 | 0 |
| 790 | RTA00000339F.i.13.1 | 5970 | 6 | 4 | 0 | 0 | 0 | 0 | 0 | 0 |
| 792 | RTA00000406F.o.15.1 | 37482 | 2 | 0 | 0 | 0 | 0 | 0 | 0 | 0 |
| 793 | RTA00000412F.g.04.2 | 64457 | 1 | 0 | 0 | 0 | 0 | 0 | 0 | 0 |
| 795 | RTA00000352R.l.06.1 | 40343 | 2 | 0 | 0 | 0 | 0 | 0 | 0 | 0 |
| 796 | RTA00000419F.b.12.1 | 63148 | 1 | 0 | 0 | 0 | 0 | 0 | 0 | 0 |
| 797 | RTA00000423F.k.17.2 | 37512 | 2 | 0 | 0 | 0 | 0 | 0 | 0 | 0 |
| 799 | RTA00000418F.k.14.1 | 76133 | 1 | 0 | 0 | 0 | 0 | 1 | 0 | 0 |
| 800 | RTA00000409F.l.12.1 | 26755 | 1 | 0 | 0 | 0 | 0 | 0 | 0 | 0 |
| 801 | RTA00000404F.c.20.1 | 39088 | 2 | 0 | 0 | 0 | 0 | 0 | 1 | 0 |
| 802 | RTA00000423F.g.09.1 | 38958 | 2 | 0 | 0 | 0 | 0 | 0 | 0 | 0 |
| 804 | RTA00000406F.d.12.1 | 38575 | 2 | 0 | 0 | 0 | 0 | 0 | 0 | 0 |
| 805 | RTA00000411F.f.02.1 | 63386 | 1 | 0 | 0 | 0 | 0 | 0 | 0 | 0 |
| 806 | RTA00000129A.n.21.1 | 79381 | 1 | 0 | 0 | 0 | 0 | 0 | 0 | 0 |
| 807 | RTA00000409F.m.12.1 | 73490 | 1 | 0 | 0 | 0 | 0 | 0 | 0 | 0 |
| 808 | RTA00000410F.c.04.1 | 74099 | 1 | 0 | 0 | 0 | 0 | 0 | 0 | 0 |
| 810 | RTA00000406F.m.09.1 | 26891 | 2 | 0 | 0 | 0 | 0 | 0 | 0 | 0 |
| 811 | RTA00000411F.b.06.1 | 77884 | 1 | 0 | 0 | 0 | 0 | 0 | 0 | 0 |
| 812 | RTA00000409F.l.21.1 | 73143 | 1 | 0 | 0 | 0 | 0 | 0 | 0 | 0 |
| 818 | RTA00000404F.l.20.2 | 38638 | 2 | 0 | 0 | 0 | 0 | 0 | 0 | 0 |
| 819 | RTA00000413F.d.18.1 | 65305 | 1 | 0 | 0 | 0 | 0 | 0 | 0 | 0 |
| 820 | RTA00000404F.p.04.2 | 39069 | 2 | 0 | 0 | 0 | 0 | 0 | 0 | 0 |
| 821 | RTA00000405F.g.19.2 | 37150 | 2 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 822 | RTA00000409F.a.22.1 | 75200 | 1 | 0 | 0 | 0 | 0 | 0 | 0 | 0 |
| 824 | RTA00000405F.o.18.1 | 11016 | 4 | 2 | 0 | 0 | 0 | 0 | 0 | 0 |
| 829 | RTA00000408F.e.22.2 | 26930 | 1 | 0 | 0 | 0 | 0 | 0 | 0 | 0 |
| 831 | RTA00000413F.d.16.1 | 63331 | 1 | 0 | 0 | 0 | 0 | 0 | 0 | 0 |
| 834 | RTA00000419F.g.08.1 | 66700 | 1 | 0 | 0 | 0 | 0 | 0 | 0 | 0 |
| 835 | RTA00000122A.g.16.1 | 81366 | 1 | 0 | 0 | 0 | 0 | 0 | 0 | 0 |
| 836 | RTA00000419F.c.16.1 | 65254 | 1 | 0 | 0 | 0 | 0 | 0 | 0 | 0 |
| 837 | RTA00000411F.b.03.1 | 23634 | 1 | 2 | 0 | 0 | 0 | 0 | 0 | 0 |
| 842 | RTA00000403F.l.20.1 | 18267 | 1 | 0 | 0 | 0 | 0 | 0 | 0 | 0 |
| 845 | RTA00000411F.a.02.1 | 78537 | 1 | 0 | 0 | 0 | 0 | 0 | 0 | 0 |
| 847 | RTA00000412F.l.04.1 | 66372 | 1 | 0 | 0 | 0 | 0 | 0 | 0 | 0 |
| 849 | RTA00000406F.a.23.1 | 38712 | 2 | 0 | 0 | 0 | 0 | 0 | 0 | 0 |
| 851 | RTA00000120A.n.19.3 | 80004 | 1 | 0 | 0 | 0 | 0 | 0 | 0 | 0 |
| 852 | RTA00000403F.e.01.1 | 38965 | 2 | 0 | 0 | 0 | 0 | 0 | 0 | 0 |
| 853 | RTA00000411F.l.03.1 | 62702 | 1 | 0 | 0 | 0 | 0 | 0 | 0 | 0 |
| 856 | RTA00000121A.m.2.1 | 81064 | 1 | 0 | 0 | 0 | 0 | 0 | 0 | 0 |
| 858 | RTA00000418F.j.12.1 | 73316 | 1 | 0 | 0 | 0 | 0 | 0 | 0 | 0 |
| 862 | RTA00000125A.g.16.1 | 21497 | 2 | 1 | 0 | 0 | 0 | 0 | 0 | 0 |
| 863 | RTA00000418F.o.18.1 | 78676 | 1 | 0 | 0 | 0 | 0 | 0 | 0 | 0 |
| 865 | RTA00000408F.k.14.1 | 73856 | 1 | 0 | 0 | 0 | 0 | 0 | 0 | 0 |
| 871 | RTA00000403F.o.15.1 | 39140 | 2 | 0 | 0 | 0 | 0 | 0 | 0 | 0 |
| 872 | RTA00000341F.m.13.1 | 26502 | 1 | 0 | 0 | 0 | 0 | 0 | 0 | 0 |
| 873 | RTA00000408F.h.03.1 | 78382 | 1 | 0 | 0 | 0 | 0 | 0 | 0 | 0 |
| 874 | RTA00000423F.k.05.1 | 37472 | 2 | 0 | 0 | 0 | 0 | 0 | 0 | 0 |
| 876 | RTA00000418F.p.19.1 | 78544 | 1 | 0 | 0 | 0 | 0 | 0 | 0 | 0 |
| 877 | RTA00000420F.f.06.1 | 64812 | 1 | 0 | 0 | 0 | 0 | 0 | 0 | 0 |
| 878 | RTA00000122A.j.18.1 | 81317 | 1 | 0 | 0 | 0 | 0 | 0 | 0 | 0 |
| 879 | RTA00000420F.d.05.1 | 64432 | 1 | 0 | 0 | 0 | 0 | 0 | 0 | 0 |
| 880 | RTA00000403F.m.18.1 | 39185 | 2 | 0 | 0 | 0 | 0 | 0 | 0 | 0 |
| 882 | RTA00000411F.j.05.1 | 40709 | 1 | 1 | 0 | 0 | 0 | 0 | 0 | 0 |
| 883 | RTA00000403F.a.04.1 | 23529 | 2 | 1 | 0 | 0 | 0 | 0 | 0 | 0 |
| 885 | RTA00000406F.f.12.1 | 21895 | 2 | 1 | 0 | 0 | 0 | 0 | 0 | 0 |
| 886 | RTA00000418F.g.22.1 | 74837 | 1 | 0 | 0 | 0 | 0 | 0 | 0 | 0 |
| 888 | RTA00000404F.l.20.1 | 38638 | 2 | 0 | 0 | 0 | 0 | 0 | 0 | 0 |
| 889 | RTA00000408F.i.08.2 | 75811 | 1 | 0 | 0 | 0 | 0 | 0 | 0 | 0 |
| 890 | RTA00000122A.d.5.1 | 81155 | 1 | 0 | 0 | 0 | 0 | 0 | 0 | 0 |
| 894 | RTA00000419F.b.19.1 | 65534 | 1 | 0 | 0 | 0 | 0 | 0 | 0 | 0 |
| 896 | RTA00000418F.k.19.1 | 74932 | 1 | 0 | 0 | 0 | 0 | 0 | 0 | 0 |
| 900 | RTA00000419F.g.12.1 | 66171 | 1 | 0 | 0 | 0 | 0 | 0 | 0 | 0 |
| 901 | RTA00000404F.n.11.2 | 38001 | 2 | 0 | 0 | 0 | 0 | 0 | 0 | 0 |
| 904 | RTA00000419F.o.24.1 | 65092 | 1 | 0 | 0 | 0 | 0 | 0 | 0 | 0 |
| 905 | RTA00000419F.k.19.1 | 75447 | 1 | 0 | 0 | 0 | 0 | 0 | 0 | 0 |
| 907 | RTA00000127A.i.20.1 | 81418 | 1 | 0 | 0 | 0 | 0 | 0 | 0 | 0 |
| 908 | RTA00000422F.g.22.1 | 22561 | 3 | 0 | 0 | 0 | 0 | 0 | 0 | 0 |
| 910 | RTA00000413F.h.13.1 | 65190 | 1 | 0 | 0 | 0 | 0 | 0 | 0 | 0 |
| 913 | RTA00000348R.j.16.1 | 7005 | 8 | 2 | 0 | 0 | 0 | 0 | 0 | 0 |
| 916 | RTA00000418F.n.22.1 | 79062 | 1 | 0 | 0 | 0 | 0 | 0 | 0 | 0 |
| 917 | RTA00000406F.l.08.1 | 39016 | 2 | 0 | 0 | 0 | 0 | 0 | 0 | 0 |
| 920 | RTA00000409F.j.07.1 | 75190 | 1 | 0 | 0 | 0 | 0 | 0 | 0 | 0 |
| 923 | RTA00000411F.e.22.1 | 63638 | 1 | 0 | 0 | 0 | 0 | 0 | 0 | 0 |
| 924 | RTA00000347F.a.17.1 | 16723 | 3 | 1 | 0 | 0 | 0 | 0 | 0 | 0 |
| 926 | RTA00000404F.n.20.1 | 26865 | 2 | 0 | 0 | 0 | 0 | 0 | 0 | 0 |
| 929 | RTA00000404F.b.02.1 | 38984 | 2 | 0 | 0 | 0 | 0 | 0 | 0 | 0 |
| 931 | RTA00000403F.b.10.1 | 73268 | 1 | 0 | 0 | 0 | 0 | 0 | 0 | 0 |
| 932 | RTA00000406F.i.12.1 | 39080 | 2 | 0 | 0 | 0 | 0 | 0 | 0 | 0 |
| 933 | RTA00000406F.h.08.1 | 16228 | 2 | 2 | 0 | 0 | 0 | 0 | 0 | 0 |
| 934 | RTA00000418F.i.19.1 | 79180 | 1 | 0 | 0 | 0 | 0 | 0 | 0 | 0 |
| 936 | RTA00000412F.h.21.1 | 64348 | 1 | 0 | 0 | 0 | 0 | 0 | 0 | 0 |
| 938 | RTA00000120A.g.18.1 | 81255 | 1 | 0 | 0 | 0 | 0 | 0 | 0 | 0 |
| 940 | RTA00000423F.j.05.1 | 37958 | 2 | 0 | 0 | 0 | 0 | 0 | 0 | 0 |
| 941 | RTA00000132A.k.6.1 | 81284 | 1 | 0 | 0 | 0 | 0 | 0 | 0 | 0 |
| 943 | RTA00000406F.p.04.1 | 37458 | 2 | 0 | 0 | 0 | 0 | 0 | 0 | 0 |
| 944 | RTA00000347F.a.13.1 | 22446 | 3 | 0 | 0 | 0 | 0 | 0 | 0 | 0 |
| 945 | RTA00000419F.p.23.1 | 64748 | 1 | 0 | 0 | 0 | 0 | 0 | 0 | 0 |
| 946 | RTA00000419F.d.17.1 | 64353 | 1 | 0 | 0 | 0 | 0 | 0 | 0 | 0 |
| 949 | RTA00000124A.k.5.1 | 80252 | 1 | 0 | 0 | 0 | 0 | 0 | 0 | 0 |
| 950 | RTA00000404F.h.22.1 | 18735 | 2 | 1 | 0 | 0 | 0 | 0 | 1 | 0 |
| 952 | RTA00000410F.o.05.1 | 75262 | 1 | 0 | 0 | 0 | 0 | 0 | 0 | 0 |
| 953 | RTA00000339R.l.14.1 | 19119 | 3 | 0 | 0 | 0 | 0 | 0 | 0 | 0 |
| 954 | RTA00000403F.m.13.2 | 39077 | 2 | 0 | 0 | 0 | 0 | 0 | 0 | 0 |
| 957 | RTA00000419F.g.22.1 | 64515 | 1 | 0 | 0 | 0 | 0 | 0 | 0 | 0 |
| 958 | RTA00000404F.g.21.1 | 37947 | 2 | 0 | 0 | 0 | 0 | 0 | 0 | 0 |
| 960 | RTA00000138A.n.4.1 | 21920 | 2 | 1 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 961 | RTA00000410F.b.15.1 | 77100 | 1 | 0 | 0 | 0 | 0 | 0 | 0 | 0 |
| 963 | RTA00000419F.j.23.1 | 74470 | 1 | 0 | 0 | 0 | 0 | 0 | 0 | 0 |
| 964 | RTAD0000411F.j.02.1 | 65310 | 1 | 0 | 0 | 0 | 0 | 0 | 0 | 0 |
| 965 | RTA00000419F.p.24.1 | 63477 | 1 | 0 | 0 | 0 | 0 | 0 | 0 | 0 |
| 966 | RTA00000404F.a.19.1 | 38624 | 2 | 0 | 0 | 0 | 0 | 0 | 0 | 0 |
| 973 | RTA00000346F.e.13.1 | 74653 | 1 | 0 | 0 | 0 | 0 | 0 | 0 | 0 |
| 974 | RTA00000419F.c.18.1 | 41394 | 1 | 1 | 0 | 0 | 0 | 0 | 0 | 0 |
| 978 | RTA00000404F.c.22.1 | 11344 | 3 | 3 | 0 | 0 | 0 | 0 | 0 | 0 |
| 981 | RTA00000125A.k.10.1 | 81644 | 1 | 0 | 0 | 0 | 0 | 0 | 0 | 0 |
| 982 | RTA00000347F.c.06.1 | 18846 | 2 | 1 | 0 | 0 | 0 | 0 | 0 | 0 |
| 983 | RTA00000411F.k.19.1 | 64200 | 1 | 0 | 0 | 0 | 0 | 0 | 0 | 0 |
| 984 | RTA00000345F.l.09.1 | 27250 | 2 | 0 | 0 | 0 | 0 | 0 | 0 | 0 |
| 985 | RTA00000423F.k.01.1 | 40426 | 2 | 0 | 0 | 0 | 0 | 0 | 0 | 0 |
| 986 | RTA00000408F.d.06.1 | 78997 | 1 | 0 | 0 | 0 | 0 | 0 | 0 | 0 |
| 987 | RTA00000128A.b.20.1 | 79761 | 1 | 0 | 0 | 0 | 0 | 0 | 0 | 0 |
| 989 | RTA00000195AF.d.4.1 | 22766 | 3 | 0 | 0 | 0 | 0 | 0 | 0 | 0 |
| 991 | RTA00000403F.h.12.1 | 15205 | 2 | 1 | 0 | 0 | 0 | 0 | 0 | 0 |
| 992 | RTA00000119A.j.22.1 | 80336 | 1 | 0 | 0 | 0 | 0 | 0 | 0 | 0 |
| 995 | RTA00000126A.n.7.2 | 79557 | 1 | 0 | 0 | 1 | 0 | 0 | 0 | 0 |
| 997 | RTA00000404F.j.08.1 | 39066 | 2 | 0 | 0 | 0 | 0 | 0 | 0 | 0 |
| 998 | RTA00000410F.c.14.1 | 77809 | 1 | 0 | 0 | 0 | 0 | 0 | 0 | 0 |
| 999 | RTA00000120A.g.23.1 | 81189 | 1 | 0 | 0 | 0 | 0 | 0 | 0 | 0 |
| 1000 | RTA00000195AF.d.20.1 | 37574 | 2 | 0 | 0 | 0 | 0 | 0 | 0 | 0 |
| 1002 | RTA00000412F.j.17.1 | 64071 | 1 | 0 | 0 | 0 | 0 | 0 | 0 | 0 |
| 1004 | RTA00000119A.j.10.1 | 79646 | 1 | 0 | 0 | 0 | 0 | 0 | 0 | 0 |
| 1010 | RTA00000419F.o.16.1 | 62867 | 1 | 0 | 0 | 0 | 0 | 0 | 0 | 0 |
| 1012 | RTA00000411F.c.17.1 | 77664 | 1 | 0 | 0 | 0 | 0 | 0 | 0 | 0 |
| 1013 | RTA00000406F.k.15.1 | 38549 | 2 | 0 | 0 | 0 | 0 | 0 | 0 | 0 |
| 1014 | RTA00000406F.a.02.1 | 37744 | 2 | 0 | 0 | 0 | 0 | 0 | 0 | 0 |
| 1016 | RTA00000341F.b.06.1 | 17008 | 4 | 0 | 0 | 0 | 0 | 0 | 0 | 0 |
| 1017 | RTA00000409F.n.14.1 | 78190 | 1 | 0 | 0 | 0 | 0 | 0 | 0 | 0 |
| 1019 | RTA00000345F.j.08.1 | 16731 | 3 | 1 | 0 | 0 | 0 | 0 | 0 | 0 |
| 1021 | RTA00000419F.g.15.1 | 32519 | 1 | 1 | 0 | 0 | 0 | 0 | 0 | 0 |
| 1022 | RTA00000423F.a.19.1 | 21396 | 1 | 2 | 0 | 0 | 0 | 0 | 0 | 0 |
| 1024 | RTA00000422F.e.08.1 | 39020 | 2 | 0 | 0 | 0 | 0 | 0 | 0 | 0 |
| 1025 | RTA00000411F.d.15.1 | 74890 | 1 | 0 | 0 | 0 | 0 | 0 | 0 | 0 |
| 1027 | RTA00000411F.l.15.1 | 66704 | 1 | 0 | 0 | 0 | 0 | 0 | 0 | 0 |
| 1029 | RTA00000405F.e.08.1 | 37916 | 2 | 0 | 0 | 0 | 1 | 0 | 0 | 0 |
| 1030 | RTA00000353R.j.24.1 | 23089 | 3 | 0 | 0 | 0 | 0 | 0 | 0 | 0 |
| 1032 | RTA00000418F.o.06.1 | 75930 | 1 | 0 | 0 | 0 | 0 | 0 | 0 | 0 |
| 1033 | RTA00000404F.c.10.1 | 23534 | 2 | 1 | 0 | 0 | 0 | 0 | 0 | 0 |
| 1034 | RTA00000418F.i.21.1 | 78728 | 1 | 0 | 0 | 0 | 0 | 0 | 0 | 0 |
| 1036 | RTA00000411F.l.13.1 | 43114 | 1 | 1 | 0 | 0 | 0 | 0 | 0 | 0 |
| 1037 | RTA00000407F.a.24.1 | 37560 | 2 | 0 | 0 | 0 | 0 | 0 | 0 | 0 |
| 1038 | RTA00000346F.n.06.1 | 12439 | 4 | 0 | 0 | 0 | 0 | 0 | 0 | 0 |
| 1039 | RTA00000412F.l.21.1 | 65183 | 1 | 0 | 0 | 0 | 0 | 0 | 0 | 0 |
| 1040 | RTA00000413F.i.02.1 | 65857 | 1 | 0 | 0 | 0 | 0 | 0 | 0 | 0 |
| 1041 | RTA00000404F.i.19.1 | 38698 | 2 | 0 | 0 | 0 | 0 | 0 | 0 | 0 |
| 1043 | RTA00000403F.a.11.1 | 73109 | 1 | 0 | 0 | 0 | 0 | 0 | 0 | 0 |
| 1045 | RTA00000411F.k.16.1 | 64759 | 1 | 0 | 0 | 0 | 0 | 0 | 1 | 0 |
| 1046 | RTA00000405F.c.01.1 | 19236 | 2 | 0 | 0 | 0 | 0 | 0 | 0 | 0 |
| 1047 | RTA00000423F.i.18.1 | 14996 | 4 | 0 | 0 | 0 | 0 | 0 | 0 | 0 |
| 1050 | RTA00000406F.a.07.1 | 26607 | 2 | 0 | 0 | 0 | 0 | 0 | 0 | 0 |
| 1051 | RTA00000347F.b.06.1 | 39122 | 2 | 0 | 0 | 0 | 0 | 0 | 0 | 0 |
| 1052 | RTA00000419F.b.18.1 | 67034 | 1 | 0 | 0 | 0 | 0 | 0 | 0 | 0 |
| 1053 | RTA00000406F.h.07.1 | 38003 | 2 | 0 | 0 | 0 | 0 | 0 | 0 | 0 |
| 1054 | RTA00000405F.l.15.1 | 19575 | 2 | 1 | 0 | 0 | 0 | 0 | 0 | 0 |
| 1055 | RTA00000406F.g.17.1 | 37979 | 2 | 0 | 0 | 0 | 0 | 0 | 0 | 0 |
| 1058 | RTA00000130A.h.22.1 | 80933 | 1 | 0 | 0 | 0 | 0 | 0 | 0 | 0 |
| 1061 | RTA00000404F.d.13.1 | 39036 | 2 | 0 | 0 | 0 | 0 | 0 | 0 | 0 |
| 1064 | RTA00000340F.n.01.1 | 39081 | 2 | 0 | 0 | 0 | 0 | 0 | 0 | 0 |
| 1065 | RTA00000419F.d.06.1 | 65496 | 1 | 0 | 0 | 0 | 0 | 0 | 0 | 0 |
| 1066 | RTA00000419F.n.09.1 | 66070 | 1 | 0 | 0 | 0 | 0 | 0 | 0 | 0 |
| 1067 | RTA00000399F.i.08.1 | 38927 | 2 | 0 | 0 | 0 | 0 | 0 | 0 | 0 |
| 1069 | RTA00000423F.g.13.1 | 38028 | 2 | 0 | 0 | 0 | 0 | 0 | 0 | 0 |
| 1072 | RTA00000195AF.b.21.1 | 39055 | 2 | 0 | 0 | 0 | 0 | 0 | 0 | 0 |
| 1073 | RTA00000403F.h.05.1 | 39096 | 2 | 0 | 0 | 0 | 0 | 0 | 0 | 0 |
| 1075 | RTA00000422F.p.07.2 | 39024 | 2 | 0 | 0 | 1 | 0 | 0 | 0 | 0 |
| 1078 | RTA00000421F.n.19.1 | 16409 | 3 | 1 | 0 | 0 | 0 | 0 | 0 | 0 |
| 1080 | RTA00000345F.k.21.1 | 40204 | 2 | 0 | 0 | 0 | 0 | 0 | 0 | 0 |
| 1082 | RTA00000405F.a.11.1 | 39124 | 2 | 0 | 0 | 0 | 0 | 0 | 0 | 0 |
| 1084 | RTA00000413F.e.16.1 | 63836 | 1 | 0 | 0 | 0 | 0 | 0 | 0 | 0 |
| 1086 | RTA00000404F.o.18.2 | 39110 | 2 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1087 | RTA00000409F.i.24.1 | 76967 | 1 | 0 | 0 | 0 | 0 | 0 | 0 | 0 |
| 1091 | RTA00000340F.n.13.1 | 17055 | 4 | 0 | 0 | 0 | 0 | 0 | 0 | 0 |
| 1092 | RTA00000340F.p.04.1 | 78533 | 1 | 0 | 0 | 0 | 0 | 0 | 0 | 0 |
| 1093 | RTA00000411F.c.05.1 | 73368 | 1 | 0 | 0 | 0 | 0 | 0 | 0 | 0 |
| 1097 | RTA00000404F.i.02.1 | 39015 | 2 | 0 | 0 | 0 | 0 | 0 | 0 | 0 |
| 1099 | RTA00000403F.m.15.2 | 26901 | 2 | 0 | 0 | 0 | 0 | 0 | 0 | 0 |
| 1100 | RTA00000412F.h.23.2 | 65118 | 1 | 0 | 0 | 0 | 0 | 0 | 0 | 0 |
| 1101 | RTA00000418F.j.08.1 | 73382 | 1 | 0 | 0 | 0 | 0 | 0 | 0 | 0 |
| 1102 | RTA00000125A.n.4.1 | 81984 | 1 | 0 | 0 | 0 | 0 | 0 | 0 | 0 |
| 1103 | RTA00000412F.l.19.1 | 65825 | 1 | 0 | 0 | 0 | 0 | 0 | 0 | 0 |
| 1105 | RTA00000129A.p.3.1 | 32644 | 1 | 1 | 0 | 0 | 0 | 0 | 0 | 0 |
| 1106 | RTA00000340F.p.20.1 | 17008 | 4 | 0 | 0 | 0 | 0 | 0 | 0 | 0 |
| 1107 | RTA00000411F.a.10.1 | 73073 | 1 | 0 | 0 | 0 | 0 | 0 | 0 | 0 |
| 1108 | RTA00000409F.n.17.1 | 76725 | 1 | 0 | 0 | 0 | 0 | 0 | 0 | 0 |
| 1109 | RTA00000404F.c.03.2 | 39198 | 2 | 0 | 0 | 0 | 0 | 0 | 0 | 0 |
| 1110 | RTA00000420F.a.19.1 | 34192 | 1 | 1 | 0 | 0 | 0 | 0 | 0 | 0 |
| 1114 | RTA00000420F.d.12.1 | 64095 | 1 | 0 | 0 | 0 | 0 | 0 | 0 | 0 |
| 1115 | RTA00000409F.j.19.1 | 73792 | 1 | 0 | 0 | 0 | 0 | 0 | 0 | 0 |
| 1116 | RTA00000422F.d.16.1 | 39133 | 2 | 0 | 0 | 0 | 0 | 0 | 0 | 0 |
| 1117 | RTA00000418F.m.16.1 | 74986 | 1 | 0 | 0 | 0 | 0 | 0 | 0 | 0 |
| 1118 | RTA00000405F.c.11.1 | 39068 | 2 | 0 | 0 | 0 | 0 | 0 | 0 | 0 |
| 1119 | RTA00000404F.k.22.1 | 39084 | 2 | 0 | 0 | 0 | 0 | 0 | 0 | 0 |
| 1120 | RTA00000418F.k.07.1 | 75067 | 1 | 0 | 0 | 0 | 0 | 0 | 0 | 0 |
| 1121 | RTA00000403F.c.10.1 | 75261 | 1 | 0 | 0 | 0 | 0 | 0 | 0 | 0 |
| 1124 | RTA00000410F.m.05.1 | 74964 | 1 | 0 | 0 | 0 | 0 | 0 | 0 | 0 |
| 1125 | RTA00000405F.i.20.1 | 38532 | 2 | 0 | 0 | 0 | 0 | 0 | 0 | 0 |
| 1127 | RTA00000408F.p.24.1 | 74286 | 1 | 0 | 0 | 0 | 0 | 0 | 0 | 0 |
| 1128 | RTA00000418F.k.18.1 | 75385 | 1 | 0 | 0 | 0 | 0 | 0 | 0 | 0 |
| 1129 | RTA00000422F.m.04.1 | 38702 | 2 | 0 | 0 | 0 | 0 | 0 | 0 | 0 |
| 1133 | RTA00000403F.a.07.1 | 73559 | 1 | 0 | 0 | 0 | 0 | 0 | 0 | 0 |
| 1135 | RTA00000403F.b.19.3 | 22327 | 2 | 1 | 0 | 0 | 0 | 0 | 0 | 0 |
| 1136 | RTA00000418F.m.23.1 | 77195 | 1 | 0 | 0 | 0 | 0 | 0 | 0 | 0 |
| 1138 | RTA00000404F.i.18.1 | 21912 | 2 | 1 | 0 | 0 | 0 | 0 | 0 | 0 |
| 1139 | RTA00000422F.i.14.1 | 39300 | 2 | 0 | 0 | 0 | 0 | 0 | 0 | 0 |
| 1140 | RTA00000418F.m.14.1 | 75711 | 1 | 0 | 0 | 1 | 0 | 0 | 0 | 0 |
| 1141 | RTA00000406F.o.12.1 | 37459 | 2 | 0 | 0 | 0 | 0 | 0 | 0 | 0 |
| 1143 | RTA00000411F.a.07.1 | 74547 | 1 | 0 | 0 | 0 | 0 | 0 | 0 | 0 |
| 1144 | RTA00000411F.c.02.1 | 72852 | 1 | 0 | 0 | 0 | 0 | 0 | 0 | 0 |
| 1146 | RTA00000130A.h.16.1 | 80761 | 1 | 0 | 0 | 0 | 0 | 0 | 0 | 0 |
| 1147 | RTA00000410F.p.23.1 | 73948 | 1 | 0 | 0 | 0 | 0 | 0 | 0 | 0 |
| 1148 | RTA00000418F.m.24.1 | 77114 | 1 | 0 | 0 | 0 | 0 | 0 | 0 | 0 |
| 1150 | RTA00000408F.j.19.2 | 73752 | 1 | 0 | 0 | 0 | 0 | 0 | 0 | 0 |
| 1152 | RTA00000118A.d.17.1 | 81921 | 1 | 0 | 0 | 0 | 0 | 0 | 0 | 0 |
| 1153 | RTA00000407F.b.04.1 | 63221 | 1 | 0 | 0 | 0 | 0 | 0 | 0 | 0 |
| 1154 | RTA00000411F.e.07.1 | 65008 | 1 | 0 | 0 | 0 | 0 | 0 | 0 | 0 |
| 1156 | RTA00000132A.c.11.1 | 87278 | 1 | 0 | 0 | 0 | 0 | 0 | 0 | 0 |
| 1157 | RTA00000420F.e.16.1 | 63639 | 1 | 0 | 0 | 0 | 0 | 0 | 0 | 0 |
| 1159 | RTA00000404F.b.11.1 | 39079 | 2 | 0 | 0 | 0 | 0 | 0 | 0 | 0 |
| 1160 | RTA00000418F.k.17.1 | 75390 | 1 | 0 | 0 | 0 | 0 | 0 | 0 | 0 |
| 1161 | RTA00000129A.k.12.1 | 79322 | 1 | 0 | 0 | 0 | 0 | 0 | 0 | 0 |
| 1162 | RTA00000340R.m.07.1 | 78415 | 1 | 0 | 0 | 0 | 0 | 0 | 0 | 0 |
| 1163 | RTA00000405F.d.14.1 | 35209 | 2 | 0 | 0 | 0 | 0 | 0 | 1 | 0 |
| 1164 | RTA00000406F.f.11.1 | 38601 | 2 | 0 | 0 | 0 | 0 | 0 | 0 | 0 |
| 1165 | RTA00000120A.h.5.1 | 80344 | 1 | 0 | 0 | 0 | 0 | 0 | 0 | 0 |
| 1167 | RTA00000411F.g.06.1 | 66065 | 1 | 0 | 0 | 0 | 0 | 0 | 0 | 0 |
| 1168 | RTA00000408F.d.16.1 | 76318 | 1 | 0 | 0 | 0 | 0 | 0 | 0 | 0 |
| 1171 | RTA00000404F.c.19.1 | 39026 | 2 | 0 | 0 | 0 | 0 | 0 | 0 | 1 |
| 1173 | RTA00000410F.a.01.1 | 73354 | 1 | 0 | 0 | 0 | 0 | 0 | 0 | 0 |
| 1174 | RTA00000408F.h.08.1 | 74575 | 1 | 0 | 0 | 0 | 0 | 0 | 0 | 0 |
| 1175 | RTA00000422F.b.16.1 | 17045 | 4 | 0 | 0 | 0 | 0 | 0 | 0 | 0 |
| 1176 | RTA00000419F.f.10.1 | 66193 | 1 | 0 | 0 | 0 | 0 | 0 | 0 | 0 |
| 1177 | RTAG0000418F.l.04.1 | 74140 | 1 | 0 | 0 | 0 | 0 | 0 | 0 | 0 |
| 1178 | RTA00000410F.a.16.1 | 73548 | 1 | 0 | 0 | 0 | 0 | 0 | 0 | 0 |
| 1179 | RTA00000138A.e.13.1 | 79608 | 1 | 0 | 0 | 0 | 0 | 0 | 0 | 0 |
| 1180 | RTA00000130A.b.5.1 | 79579 | 1 | 0 | 0 | 0 | 0 | 0 | 0 | 0 |
| 1181 | RTA00000408F.j.15.2 | 74759 | 1 | 0 | 0 | 0 | 0 | 0 | 0 | 0 |
| 1182 | RTA00000410F.m.20.1 | 74285 | 1 | 0 | 0 | 0 | 0 | 0 | 0 | 0 |
| 1185 | RTA00000419F.e.04.1 | 62963 | 1 | 0 | 0 | 0 | 0 | 0 | 0 | 0 |
| 1187 | RTA00000418F.g.05.1 | 73075 | 1 | 0 | 0 | 0 | 0 | 0 | 0 | 0 |
| 1188 | RTA00000419F.n.02.1 | 65963 | 1 | 0 | 0 | 0 | 0 | 0 | 0 | 0 |
| 1191 | RTA00000119A.m.15.1 | 80989 | 1 | 0 | 0 | 0 | 0 | 0 | 0 | 0 |
| 1194 | RTA00000413F.g.23.1 | 40700 | 1 | 1 | 0 | 0 | 0 | 0 | 0 | 0 |
| 1195 | RTA00000403F.a.18.1 | 75726 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1196 | RTA00000404F.m.20.2 | 39144 | 2 | 0 | 0 | 0 | 0 | 0 | 0 | 0 |
| 1199 | RTA00000419F.h.04.1 | 65034 | 1 | 0 | 0 | 0 | 0 | 0 | 0 | 0 |
| 1200 | RTA00000408F.d.12.1 | 75782 | 1 | 0 | 0 | 0 | 0 | 0 | 0 | 0 |
| 1201 | RTA00000133A.m.19.2 | 80167 | 1 | 0 | 0 | 0 | 0 | 0 | 0 | 0 |
| 1206 | RTA00000126A.o.22.1 | 81752 | 1 | 0 | 0 | 0 | 0 | 0 | 0 | 0 |
| 1207 | RTA00000419F.n.13.1 | 66026 | 1 | 0 | 0 | 0 | 0 | 0 | 0 | 0 |
| 1208 | RTA00000130A.h.13.1 | 80790 | 1 | 0 | 0 | 0 | 0 | 0 | 0 | 0 |
| 1212 | RTA00000411F.m.19.1 | 74924 | 1 | 0 | 0 | 0 | 0 | 0 | 0 | 0 |
| 1214 | RTA00000419F.k.06.1 | 78493 | 1 | 0 | 0 | 0 | 0 | 0 | 0 | 0 |
| 1216 | RTA00000412F.d.16.1 | 26829 | 1 | 0 | 0 | 0 | 0 | 0 | 0 | 0 |
| 1217 | RTA00000119A.j.23.1 | 79835 | 1 | 0 | 0 | 0 | 0 | 0 | 0 | 0 |
| 1219 | RTA00000195AF.c.12.1 | 37582 | 2 | 0 | 0 | 0 | 0 | 0 | 0 | 0 |
| 1223 | RTA00000423F.c.19.1 | 40472 | 2 | 0 | 0 | 0 | 0 | 0 | 0 | 0 |
| 1224 | RTA00000405F.g.24.1 | 39076 | 2 | 0 | 0 | 0 | 0 | 0 | 0 | 0 |
| 1226 | RTA00000419F.c.11.1 | 65504 | 1 | 0 | 0 | 0 | 0 | 0 | 0 | 0 |
| 1227 | RTA00000135A.f.14.2 | 79969 | 1 | 0 | 0 | 0 | 0 | 0 | 0 | 0 |
| 1228 | RTA00000403F.a.05.1 | 18808 | 1 | 1 | 0 | 0 | 0 | 0 | 0 | 0 |
| 1229 | RTA00000405F.e.17.1 | 38662 | 2 | 0 | 0 | 0 | 0 | 0 | 0 | 0 |
| 1230 | RTA00000411F.d.05.1 | 75812 | 1 | 0 | 0 | 0 | 0 | 0 | 0 | 0 |
| 1232 | RTA00000418F.d.03.1 | 76824 | 1 | 0 | 0 | 0 | 0 | 0 | 0 | 0 |
| 1233 | RTA00000418F.h.08.1 | 76401 | 1 | 0 | 0 | 0 | 0 | 0 | 0 | 0 |
| 1234 | RTA00000418F.m.10.1 | 79110 | 1 | 0 | 0 | 0 | 0 | 0 | 0 | 0 |
| 1235 | RTA00000411F.i.15.1 | 31612 | 1 | 1 | 0 | 0 | 0 | 0 | 0 | 0 |
| 1236 | RTA00000413F.i.23.1 | 63073 | 1 | 0 | 0 | 0 | 0 | 0 | 0 | 0 |
| 1237 | RTA00000411F.e.24.1 | 64781 | 1 | 0 | 0 | 0 | 0 | 0 | 0 | 0 |
| 1238 | RTA00000406F.g.22.1 | 38590 | 2 | 0 | 0 | 0 | 0 | 0 | 0 | 0 |
| 1239 | RTA00000126A.n.13.2 | 79735 | 1 | 0 | 0 | 0 | 0 | 0 | 0 | 0 |
| 1240 | RTA00000419F.a.02.1 | 77993 | 1 | 0 | 0 | 0 | 0 | 0 | 0 | 0 |
| 1241 | RTA00000346F.l.13.1 | 7542 | 8 | 0 | 0 | 2 | 1 | 0 | 1 | 0 |
| 1245 | RTA00000120A.d.15.1 | 80533 | 1 | 0 | 0 | 0 | 0 | 0 | 0 | 0 |
| 1246 | RTA00000418F.f.21.1 | 75157 | 1 | 0 | 0 | 0 | 0 | 0 | 0 | 0 |
| 1248 | RTA00000129A.d.1.2 | 80058 | 1 | 0 | 0 | 0 | 0 | 0 | 0 | 0 |
| 1251 | RTA00000419F.m.20.1 | 76720 | 1 | 0 | 0 | 0 | 0 | 0 | 0 | 0 |
| 1253 | RTA00000406F.e.15.1 | 39074 | 2 | 0 | 0 | 0 | 0 | 0 | 0 | 0 |
| 1255 | RTA00000411F.c.10.1 | 73117 | 1 | 0 | 0 | 0 | 0 | 0 | 0 | 0 |
| 1259 | RTA00000413F.d.05.1 | 64788 | 1 | 0 | 0 | 0 | 0 | 0 | 0 | 0 |
| 1260 | RTA00000121A.o.3.1 | 81437 | 1 | 0 | 0 | 0 | 0 | 0 | 0 | 0 |
| 1262 | RTA00000420F.e.02.1 | 40259 | 2 | 0 | 0 | 0 | 0 | 0 | 0 | 0 |
| 1268 | RTA00000126A.k.7.2 | 79866 | 1 | 0 | 0 | 0 | 0 | 0 | 0 | 0 |
| 1270 | RTA00000419F.l.03.1 | 79060 | 1 | 0 | 0 | 0 | 0 | 0 | 0 | 0 |
| 1272 | RTA00000118A.a.2.1 | 38067 | 2 | 0 | 0 | 0 | 0 | 0 | 0 | 0 |
| 1273 | RTA00000410F.m.18.1 | 76365 | 1 | 0 | 0 | 0 | 0 | 0 | 0 | 0 |
| 1275 | RTA00000406F.c.20.1 | 38578 | 2 | 0 | 0 | 0 | 0 | 0 | 0 | 0 |
| 1276 | RTA00000413F.b.14.1 | 66591 | 1 | 0 | 0 | 0 | 0 | 0 | 0 | 0 |
| 1277 | RTA00000406F.c.18.1 | 14368 | 2 | 0 | 0 | 0 | 0 | 0 | 0 | 0 |
| 1278 | RTA00000418F.j.09.1 | 76352 | 1 | 0 | 0 | 0 | 0 | 0 | 0 | 0 |
| 1279 | RTA00000419F.f.23.1 | 65002 | 1 | 0 | 0 | 0 | 0 | 0 | 0 | 0 |
| 1281 | RTA00000411F.a.05.1 | 76699 | 1 | 0 | 0 | 0 | 0 | 0 | 0 | 0 |
| 1282 | RTA00000419F.m.21.1 | 77947 | 1 | 0 | 0 | 0 | 0 | 0 | 0 | 0 |
| 1283 | RTA00000405F.n.16.1 | 21503 | 2 | 1 | 1 | 0 | 0 | 0 | 0 | 0 |
| 1284 | RTA00000422F.o.19.2 | 13084 | 3 | 2 | 0 | 0 | 0 | 0 | 0 | 0 |
| 1285 | RTA00000408F.n.02.2 | 76993 | 1 | 0 | 0 | 0 | 0 | 0 | 0 | 0 |
| 1290 | RTA00000119A.g.7.1 | 83580 | 1 | 0 | 0 | 0 | 0 | 0 | 0 | 0 |
| 1291 | RTA00000411F.i.02.1 | 66975 | 1 | 0 | 0 | 0 | 0 | 0 | 0 | 0 |
| 1292 | RTA00000408F.l.09.1 | 75487 | 1 | 0 | 0 | 0 | 0 | 0 | 0 | 0 |
| 1293 | RTA00000423F.g.04.1 | 23012 | 2 | 1 | 0 | 0 | 0 | 0 | 0 | 0 |
| 1295 | RTA00000418F.i.18.1 | 78024 | 1 | 0 | 0 | 0 | 0 | 0 | 0 | 0 |
| 1296 | RTA00000411F.h.15.1 | 65160 | 1 | 0 | 0 | 0 | 0 | 0 | 0 | 0 |
| 1297 | RTA00000410F.i.19.1 | 78988 | 1 | 0 | 0 | 0 | 0 | 0 | 0 | 0 |
| 1298 | RTA00000419F.k.24.1 | 75596 | 1 | 0 | 0 | 0 | 0 | 0 | 0 | 0 |
| 1301 | RTA00000409F.i.09.1 | 75279 | 1 | 0 | 0 | 0 | 0 | 0 | 0 | 0 |
| 1302 | RTA00000419F.h.02.1 | 63985 | 1 | 0 | 0 | 0 | 0 | 0 | 0 | 0 |
| 1303 | RTA00000413F.b.12.1 | 64932 | 1 | 0 | 0 | 0 | 0 | 0 | 0 | 0 |
| 1304 | RTA00000121A.h.18.1 | 16376 | 4 | 0 | 0 | 0 | 0 | 0 | 0 | 0 |
| 1305 | RTA00000411F.n.20.1 | 75816 | 1 | 0 | 0 | 0 | 0 | 0 | 0 | 0 |
| 1307 | RTA00000411F.n.12.1 | 73308 | 1 | 0 | 0 | 0 | 0 | 0 | 0 | 0 |
| 1308 | RTA00000408F.j.12.2 | 18226 | 1 | 0 | 0 | 0 | 0 | 0 | 0 | 0 |
| 1309 | RTA00000409F.i.03.1 | 75968 | 1 | 0 | 0 | 0 | 0 | 0 | 0 | 0 |
| 1312 | RTA00000409F.j.05.1 | 74128 | 1 | 0 | 0 | 0 | 0 | 0 | 0 | 0 |
| 1313 | RTA00000419F.m.04.1 | 74367 | 1 | 0 | 0 | 0 | 0 | 0 | 0 | 0 |
| 1314 | RTA00000418F.k.03.1 | 78901 | 1 | 0 | 0 | 0 | 0 | 0 | 0 | 0 |
| 1315 | RTA00000419F.d.16.1 | 64357 | 1 | 0 | 0 | 0 | 0 | 0 | 0 | 0 |
| 1316 | RTA00000420F.e.10.1 | 65899 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1319 | RTA00000418F.k.08.1 | 18259 | 1 | 0 | 0 | 0 | 0 | 0 | 0 | 0 |
| 1322 | RTA00000410F.c.02.1 | 75055 | 1 | 0 | 0 | 0 | 0 | 0 | 0 | 0 |
| 1324 | RTA00000403F.h.18.1 | 39241 | 2 | 0 | 0 | 0 | 0 | 0 | 0 | 0 |
| 1325 | RTA00000405F.n.13.1 | 23810 | 2 | 1 | 0 | 0 | 0 | 0 | 0 | 0 |
| 1326 | RTA00000355R.e.14.1 | 16837 | 2 | 2 | 0 | 0 | 0 | 0 | 0 | 0 |
| 1327 | RTA00000422F.l.03.1 | 39147 | 2 | 0 | 0 | 0 | 0 | 0 | 0 | 0 |
| 1329 | RTA00000403F.o.14.1 | 38971 | 2 | 0 | 0 | 0 | 0 | 0 | 0 | 0 |
| 1333 | RTA00000127A.f.11.1 | 81463 | 1 | 0 | 0 | 0 | 0 | 0 | 0 | 0 |
| 1335 | RTA00000403F.o.07.1 | 39037 | 2 | 0 | 0 | 0 | 0 | 0 | 0 | 0 |
| 1336 | RTA00000403F.d.19.1 | 39243 | 2 | 0 | 0 | 0 | 0 | 0 | 0 | 0 |
| 1338 | RTA00000406F.l.17.1 | 37902 | 2 | 0 | 0 | 0 | 0 | 0 | 0 | 0 |
| 1339 | RT060000418F.d.22.1 | 75324 | 1 | 0 | 0 | 0 | 0 | 0 | 0 | 0 |
| 1340 | RTA00000340R.o.12.1 | 53732 | 1 | 0 | 0 | 0 | 0 | 0 | 0 | 0 |
| 1341 | RTA00000125A.g.24.1 | 80397 | 1 | 0 | 0 | 0 | 0 | 0 | 0 | 0 |
| 1342 | RTA00000130A.o.21.1 | 80218 | 1 | 0 | 0 | 0 | 0 | 0 | 0 | 0 |
| 1343 | RTA00000420F.a.23.1 | 42158 | 1 | 1 | 0 | 0 | 0 | 0 | 0 | 0 |
| 1344 | RTA00000411F.m.18.1 | 75629 | 1 | 0 | 0 | 0 | 0 | 0 | 0 | 0 |
| 1345 | RTA00000407F.b.22.1 | 37487 | 2 | 0 | 0 | 0 | 0 | 0 | 0 | 0 |
| 1346 | RTA00000409F.a.16.1 | 73990 | 1 | 0 | 0 | 0 | 0 | 0 | 0 | 0 |
| 1348 | RTA00000341F.k.12.1 | 62985 | 1 | 0 | 0 | 0 | 0 | 0 | 0 | 0 |
| 1349 | RTA00000129A.c.18.2 | 37216 | 2 | 0 | 0 | 0 | 0 | 0 | 0 | 0 |
| 1350 | RTA00000410F.d.10.1 | 77561 | 1 | 0 | 0 | 0 | 0 | 0 | 0 | 0 |
| 1351 | RTA00000351R.i.03.1 | 6874 | 6 | 3 | 0 | 0 | 1 | 0 | 0 | 0 |
| 1352 | RTA00000135A.l.1.2 | 39426 | 2 | 0 | 0 | 0 | 0 | 0 | 0 | 0 |
| 1353 | RTA00000420F.b.15.1 | 66136 | 1 | 0 | 0 | 0 | 0 | 0 | 0 | 0 |
| 1356 | RTA00000403F.o.13.1 | 39049 | 2 | 0 | 0 | 0 | 0 | 0 | 0 | 0 |
| 1357 | RTA00000411F.f.06.1 | 64186 | 1 | 0 | 0 | 0 | 0 | 0 | 0 | 0 |
| 1359 | RTA00000351R.c.13.1 | 11476 | 6 | 0 | 0 | 0 | 0 | 0 | 0 | 0 |
| 1362 | RTA00000420F.d.16.1 | 64485 | 1 | 0 | 0 | 0 | 0 | 0 | 0 | 0 |
| 1363 | RTA00000404F.i.12.1 | 39001 | 2 | 0 | 0 | 0 | 0 | 0 | 0 | 0 |
| 1364 | RTA00000404F.o.10.2 | 16785 | 2 | 2 | 0 | 0 | 0 | 0 | 0 | 0 |
| 1365 | RTA00000419F.d.07.1 | 21421 | 1 | 2 | 0 | 0 | 0 | 0 | 0 | 0 |
| 1366 | RTA00000404F.p.02.2 | 39097 | 2 | 0 | 1 | 0 | 0 | 0 | 0 | 0 |
| 1367 | RTA00000125A.k.14.1 | 79457 | 1 | 0 | 0 | 0 | 0 | 0 | 0 | 0 |
| 1368 | RTA00000122A.j.22.1 | 81151 | 1 | 0 | 0 | 0 | 0 | 0 | 0 | 0 |
| 1369 | RTA00000406F.i.13.1 | 37904 | 2 | 0 | 0 | 0 | 0 | 0 | 0 | 0 |
| 1370 | RTA00000135A.b.23.1 | 35241 | 2 | 0 | 0 | 0 | 0 | 0 | 0 | 0 |
| 1373 | RTA00000423F.l.04.1 | 14320 | 2 | 0 | 0 | 0 | 0 | 0 | 0 | 0 |
| 1374 | RTA00000420F.b.04.1 | 63820 | 1 | 0 | 0 | 0 | 0 | 0 | 0 | 0 |
| 1376 | RTA00000408F.i.18.2 | 74410 | 1 | 0 | 0 | 0 | 0 | 0 | 0 | 0 |
| 1378 | RTA00000341F.j.05.1 | 36177 | 2 | 0 | 0 | 0 | 0 | 0 | 0 | 0 |
| 1379 | RTA00000420F.a.16.1 | 63345 | 1 | 0 | 0 | 0 | 0 | 0 | 0 | 0 |
| 1381 | RTA00000410F.j.01.1 | 73399 | 1 | 0 | 0 | 0 | 0 | 0 | 0 | 0 |
| 1382 | RTA00000408F.p.21.1 | 77930 | 1 | 0 | 0 | 0 | 0 | 0 | 0 | 0 |
| 1383 | RTA00000412F.d.19.1 | 75743 | 1 | 0 | 0 | 0 | 0 | 0 | 0 | 0 |
| 1384 | RTA00000352R.c.04.1 | 71976 | 1 | 0 | 0 | 0 | 0 | 0 | 0 | 0 |
| 1385 | RTA00000413F.f.19.1 | 65189 | 1 | 0 | 0 | 0 | 0 | 0 | 0 | 0 |
| 1386 | RTA00000411F.e.03.1 | 73648 | 1 | 0 | 0 | 0 | 0 | 0 | 0 | 0 |
| 1389 | RTA00000418F.c.04.1 | 41587 | 1 | 1 | 0 | 0 | 0 | 0 | 0 | 0 |
| 1390 | RTA00000418F.o.17.1 | 79069 | 1 | 0 | 0 | 0 | 0 | 0 | 0 | 0 |
| 1391 | RTA00000418F.e.21.1 | 74773 | 1 | 0 | 0 | 0 | 0 | 0 | 0 | 0 |
| 1392 | RTA00000419F.d.14.1 | 64945 | 1 | 0 | 0 | 0 | 0 | 0 | 0 | 0 |
| 1396 | RTA00000410F.j.20.1 | 73601 | 1 | 0 | 0 | 0 | 0 | 0 | 0 | 0 |
| 1399 | RTA00000119A.j.9.1 | 82060 | 1 | 0 | 0 | 0 | 0 | 0 | 0 | 0 |
| 1403 | RTA00000340F.i.13.1 | 79299 | 1 | 0 | 0 | 0 | 0 | 0 | 0 | 0 |
| 1404 | RTA00000412F.g.03.1 | 64740 | 1 | 0 | 0 | 0 | 0 | 0 | 0 | 0 |
| 1405 | RTA00000122A.g.17.1 | 32655 | 1 | 1 | 0 | 0 | 0 | 0 | 0 | 0 |
| 1407 | RTA00000419F.n.12.1 | 66086 | 1 | 0 | 0 | 0 | 0 | 0 | 0 | 0 |
| 1410 | RTA00000351R.p.14.1 | 13166 | 2 | 3 | 0 | 0 | 0 | 0 | 0 | 0 |
| 1411 | RTA00000403F.e.08.1 | 19126 | 3 | 0 | 0 | 0 | 0 | 0 | 0 | 0 |
| 1412 | RTA00000124A.k.20.1 | 80913 | 1 | 0 | 0 | 0 | 0 | 0 | 0 | 0 |
| 1413 | RTA00000121A.n.2.1 | 33585 | 1 | 1 | 0 | 0 | 0 | 0 | 0 | 0 |
| 1414 | RTA00000422F.m.24.1 | 39159 | 2 | 0 | 1 | 0 | 1 | 1 | 2 | 2 |
| 1415 | RTA00000408F.e.24.2 | 75002 | 1 | 0 | 0 | 0 | 0 | 0 | 0 | 0 |
| 1418 | RTA00000403F.b.12.1 | 78775 | 1 | 0 | 0 | 0 | 0 | 0 | 0 | 0 |
| 1419 | RTA00000404F.a.09.1 | 38985 | 2 | 0 | 0 | 0 | 0 | 0 | 0 | 0 |
| 1421 | RTA00000403F.o.19.1 | 78615 | 1 | 0 | 0 | 0 | 0 | 0 | 0 | 0 |
| 1424 | RTA00000410F.b.10.1 | 74504 | 1 | 0 | 0 | 0 | 0 | 0 | 0 | 0 |
| 1426 | RTA00000413F.h.12.1 | 66929 | 1 | 0 | 0 | 0 | 0 | 0 | 0 | 0 |
| 1427 | RTA00000406F.k.14.1 | 38651 | 2 | 0 | 0 | 0 | 0 | 0 | 0 | 0 |
| 1429 | RTA00000411F.f.17.1 | 65661 | 1 | 0 | 0 | 0 | 0 | 0 | 0 | 0 |
| 1430 | RTA00000411F.k.10.1 | 64506 | 1 | 0 | 0 | 0 | 0 | 0 | 0 | 0 |
| 1431 | RTA00000411F.g.21.1 | 64500 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1432 | RTA00000119A.h.24.1 | 82266 | 1 | 0 | 0 | 0 | 0 | 0 | 0 | 0 |
| 1434 | RTA00000408F.m.22.2 | 72949 | 1 | 0 | 0 | 0 | 0 | 0 | 0 | 0 |
| 1437 | RTA00000410F.i.17.1 | 78147 | 1 | 0 | 0 | 0 | 0 | 0 | 0 | 0 |
| 1440 | RTA00000129A.a.13.2 | 79780 | 1 | 0 | 0 | 0 | 0 | 0 | 0 | 0 |
| 1441 | RTA00000129A.k.21.1 | 82067 | 1 | 0 | 0 | 0 | 0 | 0 | 0 | 0 |
| 1442 | RTA00000350R.g.10.1 | 9026 | 7 | 0 | 0 | 1 | 0 | 0 | 0 | 0 |
| 1443 | RTA00000413F.d.23.1 | 66030 | 1 | 0 | 0 | 0 | 0 | 0 | 0 | 0 |
| 1447 | RTA00000411F.d.10.1 | 76445 | 1 | 0 | 0 | 0 | 0 | 0 | 0 | 0 |
| 1448 | RTA00000404F.b.19.1 | 39281 | 2 | 0 | 0 | 0 | 0 | 0 | 0 | 0 |
| 1449 | RTA00000418F.c.07.1 | 73245 | 1 | 0 | 0 | 0 | 0 | 0 | 0 | 0 |
| 1450 | RTA00000418F.j.15.1 | 74855 | 1 | 0 | 0 | 0 | 0 | 1 | 0 | 0 |
| 1453 | RTA00000413F.b.16.1 | 65126 | 1 | 0 | 0 | 0 | 0 | 0 | 0 | 0 |
| 1455 | RTA00000350R.m.14.1 | 39171 | 2 | 0 | 0 | 0 | 0 | 0 | 0 | 0 |
| 1456 | RTA00000418F.l.11.1 | 77158 | 1 | 0 | 0 | 0 | 0 | 0 | 0 | 0 |
| 1457 | RTA00000130A.d.5.1 | 82051 | 1 | 0 | 0 | 0 | 0 | 0 | 0 | 0 |
| 1458 | RTA00000339F.n.05.1 | 39648 | 2 | 0 | 0 | 0 | 0 | 0 | 0 | 0 |
| 1460 | RTA00000407F.a.23.1 | 23489 | 2 | 1 | 0 | 0 | 0 | 0 | 0 | 0 |
| 1462 | RTA00000403F.h.11.1 | 39219 | 2 | 0 | 0 | 0 | 0 | 0 | 0 | 0 |
| 1463 | RTA00000406F.j.13.1 | 38688 | 2 | 0 | 0 | 0 | 0 | 0 | 0 | 0 |
| 1464 | RTA00000352R.p.09.1 | 16915 | 4 | 0 | 0 | 0 | 0 | 0 | 0 | 0 |
| 1465 | RTA00000413F.g.24.1 | 65481 | 1 | 0 | 0 | 0 | 0 | 0 | 0 | 0 |
| 1469 | RTA00000420F.a.08.1 | 19473 | 1 | 2 | 0 | 0 | 0 | 0 | 0 | 0 |
| 1472 | RTA00000404F.i.22.1 | 39082 | 2 | 0 | 0 | 0 | 0 | 0 | 0 | 0 |
| 1473 | RTA00000124A.k.23.1 | 81350 | 1 | 0 | 0 | 0 | 0 | 0 | 0 | 0 |
| 1474 | RTA00000404F.e.11.1 | 38991 | 2 | 0 | 0 | 0 | 0 | 0 | 0 | 0 |
| 1475 | RTA00000129A.d.2.4 | 80119 | 1 | 0 | 0 | 0 | 0 | 0 | 0 | 0 |
| 1478 | RTA00000419F.o.15.1 | 32487 | 1 | 1 | 0 | 0 | 0 | 0 | 0 | 0 |
| 1479 | RTA00000119A.m.17.1 | 79536 | 1 | 0 | 0 | 0 | 0 | 0 | 0 | 0 |
| 1480 | RTA00000410F.b.07.1 | 78916 | 1 | 0 | 0 | 0 | 0 | 0 | 0 | 0 |
| 1481 | RTA00000420F.b.19.1 | 36873 | 2 | 0 | 0 | 0 | 0 | 0 | 0 | 0 |
| 1483 | RTA00000411F.b.21.1 | 10051 | 1 | 0 | 0 | 0 | 0 | 0 | 0 | 0 |
| 1485 | RTA00000356R.c.16.1 | 16915 | 4 | 0 | 0 | 0 | 0 | 0 | 0 | 0 |
| 1487 | RTA00000412F.h.11.1 | 63175 | 1 | 0 | 0 | 0 | 0 | 0 | 0 | 0 |
| 1490 | RTA00000420F.a.11.1 | 66460 | 1 | 0 | 0 | 0 | 0 | 0 | 0 | 0 |
| 1491 | RTA00000120A.c.7.1 | 80985 | 1 | 0 | 0 | 1 | 0 | 0 | 0 | 0 |
| 1492 | RTA00000404F.e.15.1 | 39101 | 2 | 0 | 0 | 0 | 0 | 0 | 0 | 0 |
| 1493 | RTA00000422F.n.20.1 | 38676 | 2 | 0 | 0 | 0 | 0 | 0 | 1 | 0 |
| 1494 | RTA00000423F.h.20.1 | 38639 | 2 | 0 | 0 | 0 | 0 | 0 | 0 | 0 |
| 1497 | RTA00000410F.b.18.1 | 76701 | 1 | 0 | 0 | 0 | 0 | 0 | 0 | 0 |
| 1499 | RTA00000423F.g.15.1 | 35173 | 2 | 0 | 0 | 0 | 0 | 0 | 0 | 0 |
| 1500 | RTA00000413F.b.04.1 | 66427 | 1 | 0 | 0 | 0 | 0 | 0 | 0 | 0 |
| 1503 | RTA00000346F.f.11.1 | 38528 | 2 | 0 | 0 | 0 | 0 | 0 | 0 | 0 |
| 1506 | RTA00000422F.i.02.1 | 76436 | 1 | 0 | 0 | 0 | 0 | 0 | 0 | 0 |
| 1507 | RTA00000410F.a.08.1 | 73324 | 1 | 0 | 0 | 0 | 0 | 0 | 0 | 0 |
| 1509 | RTA00000419F.e.02.1 | 65010 | 1 | 0 | 0 | 0 | 0 | 0 | 0 | 0 |
| 1511 | RTA00000403F.g.13.1 | 38718 | 2 | 0 | 0 | 0 | 0 | 0 | 0 | 0 |
| 1513 | RTA00000407F.a.01.1 | 12501 | 3 | 1 | 0 | 0 | 0 | 0 | 0 | 0 |
| 1516 | RTA00000411F.f.14.1 | 62984 | 1 | 0 | 0 | 0 | 0 | 0 | 0 | 0 |
| 1517 | RTA00000411F.c.04.1 | 76858 | 1 | 0 | 0 | 0 | 0 | 0 | 0 | 0 |
| 1518 | RTA00000135A.m.18.1 | 19255 | 2 | 0 | 0 | 0 | 0 | 0 | 0 | 0 |
| 1519 | RTA00000413F.c.17.1 | 36831 | 2 | 0 | 0 | 0 | 0 | 0 | 0 | 0 |
| 1521 | RTA00000404F.j.01.1 | 26859 | 2 | 0 | 0 | 0 | 0 | 0 | 0 | 0 |
| 1522 | RTA00000138A.p.10.1 | 81625 | 1 | 0 | 0 | 0 | 0 | 0 | 0 | 0 |
| 1526 | RTA00000423F.h.07.1 | 37933 | 2 | 0 | 0 | 0 | 0 | 0 | 0 | 0 |
| 1527 | RTA00000413F.e.04.1 | 64176 | 1 | 0 | 0 | 0 | 0 | 0 | 0 | 0 |
| 1528 | RTA00000406F.h.03.1 | 38585 | 2 | 0 | 0 | 0 | 0 | 0 | 0 | 0 |
| 1529 | RTA00000403F.e.24.1 | 16432 | 2 | 2 | 0 | 0 | 0 | 0 | 0 | 0 |
| 1531 | RTA00000403F.i.11.1 | 23535 | 2 | 1 | 0 | 0 | 0 | 0 | 0 | 0 |
| 1532 | RTA00000419F.g.02.1 | 62839 | 1 | 0 | 0 | 0 | 0 | 0 | 0 | 0 |
| 1533 | RTA00000347F.e.05.1 | 39814 | 2 | 0 | 0 | 0 | 0 | 0 | 0 | 0 |
| 1534 | RTA00000408F.l.16.1 | 73468 | 1 | 0 | 0 | 0 | 0 | 0 | 0 | 0 |
| 1536 | RTA00000423F.f.09.1 | 64823 | 1 | 0 | 0 | 0 | 0 | 0 | 0 | 0 |
| 1537 | RTA00000419F.k.03.1 | 40822 | 1 | 1 | 0 | 0 | 0 | 0 | 0 | 0 |
| 1538 | RTA00000406F.b.02.1 | 38744 | 2 | 0 | 0 | 0 | 0 | 0 | 0 | 0 |
| 1539 | RTA00000418F.o.14.1 | 33524 | 1 | 1 | 0 | 0 | 0 | 0 | 0 | 0 |
| 1541 | RTA00000404F.b.09.1 | 39166 | 2 | 0 | 0 | 0 | 0 | 0 | 0 | 0 |
| 1547 | RTA00000406F.k.11.1 | 38715 | 2 | 0 | 0 | 0 | 0 | 0 | 0 | 0 |
| 1549 | RTA00000406F.c.06.1 | 37924 | 2 | 0 | 0 | 0 | 0 | 0 | 0 | 0 |
| 1550 | RTA00000418F.n.07.1 | 76316 | 1 | 0 | 0 | 0 | 0 | 0 | 0 | 0 |
| 1551 | RTA00000419F.n.15.1 | 63484 | 1 | 0 | 0 | 0 | 0 | 0 | 0 | 0 |
| 1552 | RTA00000408F.n.06.2 | 76642 | 1 | 0 | 0 | 0 | 0 | 0 | 0 | 0 |
| 1553 | RTA00000420F.c.04.1 | 65007 | 1 | 0 | 0 | 0 | 0 | 0 | 0 | 0 |
| 1554 | RTA00000411F.j.15.1 | 66871 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1556 | RTA00000128A.m.23.1 | 81441 | 1 | 0 | 0 | 0 | 0 | 0 | 0 | 0 |
| 1557 | RTA00000406F.g.03.1 | 38690 | 2 | 0 | 0 | 0 | 0 | 0 | 0 | 0 |
| 1558 | RTA00000405F.h.05.2 | 75706 | 1 | 0 | 0 | 0 | 0 | 0 | 0 | 0 |
| 1559 | RTA00000129A.n.24.1 | 81409 | 1 | 0 | 0 | 0 | 0 | 0 | 0 | 0 |
| 1562 | RTA00000418F.n.11.1 | 78977 | 1 | 0 | 0 | 0 | 0 | 0 | 0 | 0 |
| 1565 | RTA00000120A.h.9.1 | 80736 | 1 | 0 | 0 | 0 | 0 | 0 | 0 | 0 |
| 1566 | RTA00000413F.a.12.1 | 63403 | 1 | 0 | 0 | 0 | 0 | 0 | 0 | 0 |
| 1567 | RTA00000412F.o.05.1 | 63575 | 1 | 0 | 0 | 0 | 0 | 0 | 0 | 0 |
| 1571 | RTA00000354R.n.04.1 | 22049 | 3 | 0 | 0 | 0 | 0 | 0 | 0 | 0 |
| 1573 | RTA00000406F.h.05.1 | 38542 | 2 | 0 | 0 | 0 | 0 | 0 | 0 | 0 |
| 1574 | RTA00000410F.b.24.1 | 75104 | 1 | 0 | 0 | 0 | 0 | 0 | 0 | 0 |
| 1575 | RTA00000423F.d.11.1 | 38950 | 2 | 0 | 0 | 0 | 0 | 0 | 0 | 0 |
| 1578 | RTA00000119A.k.1.1 | 81282 | 1 | 0 | 0 | 0 | 0 | 0 | 0 | 0 |
| 1579 | RTA00000420F.f.07.1 | 66312 | 1 | 0 | 0 | 0 | 0 | 0 | 0 | 0 |
| 1580 | RTA00000404F.k.22.2 | 39084 | 2 | 0 | 0 | 0 | 0 | 0 | 0 | 0 |
| 1581 | RTA00000422F.e.07.1 | 38964 | 2 | 0 | 0 | 0 | 0 | 0 | 0 | 0 |
| 1582 | RTA00000410F.f.12.1 | 73883 | 1 | 0 | 0 | 0 | 0 | 0 | 0 | 0 |
| 1584 | RTA00000411F.m.11.1 | 73196 | 1 | 0 | 0 | 0 | 0 | 0 | 0 | 0 |
| 1587 | RTA00000403F.o.10.2 | 38964 | 2 | 0 | 0 | 0 | 0 | 0 | 0 | 0 |
| 1590 | RTA00000413F.c.10.1 | 65600 | 1 | 0 | 0 | 0 | 0 | 0 | 0 | 0 |
| 1591 | RTA00000411F.b.17.1 | 72893 | 1 | 0 | 0 | 0 | 0 | 0 | 0 | 0 |
| 1593 | RTA00000408F.k.19.1 | 77593 | 1 | 0 | 0 | 0 | 0 | 0 | 0 | 0 |
| 1596 | RTA00000119A.i.8.1 | 82593 | 1 | 0 | 0 | 0 | 0 | 0 | 0 | 0 |
| 1598 | RTA00000418F.g.03.1 | 78737 | 1 | 0 | 0 | 0 | 0 | 0 | 0 | 0 |
| 1599 | RTA00000411F.a.09.1 | 78629 | 1 | 0 | 0 | 0 | 0 | 0 | 0 | 0 |
| 1601 | RTA00000419F.j.11.1 | 73183 | 1 | 0 | 0 | 0 | 0 | 0 | 0 | 0 |
| 1603 | RTA00000404F.n.18.2 | 37169 | 2 | 0 | 0 | 0 | 0 | 0 | 0 | 0 |
| 1604 | RTA00000122A.n.16.1 | 80553 | 1 | 0 | 0 | 0 | 0 | 0 | 0 | 0 |
| 1605 | RTA00000420F.c.07.1 | 65555 | 1 | 0 | 0 | 0 | 0 | 0 | 0 | 0 |
| 1608 | RTA00000408F.j.13.2 | 42275 | 1 | 1 | 0 | 0 | 0 | 0 | 0 | 0 |
| 1610 | RTA00000423F.a.01.1 | 39103 | 2 | 0 | 0 | 0 | 0 | 0 | 0 | 0 |
| 1613 | RTA00000341F.e.20.1 | 67422 | 1 | 0 | 0 | 0 | 0 | 0 | 0 | 0 |
| 1614 | RTA00000419F.m.22.1 | 75600 | 1 | 0 | 0 | 0 | 0 | 0 | 0 | 0 |
| 1615 | RTA00000419F.m.23.1 | 64263 | 1 | 0 | 0 | 0 | 0 | 0 | 0 | 0 |
| 1616 | RTA00000419F.b.06.1 | 76728 | 1 | 0 | 0 | 0 | 0 | 0 | 0 | 0 |
| 1618 | RTA00000406F.p.08.1 | 37573 | 2 | 0 | 0 | 0 | 0 | 0 | 0 | 2 |
| 1619 | RTA00000129A.n.17.1 | 79811 | 1 | 0 | 0 | 0 | 0 | 0 | 0 | 0 |
| 1621 | RTA00000407F.b.08.1 | 37513 | 2 | 0 | 0 | 0 | 0 | 0 | 0 | 0 |
| 1623 | RTA00000406F.i.08.1 | 37946 | 2 | 0 | 0 | 0 | 0 | 0 | 0 | 0 |
| 1624 | RTA00000403F.h.07.1 | 26856 | 2 | 0 | 0 | 0 | 0 | 0 | 0 | 0 |
| 1625 | RTA00000418F.n.24.1 | 73153 | 1 | 0 | 0 | 0 | 0 | 0 | 0 | 0 |
| 1627 | RTA00000409F.l.20.1 | 74394 | 1 | 0 | 0 | 0 | 0 | 0 | 0 | 0 |
| 1628 | RTA00000418F.l.06.1 | 73317 | 1 | 0 | 0 | 0 | 0 | 0 | 0 | 0 |
| 1629 | RTA00000346F.o.22.1 | 7381 | 2 | 6 | 0 | 0 | 0 | 0 | 0 | 0 |
| 1630 | RTA00000129A.k.22.1 | 79639 | 1 | 0 | 0 | 0 | 0 | 0 | 0 | 0 |
| 1632 | RTA00000418F.m.22.1 | 74567 | 1 | 0 | 0 | 0 | 0 | 0 | 0 | 0 |
| 1633 | RTA00000413F.c.12.1 | 65334 | 1 | 0 | 0 | 0 | 0 | 0 | 0 | 0 |
| 1635 | RTA00000418F.g.20.1 | 74626 | 1 | 0 | 0 | 0 | 0 | 0 | 0 | 0 |
| 1636 | RTA00000413F.d.15.1 | 64943 | 1 | 0 | 0 | 0 | 0 | 0 | 0 | 0 |
| 1639 | RTA00000412F.c.10.1 | 76372 | 1 | 0 | 0 | 0 | 0 | 0 | 0 | 0 |
| 1640 | RTA00000122A.j.17.1 | 62736 | 1 | 0 | 0 | 0 | 0 | 0 | 0 | 0 |
| 1645 | RTA00000418F.j.19.1 | 78399 | 1 | 0 | 0 | 0 | 0 | 0 | 0 | 0 |
| 1646 | RTA00000137A.p.12.1 | 80614 | 1 | 0 | 0 | 0 | 0 | 0 | 0 | 0 |
| 1648 | RTA00000418F.p.10.1 | 75323 | 1 | 0 | 0 | 0 | 0 | 0 | 0 | 0 |
| 1649 | RTA00000408F.k.12.1 | 77246 | 1 | 0 | 0 | 0 | 0 | 0 | 0 | 0 |
| 1650 | RTA00000137A.j.11.4 | 79752 | 1 | 0 | 0 | 0 | 0 | 0 | 0 | 0 |
| 1652 | RTA00000419F.n.24.1 | 65995 | 1 | 0 | 0 | 0 | 0 | 0 | 0 | 0 |
| 1653 | RTA00000418F.l.03.1 | 79058 | 1 | 0 | 0 | 0 | 0 | 0 | 0 | 0 |
| 1655 | RTA00000419F.m.13.1 | 79052 | 1 | 0 | 0 | 0 | 0 | 0 | 0 | 0 |
| 1656 | RTA00000418F.j.14.1 | 32623 | 1 | 1 | 0 | 0 | 0 | 0 | 0 | 0 |
| 1657 | RTA00000403F.a.10.1 | 73952 | 1 | 0 | 0 | 0 | 0 | 0 | 0 | 0 |
| 1658 | RTA00000420F.a.21.1 | 66241 | 1 | 0 | 0 | 0 | 0 | 0 | 0 | 0 |
| 1659 | RTA00000127A.e.6.1 | 5885 | 4 | 2 | 0 | 0 | 0 | 0 | 0 | 0 |
| 1660 | RTA00000405F.g.21.2 | 38966 | 2 | 0 | 0 | 0 | 0 | 0 | 0 | 0 |
| 1661 | RTA00000405F.g.21.1 | 38966 | 2 | 0 | 0 | 0 | 0 | 0 | 0 | 0 |
| 1662 | RTA00000419F.m.06.1 | 75749 | 1 | 0 | 0 | 0 | 0 | 0 | 0 | 0 |
| 1663 | RTA00000423F.g.03.1 | 38007 | 2 | 0 | 0 | 0 | 0 | 0 | 0 | 0 |
| 1665 | RTA00000418F.f.03.1 | 78911 | 1 | 0 | 0 | 0 | 0 | 0 | 0 | 0 |
| 1668 | RTA00000120A.c.20.1 | 43235 | 1 | 1 | 0 | 0 | 0 | 1 | 0 | 0 |
| 1669 | RTA00000138A.m.15.1 | 41603 | 1 | 1 | 0 | 0 | 0 | 0 | 0 | 0 |
| 1670 | RTA00000408F.f.14.2 | 73024 | 1 | 0 | 0 | 0 | 0 | 0 | 0 | 0 |
| 1671 | RTA00000418F.p.20.1 | 78023 | 1 | 0 | 0 | 0 | 0 | 0 | 0 | 0 |
| 1672 | RTA00000423F.e.21.1 | 66961 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1673 | RTA00000419F.j.22.1 | 73525 | 1 | 0 | 0 | 0 | 0 | 0 | 0 | 0 |
| 1674 | RTA00000410F.d.18.1 | 75458 | 1 | 0 | 0 | 0 | 0 | 0 | 0 | 0 |
| 1675 | RTA00000403F.b.24.1 | 78838 | 1 | 0 | 0 | 0 | 0 | 0 | 0 | 0 |
| 1677 | RTA00000410F.e.09.1 | 76093 | 1 | 0 | 0 | 0 | 0 | 0 | 0 | 0 |
| 1680 | RTA00000353R.h.10.1 | 39498 | 2 | 0 | 0 | 0 | 0 | 0 | 0 | 0 |
| 1682 | RTA00000411F.d.21.1 | 74794 | 1 | 0 | 0 | 0 | 0 | 0 | 0 | 0 |
| 1683 | RTA00000340F.m.04.1 | 19406 | 2 | 1 | 0 | 0 | 0 | 0 | 0 | 0 |
| 1684 | RTA00000411F.n.09.1 | 78962 | 1 | 0 | 0 | 0 | 0 | 0 | 0 | 0 |
| 1685 | RTA00000127A.h.22.2 | 13155 | 2 | 3 | 0 | 0 | 0 | 0 | 0 | 0 |
| 1686 | RTA00000420F.e.09.1 | 66325 | 1 | 0 | 0 | 0 | 0 | 0 | 0 | 0 |
| 1687 | RTA00000405F.p.03.1 | 11346 | 3 | 3 | 0 | 0 | 0 | 0 | 0 | 0 |
| 1688 | RTA00000419F.a.18.1 | 78484 | 1 | 0 | 0 | 0 | 0 | 0 | 0 | 0 |
| 1691 | RTA00000121A.n.23.1 | 26981 | 2 | 0 | 0 | 0 | 0 | 0 | 0 | 0 |
| 1692 | RTA00000121A.n.15.1 | 40849 | 1 | 1 | 0 | 0 | 0 | 0 | 0 | 0 |
| 1693 | RTA00000403F.i.23.1 | 11364 | 4 | 2 | 0 | 0 | 0 | 0 | 0 | 0 |
| 1694 | RTA00000405F.a.03.1 | 39065 | 2 | 0 | 0 | 0 | 0 | 0 | 0 | 0 |
| 1696 | RTA00000419F.p.08.1 | 65560 | 1 | 0 | 0 | 0 | 0 | 0 | 0 | 0 |
| 1697 | RTA00000126A.n.6.2 | 79917 | 1 | 0 | 0 | 0 | 0 | 0 | 0 | 0 |
| 1698 | RTA00000413F.c.03.1 | 64527 | 1 | 0 | 0 | 1 | 0 | 0 | 0 | 0 |
| 1699 | RTA00000422F.k.24.1 | 39118 | 2 | 0 | 0 | 0 | 0 | 0 | 0 | 0 |
| 1700 | RTA00000412F.c.17.1 | 75620 | 1 | 0 | 0 | 0 | 0 | 0 | 0 | 0 |
| 1702 | RTA00000347F.g.08.1 | 23121 | 3 | 0 | 0 | 0 | 0 | 0 | 0 | 0 |
| 1703 | RTA00000419F.o.06.1 | 64643 | 1 | 0 | 0 | 0 | 0 | 0 | 0 | 0 |
| 1704 | RTA00000340R.j.07.1 | 38954 | 2 | 0 | 0 | 0 | 0 | 0 | 0 | 0 |
| 1705 | RTA00000423F.j.02.1 | 38617 | 2 | 0 | 0 | 0 | 0 | 0 | 0 | 0 |
| 1706 | RTA00000419F.c.04.1 | 63749 | 1 | 0 | 0 | 0 | 0 | 0 | 0 | 0 |
| 1707 | RTA00000411F.a.01.1 | 74524 | 1 | 0 | 0 | 0 | 0 | 0 | 0 | 0 |
| 1708 | RTA00000406F.f.05.1 | 22961 | 2 | 1 | 0 | 0 | 0 | 0 | 1 | 0 |
| 1709 | RTA00000410F.n.05.1 | 77830 | 1 | 0 | 0 | 0 | 0 | 0 | 0 | 0 |
| 1710 | RTA00000404F.e.06.1 | 39315 | 2 | 0 | 0 | 0 | 0 | 0 | 0 | 0 |
| 1712 | RTA00000411F.c.03.1 | 79280 | 1 | 0 | 0 | 0 | 0 | 0 | 0 | 0 |
| 1718 | RTA00000405F.l.07.1 | 38636 | 2 | 0 | 0 | 0 | 0 | 0 | 0 | 0 |
| 1720 | RTA00000411F.n.06.1 | 73886 | 1 | 0 | 0 | 0 | 0 | 0 | 0 | 0 |
| 1721 | RTA00000422F.k.15.1 | 19253 | 2 | 0 | 0 | 0 | 0 | 0 | 0 | 0 |
| 1722 | RTA00000406F.h.16.1 | 38618 | 2 | 0 | 0 | 0 | 0 | 0 | 0 | 0 |
| 1723 | RTA00000419F.f.24.1 | 18717 | 1 | 1 | 0 | 0 | 0 | 0 | 0 | 0 |
| 1724 | RTA00000411F.d.18.1 | 76063 | 1 | 0 | 0 | 0 | 0 | 0 | 0 | 0 |
| 1727 | RTA00000408F.d.15.1 | 78467 | 1 | 0 | 0 | 0 | 0 | 0 | 0 | 0 |
| 1728 | RTA00000339F.b.22.1 | 6867 | 7 | 3 | 0 | 0 | 0 | 0 | 0 | 0 |
| 1730 | RTA00000411F.n.02.1 | 78049 | 1 | 0 | 0 | 0 | 0 | 0 | 0 | 0 |
| 1731 | RTA00000419F.b.17.1 | 63261 | 1 | 0 | 0 | 0 | 0 | 0 | 0 | 0 |
| 1733 | RTA00000130A.e.20.1 | 79502 | 1 | 0 | 0 | 0 | 0 | 0 | 0 | 0 |
| 1735 | RTA00000411F.i.13.1 | 66138 | 1 | 0 | 0 | 0 | 0 | 0 | 0 | 0 |
| 1736 | RTA00000420F.e.20.1 | 64762 | 1 | 0 | 0 | 0 | 0 | 0 | 0 | 0 |
| 1737 | RTA00000126A.p.23.2 | 80915 | 1 | 0 | 0 | 0 | 0 | 0 | 0 | 0 |
| 1739 | RTA00000406F.g.08.1 | 37963 | 2 | 0 | 0 | 0 | 0 | 0 | 0 | 0 |
| 1740 | RTA00000409F.a.08.1 | 74978 | 1 | 0 | 0 | 0 | 0 | 0 | 0 | 0 |
| 1741 | RTA00000406F.d.24.1 | 37997 | 2 | 0 | 0 | 0 | 0 | 0 | 0 | 0 |
| 1744 | RTA00000418F.i.12.1 | 78971 | 1 | 0 | 0 | 0 | 0 | 0 | 0 | 0 |
| 1745 | RTA00000121A.h.19.1 | 80334 | 1 | 0 | 0 | 0 | 0 | 0 | 0 | 0 |
| 1746 | RTA00000419F.b.10.1 | 78566 | 1 | 0 | 0 | 0 | 0 | 0 | 0 | 0 |
| 1747 | RTA00000406F.m.10.1 | 38004 | 2 | 0 | 0 | 0 | 0 | 0 | 0 | 0 |
| 1748 | RTA00000406F.o.05.1 | 37894 | 2 | 0 | 0 | 0 | 0 | 0 | 0 | 0 |
| 1749 | RTA00000408F.b.04.2 | 39933 | 2 | 0 | 0 | 0 | 0 | 0 | 0 | 0 |
| 1750 | RTA00000411F.k.04.1 | 65407 | 1 | 0 | 0 | 0 | 0 | 0 | 0 | 0 |
| 1752 | RTA00000134A.l.9.1 | 81814 | 1 | 0 | 0 | 0 | 0 | 0 | 0 | 0 |
| 1754 | RTA00000418F.k.04.1 | 75864 | 1 | 0 | 0 | 0 | 0 | 0 | 0 | 0 |
| 1757 | RTA00000419F.p.18.1 | 63002 | 1 | 0 | 0 | 0 | 0 | 0 | 0 | 0 |
| 1759 | RTA00000419F.a.24.1 | 79290 | 1 | 0 | 0 | 0 | 0 | 0 | 0 | 0 |
| 1761 | RTA00000129A.e.14.1 | 80053 | 1 | 0 | 0 | 0 | 0 | 0 | 0 | 0 |
| 1762 | RTA00000404F.a.01.1 | 19251 | 2 | 0 | 0 | 0 | 0 | 0 | 0 | 0 |
| 1765 | RTA00000408F.n.16.2 | 73720 | 1 | 0 | 0 | 0 | 0 | 0 | 0 | 0 |
| 1769 | RTA00000412F.l.14.1 | 62792 | 1 | 0 | 0 | 0 | 0 | 0 | 0 | 0 |
| 1770 | RTA00000129A.b.6.2 | 39111 | 2 | 0 | 0 | 0 | 0 | 0 | 0 | 0 |
| 1771 | RTA00000406F.n.12.1 | 37517 | 2 | 0 | 0 | 0 | 0 | 0 | 0 | 0 |
| 1772 | RTA00000418F.e.03.1 | 73442 | 1 | 0 | 0 | 0 | 0 | 0 | 0 | 0 |
| 1774 | RTA00000403F.g.03.1 | 23537 | 2 | 1 | 0 | 0 | 0 | 0 | 0 | 0 |
| 1775 | RTA00000412F.p.06.1 | 65485 | 1 | 0 | 0 | 0 | 0 | 0 | 0 | 0 |
| 1776 | RTA00000419F.b.21.1 | 65366 | 1 | 0 | 0 | 0 | 0 | 0 | 0 | 0 |
| 1779 | RTA00000351R.j.16.1 | 64773 | 1 | 0 | 0 | 0 | 0 | 0 | 0 | 0 |
| 1781 | RTA00000419F.f.18.1 | 64047 | 1 | 0 | 0 | 0 | 0 | 0 | 0 | 0 |
| 1782 | RTA00000423F.i.16.1 | 38604 | 2 | 0 | 0 | 0 | 0 | 0 | 0 | 0 |
| 1784 | RTA00000411F.f.04.1 | 64526 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1785 | RTA00000125A.c.17.1 | 80619 | 1 | 0 | 0 | 0 | 0 | 0 | 0 | 0 |
| 1786 | RTA00000404F.g.08.1 | 38980 | 2 | 0 | 0 | 0 | 0 | 0 | 0 | 0 |
| 1787 | RTA00000423F.c.13.1 | 39059 | 2 | 0 | 0 | 0 | 0 | 0 | 0 | 0 |
| 1790 | RTA00000404F.k.15.1 | 18225 | 2 | 0 | 0 | 0 | 0 | 0 | 0 | 0 |
| 1792 | RTA00000339F.l.12.1 | 7711 | 4 | 1 | 0 | 0 | 0 | 0 | 0 | 0 |
| 1793 | RTA00000406F.b.01.1 | 39006 | 2 | 0 | 0 | 0 | 0 | 0 | 0 | 0 |
| 1794 | RTA00000407F.c.08.1 | 37549 | 2 | 0 | 0 | 0 | 0 | 0 | 0 | 0 |
| 1796 | RTA00000403F.b.05.1 | 74300 | 1 | 0 | 0 | 0 | 0 | 0 | 0 | 0 |
| 1800 | RTA00000408F.j.05.2 | 73878 | 1 | 0 | 0 | 0 | 0 | 0 | 0 | 0 |
| 1802 | RTA00000419F.c.14.1 | 65727 | 1 | 0 | 0 | 0 | 0 | 0 | 0 | 0 |
| 1806 | RTA00000346F.h.24.1 | 4379 | 9 | 2 | 0 | 0 | 0 | 0 | 0 | 0 |
| 1807 | RTA00000420F.b.02.1 | 64013 | 1 | 0 | 0 | 0 | 0 | 0 | 0 | 0 |
| 1808 | RTA00000413F.b.24.1 | 65117 | 1 | 0 | 0 | 0 | 0 | 0 | 0 | 0 |
| 1809 | RTA00000412F.d.08.1 | 75328 | 1 | 0 | 0 | 0 | 0 | 0 | 0 | 0 |
| 1811 | RTA00000419F.m.18.1 | 76014 | 1 | 0 | 0 | 0 | 0 | 0 | 0 | 0 |
| 1812 | RTA00000419F.l.24.1 | 74628 | 1 | 0 | 0 | 0 | 0 | 0 | 0 | 0 |
| 1813 | RTA00000408F.c.06.1 | 78619 | 1 | 0 | 0 | 0 | 0 | 0 | 0 | 0 |
| 1814 | RTA00000405F.h.21.2 | 39072 | 2 | 0 | 0 | 0 | 0 | 0 | 0 | 0 |
| 1816 | RTA00000405F.g.05.2 | 38987 | 2 | 0 | 0 | 0 | 0 | 0 | 0 | 0 |
| 1817 | RTA00000411F.f.20.1 | 63501 | 1 | 0 | 0 | 0 | 0 | 0 | 0 | 0 |
| 1819 | RTA00000420F.d.19.1 | 43146 | 1 | 1 | 0 | 0 | 0 | 0 | 0 | 0 |
| 1820 | RTA00000195R.a.06.1 | 35265 | 2 | 0 | 1 | 0 | 0 | 0 | 0 | 0 |
| 1821 | RTA00000123A.f.2.1 | 80379 | 1 | 0 | 0 | 0 | 0 | 0 | 0 | 0 |
| 1822 | RTA00000411F.j.11.1 | 66154 | 1 | 0 | 0 | 0 | 0 | 0 | 0 | 0 |
| 1827 | RTA00000419F.j.03.1 | 77578 | 1 | 0 | 0 | 0 | 0 | 0 | 0 | 0 |
| 1829 | RTA00000423F.h.11.1 | 38977 | 2 | 0 | 0 | 0 | 0 | 0 | 0 | 0 |
| 1830 | RTA00000413F.b.17.1 | 21704 | 1 | 2 | 0 | 0 | 0 | 0 | 0 | 0 |
| 1833 | RTA00000423F.f.03.1 | 63852 | 1 | 0 | 0 | 0 | 0 | 0 | 0 | 0 |
| 1834 | RTA00000419F.e.10.1 | 63225 | 1 | 0 | 0 | 0 | 0 | 0 | 0 | 0 |
| 1836 | RTA00000403F.d.02.1 | 39224 | 2 | 0 | 0 | 0 | 0 | 0 | 0 | 0 |
| 1838 | RTA00000418F.j.20.1 | 77101 | 1 | 0 | 0 | 0 | 0 | 0 | 0 | 0 |
| 1846 | RTA00000356R.h.05.1 | 35052 | 2 | 0 | 1 | 0 | 0 | 0 | 0 | 0 |
| 1848 | RTA00000340F.i.15.1 | 26815 | 1 | 0 | 0 | 0 | 0 | 0 | 0 | 0 |
| 1850 | RTA00000345F.c.12.1 | 23824 | 2 | 1 | 0 | 0 | 0 | 0 | 0 | 0 |
| 1852 | RTA00000412F.o.03.1 | 65039 | 1 | 0 | 0 | 0 | 0 | 0 | 0 | 0 |
| 1853 | RTA00000409F.d.16.1 | 76090 | 1 | 0 | 0 | 0 | 0 | 0 | 0 | 0 |
| 1856 | RTA00000408F.j.17.2 | 78935 | 1 | 0 | 0 | 0 | 0 | 0 | 0 | 0 |
| 1857 | RTA00000126A.j.15.2 | 40425 | 2 | 0 | 0 | 0 | 0 | 0 | 0 | 0 |
| 1861 | RTA00000410F.b.17.1 | 77458 | 1 | 0 | 0 | 0 | 0 | 0 | 0 | 0 |
| 1862 | RTA00000419F.l.22.1 | 78444 | 1 | 0 | 0 | 0 | 0 | 0 | 0 | 0 |
| 1864 | RTA00000422F.f.22.1 | 38703 | 2 | 0 | 0 | 0 | 0 | 0 | 0 | 0 |
| 1867 | RTA00000418F.c.05.1 | 76475 | 1 | 0 | 0 | 0 | 0 | 0 | 0 | 0 |
| 1868 | RTA00000418F.p.21.1 | 78068 | 1 | 0 | 0 | 0 | 0 | 0 | 0 | 0 |
| 1870 | RTA00000340F.i.08.1 | 12005 | 2 | 1 | 0 | 0 | 0 | 0 | 0 | 0 |
| 1871 | RTA00000410F.o.04.1 | 79018 | 1 | 0 | 0 | 0 | 0 | 0 | 0 | 0 |
| 1872 | RTA00000411F.l.16.1 | 16122 | 1 | 3 | 0 | 0 | 0 | 0 | 0 | 0 |
| 1873 | RTA00000411F.j.03.1 | 66263 | 1 | 0 | 0 | 0 | 0 | 0 | 0 | 0 |
| 1874 | RTA00000126A.k.24.1 | 39428 | 2 | 0 | 0 | 0 | 0 | 0 | 0 | 0 |
| 1876 | RTA00000120A.m.10.3 | 81376 | 1 | 0 | 0 | 0 | 0 | 0 | 0 | 0 |
| 1877 | RTA00000419F.f.16.1 | 64679 | 1 | 0 | 0 | 0 | 0 | 0 | 0 | 0 |
| 1878 | RTA00000408F.c.23.1 | 42261 | 1 | 1 | 0 | 0 | 0 | 0 | 0 | 0 |
| 1881 | RTA00000136A.h.6.1 | 81620 | 1 | 0 | 0 | 0 | 0 | 0 | 0 | 0 |
| 1886 | RTA00000418F.e.20.1 | 73741 | 1 | 0 | 0 | 0 | 0 | 0 | 0 | 0 |
| 1888 | RTA00000405F.l.03.1 | 38580 | 2 | 0 | 0 | 0 | 0 | 0 | 0 | 0 |
| 1889 | RTA00000418F.m.02.1 | 74550 | 1 | 0 | 0 | 0 | 0 | 0 | 0 | 0 |
| 1891 | RTA00000406F.c.05.1 | 22077 | 3 | 0 | 1 | 0 | 0 | 0 | 0 | 0 |
| 1893 | RTA00000411F.k.21.1 | 65349 | 1 | 0 | 0 | 0 | 0 | 0 | 0 | 0 |
| 1897 | RTA00000418F.l.06.1 | 75151 | 1 | 0 | 0 | 0 | 0 | 0 | 0 | 0 |
| 1898 | RTA00000423F.a.03.1 | 26796 | 2 | 0 | 0 | 0 | 0 | 0 | 0 | 0 |
| 1900 | RTA00000423F.k.21.2 | 37499 | 2 | 0 | 0 | 0 | 0 | 0 | 0 | 0 |
| 1902 | RTA00000404F.c.18.1 | 38982 | 2 | 0 | 0 | 0 | 0 | 0 | 0 | 0 |
| 1905 | RTA00000411F.g.24.1 | 65233 | 1 | 0 | 0 | 0 | 0 | 0 | 0 | 0 |
| 1907 | RTA00000405F.m.07.1 | 37733 | 2 | 0 | 0 | 0 | 0 | 0 | 0 | 0 |
| 1908 | RTA00000411F.j.07.1 | 66963 | 1 | 0 | 0 | 0 | 0 | 0 | 0 | 0 |
| 1910 | RTA00000353R.h.04.1 | 17123 | 4 | 0 | 0 | 0 | 0 | 0 | 0 | 0 |
| 1911 | RTA00000408F.f.10.2 | 75309 | 1 | 0 | 0 | 0 | 0 | 0 | 0 | 0 |
| 1913 | RTA00000405F.o.03.1 | 37575 | 2 | 0 | 0 | 0 | 0 | 0 | 0 | 0 |
| 1914 | RTA00000413F.b.18.1 | 39873 | 2 | 0 | 0 | 0 | 0 | 0 | 0 | 0 |
| 1920 | RTA00000408F.c.08.1 | 73473 | 1 | 0 | 0 | 0 | 0 | 0 | 0 | 0 |
| 1922 | RTA00000410F.c.06.1 | 77784 | 1 | 0 | 0 | 0 | 1 | 0 | 0 | 0 |
| 1924 | RTA00000405F.b.08.1 | 39182 | 2 | 0 | 0 | 0 | 0 | 0 | 0 | 0 |
| 1925 | RTA00000409F.l.24.1 | 73174 | 1 | 0 | 0 | 0 | 0 | 0 | 0 | 0 |
| 1926 | RTA00000406F.j.06.1 | 38952 | 2 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1927 | RTA00000423F.h.03.1 | 37903 | 2 | 0 | 0 | 0 | 0 | 0 | 0 | 0 |
| 1929 | RTA00000121A.k.22.1 | 79523 | 1 | 0 | 0 | 0 | 0 | 0 | 0 | 0 |
| 1931 | RTA00000411F.m.06.1 | 24195 | 2 | 1 | 0 | 0 | 0 | 0 | 0 | 0 |
| 1932 | RTA00000126A.b.9.1 | 81279 | 1 | 0 | 0 | 0 | 0 | 0 | 0 | 0 |
| 1935 | RTA00000404F.l.05.1 | 38671 | 2 | 0 | 0 | 0 | 0 | 0 | 0 | 0 |
| 1941 | RTA00000419F.p.10.1 | 41448 | 1 | 1 | 0 | 0 | 0 | 0 | 0 | 0 |
| 1942 | RTA00000120A.c.19.1 | 81016 | 1 | 0 | 0 | 0 | 0 | 0 | 0 | 0 |
| 1948 | RTA00000411F.k.14.1 | 63987 | 1 | 0 | 0 | 0 | 0 | 0 | 0 | 0 |
| 1949 | RTA00000420F.e.05.1 | 63908 | 1 | 0 | 0 | 0 | 0 | 0 | 0 | 0 |
| 1952 | RTA00000128A.j.10.1 | 80085 | 1 | 0 | 0 | 0 | 0 | 0 | 0 | 0 |
| 1953 | RTA00000412F.f.10.2 | 65405 | 1 | 0 | 0 | 0 | 0 | 0 | 0 | 0 |
| 1955 | RTA00000422F.k.17.1 | 38955 | 2 | 0 | 0 | 0 | 0 | 0 | 0 | 0 |
| 1957 | RTA00000347F.h.10.1 | 22779 | 3 | 0 | 0 | 0 | 0 | 0 | 0 | 0 |
| 1959 | RTA00000419F.l.02.1 | 75736 | 1 | 0 | 0 | 0 | 0 | 0 | 0 | 0 |
| 1961 | RTA00000418F.b.20.1 | 73560 | 1 | 0 | 0 | 0 | 0 | 0 | 0 | 0 |
| 1964 | RTA00000408F.n.05.2 | 77883 | 1 | 0 | 0 | 0 | 0 | 0 | 0 | 0 |
| 1965 | RTA00000419F.o.09.1 | 66396 | 1 | 0 | 0 | 0 | 0 | 0 | 0 | 0 |
| 1970 | RTA00000422F.o.08.2 | 26832 | 2 | 0 | 0 | 0 | 0 | 0 | 0 | 0 |
| 1973 | RTA00000418F.m.18.1 | 76479 | 1 | 0 | 0 | 0 | 0 | 0 | 0 | 0 |
| 1974 | RTA00000347F.e.20.1 | 39911 | 2 | 0 | 0 | 0 | 0 | 0 | 0 | 0 |
| 1975 | RTA00000419F.e.23.1 | 65772 | 1 | 0 | 0 | 0 | 0 | 0 | 0 | 0 |
| 1982 | RTA00000411F.g.05.1 | 64664 | 1 | 0 | 0 | 0 | 0 | 0 | 0 | 0 |
| 1983 | RTA00000404F.h.10.1 | 37148 | 2 | 0 | 0 | 0 | 0 | 0 | 0 | 0 |
| 1984 | RTA00000422F.n.14.1 | 26787 | 2 | 0 | 0 | 0 | 0 | 0 | 0 | 0 |
| 1986 | RTA00000120A.m.13.3 | 80608 | 1 | 0 | 0 | 0 | 0 | 0 | 0 | 0 |
| 1987 | RTA00000412F.i.03.1 | 65617 | 1 | 0 | 0 | 0 | 0 | 0 | 0 | 0 |
| 1988 | RTA00000418F.l.02.1 | 39316 | 2 | 0 | 0 | 0 | 0 | 0 | 0 | 0 |
| 1990 | RTA00000411F.j.04.1 | 66219 | 1 | 0 | 0 | 0 | 0 | 0 | 0 | 0 |
| 1995 | RTA00000404F.a.18.1 | 36267 | 2 | 0 | 0 | 0 | 0 | 0 | 0 | 0 |
| 1996 | RTA00000408F.l.14.1 | 12001 | 2 | 3 | 0 | 0 | 0 | 0 | 0 | 0 |
| 1997 | RTA00000405F.d.10.1 | 39000 | 2 | 0 | 0 | 0 | 0 | 0 | 0 | 0 |
| 1999 | RTA00000418F.h.23.1 | 75153 | 1 | 0 | 0 | 0 | 0 | 0 | 0 | 0 |
| 2001 | RTA00000418F.j.11.1 | 73853 | 1 | 0 | 0 | 0 | 0 | 0 | 0 | 0 |
| 2002 | RTA00000408F.o.13.1 | 74895 | 1 | 0 | 0 | 0 | 0 | 0 | 0 | 0 |
| 2003 | RTA00000419F.o.07.1 | 14059 | 1 | 0 | 0 | 0 | 0 | 0 | 0 | 0 |
| 2004 | RTA00000419F.n.17.1 | 63186 | 1 | 0 | 0 | 0 | 0 | 0 | 0 | 0 |
| 2005 | RTA00000403F.f.15.1 | 22768 | 3 | 0 | 0 | 0 | 0 | 0 | 0 | 0 |
| 2006 | RTA00000408F.d.03.1 | 22768 | 3 | 0 | 0 | 0 | 0 | 0 | 0 | 0 |
| 2008 | RTA00000346F.f.02.1 | 62757 | 1 | 0 | 0 | 0 | 0 | 0 | 0 | 0 |
| 2010 | RTA00000413F.i.21.1 | 64066 | 1 | 0 | 0 | 0 | 0 | 0 | 0 | 0 |
| 2012 | RTA00000419F.h.21.1 | 64828 | 1 | 0 | 0 | 0 | 0 | 0 | 0 | 0 |
| 2021 | RTA00000121A.a.2.1 | 81843 | 1 | 0 | 0 | 0 | 0 | 0 | 0 | 0 |
| 2022 | RTA00000527F.g.13.1 | 36035 | 2 | 0 | 0 | 0 | 0 | 0 | 0 | 0 |
| 2025 | RTA00000426F.h.11.1 | 75479 | 1 | 0 | 0 | 0 | 0 | 0 | 0 | 0 |
| 2030 | RTA00000522F.b.22.1 | 75181 | 1 | 0 | 0 | 0 | 0 | 0 | 0 | 0 |
| 2033 | RTA00000522F.a.23.1 | 38613 | 2 | 0 | 0 | 0 | 0 | 0 | 0 | 0 |
| 2035 | RTA00000523F.b.02.1 | 65163 | 1 | 0 | 0 | 0 | 0 | 0 | 0 | 0 |
| 2036 | RTA00000425F.j.14.1 | 73397 | 1 | 0 | 0 | 0 | 0 | 0 | 0 | 0 |
| 2039 | RTA00000522F.e.16.1 | 75283 | 1 | 0 | 0 | 0 | 0 | 0 | 0 | 0 |
| 2042 | RTA00000523F.h.17.1 | 65586 | 1 | 0 | 0 | 0 | 0 | 0 | 0 | 0 |
| 2044 | RTA00000522F.p.07.1 | 76888 | 1 | 0 | 0 | 0 | 0 | 0 | 0 | 0 |
| 2045 | RTA00000522F.n.08.1 | 76343 | 1 | 0 | 0 | 0 | 0 | 0 | 0 | 0 |
| 2046 | RTA00000425F.c.06.1 | 78041 | 1 | 0 | 0 | 0 | 0 | 0 | 0 | 0 |
| 2047 | RTA00000427F.h.23.1 | 64297 | 1 | 0 | 0 | 0 | 0 | 0 | 0 | 0 |
| 2048 | RTA00000527F.p.02.1 | 36844 | 2 | 0 | 0 | 0 | 0 | 0 | 0 | 0 |
| 2049 | RTA00000427F.d.08.1 | 63967 | 1 | 0 | 0 | 0 | 0 | 0 | 0 | 0 |
| 2051 | RTA00000426F.m.07.1 | 63504 | 1 | 0 | 0 | 0 | 0 | 0 | 0 | 0 |
| 2052 | RTA00000427F.c.10.1 | 65478 | 1 | 0 | 0 | 0 | 0 | 0 | 0 | 0 |
| 2055 | RTA00000424F.m.15.1 | 73759 | 1 | 0 | 0 | 0 | 0 | 0 | 0 | 0 |
| 2056 | RTA00000426F.f.11.1 | 63102 | 1 | 0 | 0 | 0 | 0 | 0 | 0 | 0 |
| 2058 | RTA00000426F.f.20.1 | 65134 | 1 | 0 | 0 | 0 | 0 | 0 | 0 | 0 |
| 2063 | RTA00000527F.i.19.2 | 38089 | 2 | 0 | 0 | 0 | 0 | 0 | 0 | 0 |
| 2068 | RTA00000523F.e.18.1 | 62898 | 1 | 0 | 0 | 0 | 0 | 0 | 0 | 0 |
| 2069 | RTA00000527F.k.21.1 | 36051 | 2 | 0 | 0 | 0 | 0 | 0 | 0 | 0 |
| 2072 | RTA00000522F.n.02.1 | 74959 | 1 | 0 | 0 | 0 | 0 | 0 | 0 | 0 |
| 2075 | RTA00000425F.f.19.1 | 32635 | 1 | 1 | 0 | 0 | 0 | 0 | 0 | 0 |
| 2076 | RTA00000528F.e.23.1 | 19242 | 3 | 0 | 0 | 0 | 0 | 0 | 0 | 0 |
| 2077 | RTA00000522F.n.16.1 | 26769 | 1 | 0 | 0 | 0 | 0 | 0 | 0 | 0 |
| 2078 | RTA00000427F.c.20.1 | 26527 | 1 | 0 | 0 | 0 | 0 | 0 | 0 | 0 |
| 2079 | RTA00000527F.k.06.1 | 12469 | 3 | 1 | 0 | 0 | 0 | 0 | 0 | 0 |
| 2081 | RTA00000523F.i.06.1 | 66341 | 1 | 0 | 0 | 0 | 0 | 0 | 0 | 0 |
| 2082 | RTA00000427F.f.21.1 | 36853 | 2 | 0 | 0 | 0 | 0 | 0 | 0 | 0 |
| 2083 | RTA00000427F.j.19.1 | 41395 | 1 | 1 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2084 | RTA00000522F.b.01.1 | 75691 | 1 | 0 | 0 | 0 | 0 | 0 | 0 | 0 |
| 2085 | RTA00000424F.i.24.1 | 79101 | 1 | 0 | 0 | 0 | 0 | 0 | 0 | 0 |
| 2086 | RTA00000523F.c.01.1 | 65710 | 1 | 0 | 0 | 0 | 0 | 0 | 0 | 0 |
| 2087 | RTA00000427F.b.15.1 | 66891 | 1 | 0 | 0 | 0 | 0 | 0 | 0 | 0 |
| 2090 | RTA00000522F.j.15.2 | 76535 | 1 | 0 | 0 | 0 | 0 | 0 | 0 | 0 |
| 2093 | RTA00000426F.f.19.1 | 66701 | 1 | 0 | 1 | 0 | 0 | 0 | 0 | 0 |
| 2096 | RTA00000523F.i.22.1 | 64688 | 1 | 0 | 0 | 0 | 0 | 0 | 0 | 0 |
| 2098 | RTA00000425F.i.17.1 | 43213 | 1 | 1 | 0 | 0 | 0 | 0 | 0 | 0 |
| 2101 | RTA00000425F.p.12.1 | 73219 | 1 | 0 | 0 | 0 | 0 | 0 | 0 | 0 |
| 2102 | RTA00000427F.j.07.1 | 64819 | 1 | 0 | 0 | 0 | 0 | 0 | 0 | 0 |
| 2104 | RTA00000527F.i.05.2 | 37481 | 2 | 0 | 0 | 0 | 0 | 0 | 0 | 0 |
| 2107 | RTA00000523F.k.01.1 | 41437 | 1 | 1 | 0 | 0 | 0 | 0 | 0 | 0 |
| 2108 | RTA00000425F.j.11.1 | 76667 | 1 | 0 | 0 | 0 | 0 | 0 | 0 | 0 |
| 2109 | RTA00000424F.b.22.4 | 72971 | 1 | 0 | 0 | 0 | 0 | 0 | 0 | 0 |
| 2111 | RTA00000525F.a.03.1 | 36786 | 2 | 0 | 0 | 0 | 0 | 0 | 0 | 0 |
| 2112 | RTA00000527F.i.21.2 | 37490 | 2 | 0 | 0 | 0 | 0 | 0 | 0 | 0 |
| 2113 | RTA00000424F.a.24.4 | 73951 | 1 | 0 | 0 | 0 | 0 | 0 | 0 | 0 |
| 2114 | RTA00000522F.k.14.1 | 74280 | 1 | 0 | 0 | 0 | 0 | 0 | 0 | 0 |
| 2115 | RTA00000522F.n.05.1 | 73260 | 1 | 0 | 0 | 0 | 0 | 0 | 0 | 0 |
| 2116 | RTA00000523F.c.18.1 | 66179 | 1 | 0 | 0 | 0 | 0 | 0 | 0 | 0 |
| 2117 | RTA00000523F.b.13.1 | 66330 | 1 | 0 | 0 | 0 | 0 | 0 | 0 | 0 |
| 2119 | RTA00000527F.p.16.1 | 23798 | 2 | 1 | 0 | 0 | 0 | 0 | 0 | 0 |
| 2120 | RTA00000425F.c.20.1 | 73581 | 1 | 0 | 0 | 0 | 0 | 0 | 0 | 0 |
| 2121 | RTA00000424F.i.21.1 | 73482 | 1 | 0 | 0 | 0 | 0 | 0 | 0 | 0 |
| 2122 | RTA00000523F.j.19.1 | 65910 | 1 | 0 | 0 | 0 | 0 | 0 | 0 | 0 |
| 2124 | RTA00000424F.b.22.1 | 72971 | 1 | 0 | 0 | 0 | 0 | 0 | 0 | 0 |
| 2125 | RTA00000527F.b.18.1 | 37469 | 2 | 0 | 0 | 0 | 0 | 0 | 0 | 0 |
| 2129 | RTA00000525F.e.16.1 | 36837 | 2 | 0 | 0 | 0 | 0 | 0 | 0 | 0 |
| 2131 | RTA00000522F.d.08.1 | 74284 | 1 | 0 | 0 | 0 | 0 | 0 | 0 | 0 |
| 2134 | RTA00000527F.g.07.1 | 37488 | 2 | 0 | 0 | 0 | 0 | 0 | 0 | 0 |
| 2136 | RTA00000525F.b.05.1 | 21116 | 2 | 1 | 0 | 0 | 0 | 0 | 0 | 0 |
| 2137 | RTA00000425F.n.05.1 | 73965 | 1 | 0 | 0 | 0 | 0 | 0 | 0 | 0 |
| 2138 | RTA00000523F.d.18.1 | 64072 | 1 | 0 | 0 | 0 | 0 | 0 | 0 | 0 |
| 2139 | RTA00000525F.a.02.1 | 37454 | 2 | 0 | 0 | 0 | 0 | 0 | 0 | 0 |
| 2141 | RTA00000426F.h.09.1 | 78797 | 1 | 0 | 0 | 0 | 0 | 0 | 0 | 0 |
| 2144 | RTA00000427F.g.05.1 | 63138 | 1 | 0 | 0 | 0 | 0 | 0 | 0 | 0 |
| 2145 | RTA00000424F.m.12.1 | 77675 | 1 | 0 | 0 | 0 | 0 | 0 | 0 | 0 |
| 2151 | RTA00000427F.h.12.1 | 36894 | 2 | 0 | 0 | 0 | 0 | 0 | 0 | 0 |
| 2152 | RTA00000523F.c.15.1 | 36935 | 2 | 0 | 0 | 0 | 0 | 0 | 0 | 0 |
| 2153 | RTA00000427F.k.17.1 | 64965 | 1 | 0 | 0 | 0 | 0 | 0 | 0 | 0 |
| 2155 | RTA00000424F.c.14.3 | 76614 | 1 | 0 | 0 | 0 | 0 | 0 | 0 | 0 |
| 2156 | RTA00000522F.k.10.2 | 77619 | 1 | 0 | 0 | 0 | 0 | 0 | 0 | 0 |
| 2157 | RTA00000424F.m.22.1 | 72943 | 1 | 0 | 0 | 0 | 0 | 0 | 0 | 0 |
| 2158 | RTA00000527F.h.17.1 | 37799 | 2 | 0 | 0 | 0 | 0 | 0 | 0 | 0 |
| 2159 | RTA00000527F.c.22.1 | 37496 | 2 | 0 | 0 | 0 | 0 | 0 | 0 | 0 |
| 2160 | RTA00000425F.k.22.1 | 78123 | 1 | 0 | 0 | 0 | 0 | 0 | 0 | 0 |
| 2161 | RTA00000424F.m.14.1 | 77491 | 1 | 0 | 0 | 0 | 0 | 0 | 0 | 0 |
| 2162 | RTA00000522F.k.19.1 | 32625 | 1 | 1 | 0 | 0 | 0 | 0 | 0 | 0 |
| 2163 | RTA00000523F.i.18.1 | 64463 | 1 | 0 | 0 | 0 | 0 | 0 | 0 | 0 |
| 2164 | RTA00000425F.j.22.1 | 73882 | 1 | 0 | 0 | 0 | 0 | 0 | 0 | 0 |
| 2165 | RTA00000527F.g.23.1 | 37538 | 2 | 0 | 0 | 0 | 0 | 0 | 0 | 0 |
| 2166 | RTA00000426F.m.24.1 | 63943 | 1 | 0 | 0 | 0 | 0 | 0 | 0 | 0 |
| 2168 | RTA00000425F.d.21.1 | 78920 | 1 | 0 | 0 | 0 | 0 | 0 | 0 | 0 |
| 2170 | RTA00000424F.d.04.3 | 76505 | 1 | 0 | 0 | 0 | 0 | 0 | 0 | 0 |
| 2171 | RTA00000424F.d.04.1 | 76505 | 1 | 0 | 0 | 0 | 0 | 0 | 0 | 0 |
| 2172 | RTA00000427F.c.12.1 | 66995 | 1 | 0 | 0 | 0 | 0 | 0 | 0 | 0 |
| 2174 | RTA00000527F.l.13.1 | 36904 | 2 | 0 | 0 | 0 | 0 | 0 | 0 | 0 |
| 2175 | RTA00000522F.h.13.1 | 40823 | 1 | 1 | 0 | 0 | 0 | 0 | 0 | 0 |
| 2176 | RTA00000424F.l.19.1 | 75454 | 1 | 0 | 0 | 0 | 0 | 0 | 0 | 0 |
| 2179 | RTA00000427F.a.06.1 | 66550 | 1 | 0 | 0 | 0 | 0 | 0 | 0 | 0 |
| 2180 | RTA00000525F.c.19.1 | 38159 | 2 | 0 | 0 | 0 | 0 | 0 | 0 | 0 |
| 2181 | RTA00000523F.f.06.1 | 62871 | 1 | 0 | 0 | 0 | 0 | 0 | 0 | 0 |
| 2182 | RTA00000424F.h.10.1 | 72925 | 1 | 0 | 0 | 0 | 0 | 0 | 0 | 0 |
| 2183 | RTA00000522F.a.12.1 | 33515 | 1 | 1 | 0 | 0 | 0 | 0 | 0 | 0 |
| 2184 | RTA00000522F.h.01.1 | 75010 | 1 | 0 | 0 | 0 | 0 | 0 | 0 | 0 |
| 2186 | RTA00000425F.e.21.1 | 77203 | 1 | 0 | 0 | 0 | 0 | 0 | 0 | 0 |
| 2187 | RTA00000523F.f.07.1 | 62799 | 1 | 0 | 0 | 0 | 0 | 0 | 0 | 0 |
| 2189 | RTA00000424F.j.12.1 | 73827 | 1 | 0 | 0 | 0 | 0 | 0 | 0 | 0 |
| 2191 | RTA00000523F.d.12.1 | 64888 | 1 | 0 | 0 | 0 | 0 | 0 | 0 | 0 |
| 2192 | RTA00000523F.e.10.1 | 62878 | 1 | 0 | 0 | 0 | 0 | 0 | 0 | 0 |
| 2193 | RTA00000425F.f.11.1 | 79275 | 1 | 0 | 0 | 0 | 0 | 0 | 0 | 0 |
| 2194 | RTA00000426F.m.18.1 | 62974 | 1 | 0 | 0 | 0 | 0 | 0 | 0 | 0 |
| 2197 | RTA00000522F.g.15.1 | 76536 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2198 | RTA00000522F.n.12.1 | 74117 | 1 | 0 | 0 | 0 | 0 | 0 | 0 | 0 |
| 2200 | RTA00000424F.d.10.3 | 73110 | 1 | 0 | 0 | 0 | 0 | 0 | 0 | 0 |
| 2204 | RTA00000527F.c.04.1 | 23090 | 3 | 0 | 0 | 0 | 0 | 0 | 0 | 0 |
| 2206 | RTA00000527F.h.21.1 | 37630 | 2 | 0 | 0 | 0 | 0 | 0 | 0 | 0 |
| 2207 | RTA00000425F.c.07.1 | 76042 | 1 | 0 | 0 | 0 | 0 | 0 | 0 | 0 |
| 2209 | RTA00000525F.c.15.1 | 7692 | 2 | 0 | 0 | 0 | 0 | 0 | 0 | 0 |
| 2210 | RTA00000424F.d.22.3 | 76189 | 1 | 0 | 0 | 0 | 0 | 0 | 0 | 0 |
| 2211 | RTA00000523F.h.12.1 | 65745 | 1 | 0 | 0 | 0 | 0 | 0 | 0 | 0 |
| 2212 | RTA00000522F.g.22.1 | 77504 | 1 | 0 | 0 | 0 | 0 | 0 | 0 | 0 |
| 2215 | RTA00000522F.j.12.2 | 74341 | 1 | 0 | 0 | 0 | 0 | 0 | 0 | 0 |
| 2216 | RTA00000523F.i.08.1 | 65099 | 1 | 0 | 0 | 0 | 0 | 0 | 0 | 0 |
| 2218 | RTA00000425F.j.20.1 | 26760 | 1 | 0 | 0 | 0 | 0 | 0 | 0 | 0 |
| 2220 | RTA00000427F.f.24.1 | 64572 | 1 | 0 | 0 | 0 | 0 | 0 | 0 | 0 |
| 2221 | RTA00000527F.a.13.1 | 37740 | 2 | 0 | 0 | 0 | 0 | 0 | 0 | 0 |
| 2225 | RTA00000424F.a.09.4 | 77833 | 1 | 0 | 0 | 0 | 0 | 0 | 0 | 0 |
| 2227 | RTA00000525F.f.07.1 | 37500 | 2 | 0 | 0 | 0 | 0 | 0 | 0 | 0 |
| 2228 | RTA00000424F.j.07.1 | 79211 | 1 | 0 | 0 | 0 | 0 | 0 | 0 | 0 |
| 2229 | RTA00000424F.m.10.1 | 34251 | 1 | 1 | 0 | 0 | 0 | 0 | 0 | 0 |
| 2231 | RTA00000522F.g.06.1 | 78221 | 1 | 0 | 0 | 0 | 0 | 0 | 0 | 0 |
| 2232 | RTA00000424F.h.03.1 | 74447 | 1 | 0 | 0 | 0 | 0 | 0 | 0 | 0 |
| 2233 | RTA00000424F.n.06.1 | 74737 | 1 | 0 | 0 | 0 | 0 | 0 | 0 | 0 |
| 2234 | RTA00000427F.c.22.1 | 63990 | 1 | 0 | 0 | 0 | 0 | 0 | 0 | 0 |
| 2235 | RTA00000424F.k.12.1 | 77666 | 1 | 0 | 0 | 0 | 0 | 0 | 0 | 0 |
| 2236 | RTA00000425F.f.02.1 | 76982 | 1 | 0 | 0 | 0 | 0 | 0 | 0 | 0 |
| 2237 | RTA00000427F.h.11.1 | 26494 | 1 | 0 | 0 | 0 | 0 | 0 | 0 | 0 |
| 2238 | RTA00000425F.j.16.1 | 75631 | 1 | 0 | 0 | 0 | 0 | 0 | 0 | 0 |
| 2240 | RTA00000427F.f.17.1 | 63803 | 1 | 0 | 0 | 0 | 0 | 0 | 0 | 0 |
| 2241 | RTA00000522F.o.18.1 | 76366 | 1 | 0 | 0 | 0 | 0 | 0 | 0 | 0 |
| 2242 | RTA00000427F.j.22.1 | 66367 | 1 | 0 | 0 | 0 | 0 | 0 | 0 | 0 |
| 2243 | RTA00000426F.p.10.1 | 65845 | 1 | 0 | 0 | 0 | 0 | 0 | 0 | 0 |
| 2244 | RTA00000522F.m.02.1 | 76834 | 1 | 0 | 0 | 0 | 0 | 0 | 0 | 0 |
| 2247 | RTA00000425F.e.15.1 | 75921 | 1 | 0 | 0 | 0 | 0 | 0 | 0 | 0 |
| 2250 | RTA00000424F.n.13.1 | 74942 | 1 | 0 | 0 | 0 | 0 | 0 | 0 | 0 |
| 2251 | RTA00000424F.g.14.1 | 74879 | 1 | 0 | 0 | 0 | 0 | 0 | 0 | 0 |
| 2252 | RTA00000426F.e.17.1 | 64089 | 1 | 0 | 0 | 0 | 0 | 0 | 0 | 0 |
| 2256 | RTA00000427F.g.19.1 | 64611 | 1 | 0 | 0 | 0 | 0 | 0 | 0 | 0 |
| 2258 | RTA00000522F.c.01.1 | 74938 | 1 | 0 | 0 | 0 | 0 | 0 | 0 | 0 |
| 2259 | RTA00000522F.g.17.1 | 76486 | 1 | 0 | 0 | 0 | 0 | 0 | 0 | 0 |
| 2260 | RTA00000523F.j.17.1 | 63610 | 1 | 0 | 0 | 0 | 0 | 0 | 0 | 0 |
| 2261 | RTA00000522F.n.14.1 | 73410 | 1 | 0 | 0 | 0 | 0 | 0 | 1 | 0 |
| 2263 | RTA00000523F.e.20.1 | 65164 | 1 | 0 | 0 | 0 | 0 | 0 | 0 | 0 |
| 2264 | RTA00000424F.c.15.3 | 73533 | 1 | 0 | 0 | 0 | 0 | 0 | 0 | 0 |
| 2265 | RTA00000426F.p.09.1 | 66665 | 1 | 0 | 0 | 0 | 0 | 0 | 0 | 0 |
| 2266 | RTA00000522F.p.09.1 | 75204 | 1 | 0 | 0 | 0 | 0 | 0 | 0 | 0 |
| 2267 | RTA00000426F.m.21.1 | 64915 | 1 | 0 | 0 | 0 | 0 | 0 | 0 | 0 |
| 2268 | RTA00000425F.j.21.1 | 77373 | 1 | 0 | 0 | 0 | 0 | 0 | 0 | 0 |
| 2270 | RTA00000523F.h.21.1 | 41440 | 1 | 1 | 0 | 0 | 0 | 0 | 0 | 0 |
| 2271 | RTA00000427F.h.24.1 | 65193 | 1 | 0 | 0 | 0 | 0 | 0 | 0 | 0 |
| 2272 | RTA00000425F.f.24.1 | 40841 | 1 | 1 | 0 | 0 | 0 | 0 | 0 | 0 |
| 2273 | RTA00000425F.m.03.1 | 76045 | 1 | 0 | 0 | 0 | 0 | 0 | 0 | 0 |
| 2274 | RTA00000426F.m.08.1 | 63781 | 1 | 0 | 0 | 0 | 0 | 0 | 0 | 0 |
| 2275 | RTA00000523F.d.24.1 | 64799 | 1 | 0 | 0 | 0 | 0 | 0 | 0 | 0 |
| 2276 | RTA00000523F.c.14.1 | 66015 | 1 | 0 | 0 | 0 | 0 | 0 | 0 | 0 |
| 2277 | RTA00000523F.b.20.1 | 66492 | 1 | 0 | 0 | 0 | 0 | 0 | 0 | 0 |
| 2278 | RTA00000522F.h.07.1 | 75149 | 1 | 0 | 0 | 0 | 0 | 0 | 0 | 0 |
| 2279 | RTA00000527F.g.10.1 | 37820 | 2 | 0 | 0 | 0 | 0 | 0 | 0 | 0 |
| 2282 | RTA00000427F.i.22.1 | 63199 | 1 | 0 | 0 | 0 | 0 | 0 | 0 | 0 |
| 2284 | RTA00000527F.n.07.1 | 15939 | 2 | 2 | 0 | 0 | 0 | 0 | 0 | 0 |
| 2285 | RTA00000425F.e.09.1 | 75550 | 1 | 0 | 0 | 0 | 0 | 0 | 0 | 0 |
| 2286 | RTA00000427F.h.02.1 | 63652 | 1 | 0 | 0 | 0 | 0 | 0 | 0 | 0 |
| 2287 | RTA00000426F.f.16.1 | 65613 | 1 | 0 | 0 | 0 | 0 | 0 | 0 | 0 |
| 2288 | RTA00000425F.i.21.1 | 75305 | 1 | 0 | 0 | 0 | 0 | 0 | 0 | 0 |
| 2289 | RTA00000427F.k.19.1 | 62851 | 1 | 0 | 0 | 0 | 0 | 0 | 0 | 0 |
| 2291 | RTA00000426F.g.16.1 | 41446 | 1 | 1 | 0 | 0 | 0 | 0 | 0 | 0 |
| 2292 | RTA00000527F.l.05.1 | 13016 | 4 | 0 | 0 | 1 | 1 | 0 | 0 | 0 |
| 2293 | RTA00000426F.m.02.1 | 66237 | 1 | 0 | 0 | 0 | 0 | 0 | 0 | 0 |
| 2296 | RTA00000522F.l.22.1 | 75801 | 1 | 0 | 0 | 0 | 0 | 0 | 0 | 0 |
| 2297 | RTA00000427F.h.19.1 | 63047 | 1 | 0 | 0 | 0 | 0 | 0 | 0 | 0 |
| 2299 | RTA00000522F.g.21.1 | 77310 | 1 | 0 | 0 | 0 | 0 | 0 | 0 | 0 |
| 2301 | RTA00000522F.g.20.1 | 77688 | 1 | 0 | 0 | 0 | 0 | 0 | 0 | 0 |
| 2304 | RTA00000425F.k.20.1 | 74048 | 1 | 0 | 0 | 0 | 0 | 0 | 0 | 0 |
| 2306 | RTA00000522F.b.07.1 | 78634 | 1 | 0 | 0 | 0 | 0 | 0 | 0 | 0 |
| 2307 | RTA00000426F.g.19.1 | 63672 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2308 | RTA00000525F.d.19.1 | 36860 | 2 | 0 | 0 | 0 | 0 | 0 | 0 | 0 |
| 2310 | RTA00000427F.d.10.1 | 40685 | 1 | 1 | 0 | 0 | 0 | 0 | 0 | 0 |
| 2313 | RTA00000424F.a.05.4 | 77976 | 1 | 0 | 0 | 0 | 0 | 0 | 0 | 0 |
| 2315 | RTA00000424F.a.05.1 | 77976 | 1 | 0 | 0 | 0 | 0 | 0 | 0 | 0 |
| 2316 | RTA00000522F.l.15.1 | 74691 | 1 | 0 | 0 | 0 | 0 | 0 | 0 | 0 |
| 2317 | RTA00000425F.e.02.1 | 76143 | 1 | 0 | 0 | 0 | 0 | 0 | 0 | 0 |
| 2318 | RTA00000525F.c.11.1 | 37895 | 2 | 0 | 0 | 0 | 0 | 0 | 0 | 0 |
| 2320 | RTA00000522F.c.14.1 | 75449 | 1 | 0 | 0 | 0 | 0 | 0 | 0 | 0 |
| 2321 | RTA00000424F.m.08.1 | 19402 | 1 | 2 | 0 | 0 | 0 | 0 | 0 | 0 |
| 2322 | RTA00000527F.f.18.1 | 37577 | 2 | 0 | 0 | 0 | 0 | 0 | 0 | 0 |
| 2324 | RTA00000522F.a.06.1 | 73662 | 1 | 0 | 0 | 0 | 0 | 0 | 0 | 0 |
| 2327 | RTA00000522F.d.23.1 | 73868 | 1 | 0 | 0 | 0 | 0 | 0 | 0 | 0 |
| 2330 | RTA00000523F.j.10.1 | 63384 | 1 | 0 | 0 | 0 | 0 | 0 | 0 | 0 |
| 2331 | RTA00000527F.p.08.1 | 36013 | 2 | 0 | 0 | 0 | 0 | 0 | 0 | 0 |
| 2333 | RTA00000426F.f.17.1 | 66334 | 1 | 0 | 0 | 0 | 0 | 0 | 0 | 0 |
| 2334 | RTA00000523F.j.21.1 | 36925 | 2 | 0 | 0 | 0 | 0 | 0 | 0 | 0 |
| 2339 | RTA00000523F.a.01.1 | 74923 | 1 | 0 | 0 | 0 | 0 | 0 | 0 | 0 |
| 2341 | RTA00000427F.j.06.1 | 63676 | 1 | 0 | 0 | 0 | 0 | 0 | 0 | 0 |
| 2342 | RTA00000424F.m.04.1 | 79017 | 1 | 0 | 0 | 0 | 0 | 0 | 0 | 0 |
| 2343 | RTA00000523F.i.17.1 | 65779 | 1 | 0 | 0 | 0 | 0 | 0 | 0 | 0 |
| 2346 | RTA00000525F.c.18.1 | 24208 | 2 | 1 | 0 | 0 | 0 | 0 | 0 | 0 |
| 2347 | RTA00000527F.e.09.1 | 37521 | 2 | 0 | 0 | 0 | 0 | 0 | 0 | 0 |
| 2348 | RTA00000424F.j.08.1 | 73972 | 1 | 0 | 0 | 0 | 0 | 0 | 0 | 0 |
| 2350 | RTA00000527F.c.09.1 | 64859 | 1 | 0 | 0 | 0 | 0 | 0 | 0 | 0 |
| 2353 | RTA00000523F.c.03.1 | 36913 | 2 | 0 | 0 | 0 | 0 | 0 | 0 | 0 |
| 2354 | RTA00000427F.k.21.1 | 62880 | 1 | 0 | 0 | 0 | 0 | 0 | 0 | 0 |
| 2356 | RTA00000427F.d.09.1 | 66486 | 1 | 0 | 0 | 0 | 0 | 0 | 0 | 0 |
| 2357 | RTA00000426F.n.17.1 | 66572 | 1 | 0 | 0 | 0 | 0 | 0 | 0 | 0 |
| 2360 | RTA00000426F.m.03.1 | 66480 | 1 | 0 | 0 | 0 | 0 | 0 | 0 | 0 |
| 2361 | RTA00000424F.h.06.1 | 77552 | 1 | 0 | 0 | 0 | 0 | 0 | 0 | 0 |
| 2362 | RTA00000425F.d.06.1 | 77660 | 1 | 0 | 0 | 0 | 0 | 0 | 0 | 0 |
| 2363 | RTA00000427F.e.12.1 | 62813 | 1 | 0 | 0 | 0 | 0 | 0 | 0 | 0 |
| 2366 | RTA00000426F.n.23.1 | 18176 | 1 | 0 | 0 | 0 | 0 | 0 | 0 | 0 |
| 2367 | RTA00000522F.m.19.1 | 41544 | 1 | 1 | 0 | 0 | 0 | 0 | 0 | 0 |
| 2368 | RTA00000522F.a.05.1 | 32611 | 1 | 1 | 0 | 0 | 0 | 0 | 0 | 0 |
| 2369 | RTA00000427F.i.09.1 | 65916 | 1 | 0 | 0 | 0 | 0 | 0 | 0 | 0 |
| 2370 | RTA00000424F.j.09.1 | 74387 | 1 | 0 | 0 | 0 | 0 | 0 | 0 | 0 |
| 2371 | RTA00000424F.n.11.1 | 73874 | 1 | 0 | 0 | 0 | 0 | 0 | 0 | 0 |
| 2373 | RTA00000527F.e.13.1 | 37588 | 2 | 0 | 0 | 0 | 0 | 0 | 0 | 0 |
| 2375 | RTA00000425F.j.19.1 | 77925 | 1 | 0 | 0 | 0 | 0 | 0 | 0 | 0 |
| 2376 | RTA00000522F.g.12.1 | 78783 | 1 | 0 | 0 | 0 | 0 | 0 | 0 | 0 |
| 2377 | RTA00000523F.a.07.1 | 75804 | 1 | 0 | 0 | 0 | 0 | 0 | 0 | 0 |
| 2378 | RTA00000425F.e.19.1 | 73409 | 1 | 0 | 0 | 0 | 0 | 0 | 0 | 0 |
| 2379 | RTA00000425F.n.19.1 | 78324 | 1 | 0 | 0 | 0 | 0 | 0 | 0 | 0 |
| 2384 | RTA00000427F.k.07.1 | 63742 | 1 | 0 | 0 | 0 | 0 | 0 | 0 | 0 |
| 2387 | RTA00000522F.a.17.1 | 79032 | 1 | 0 | 0 | 0 | 0 | 0 | 0 | 0 |
| 2388 | RTA00000527F.l.19.1 | 36856 | 2 | 0 | 0 | 0 | 0 | 0 | 0 | 0 |
| 2389 | RTA00000424F.i.11.1 | 41569 | 1 | 1 | 0 | 0 | 0 | 0 | 0 | 0 |
| 2391 | RTA00000424F.d.19.3 | 73180 | 1 | 0 | 0 | 0 | 0 | 0 | 0 | 0 |
| 2392 | RTA00000522F.j.09.2 | 78522 | 1 | 0 | 0 | 0 | 0 | 0 | 0 | 0 |
| 2393 | RTA00000424F.m.24.1 | 77045 | 1 | 0 | 0 | 0 | 0 | 0 | 0 | 0 |
| 2394 | RTA00000522F.j.19.2 | 76224 | 1 | 0 | 0 | 0 | 0 | 0 | 0 | 0 |
| 2398 | RTA00000527F.j.12.2 | 37503 | 2 | 0 | 0 | 0 | 0 | 0 | 0 | 0 |
| 2399 | RTA00000522F.g.11.1 | 75432 | 1 | 0 | 0 | 0 | 0 | 0 | 0 | 0 |
| 2400 | RTA00000522F.k.02.2 | 77622 | 1 | 0 | 0 | 0 | 0 | 0 | 0 | 0 |
| 2401 | RTA00000427F.e.13.1 | 66080 | 1 | 0 | 0 | 0 | 0 | 0 | 0 | 0 |
| 2402 | RTA00000426F.f.18.1 | 63271 | 1 | 0 | 0 | 0 | 0 | 0 | 0 | 0 |
| 2403 | RTA00000427F.a.12.1 | 63377 | 1 | 0 | 0 | 0 | 0 | 0 | 0 | 0 |
| 2404 | RTA00000424F.b.23.4 | 77322 | 1 | 0 | 0 | 0 | 0 | 0 | 0 | 0 |
| 2408 | RTA00000427F.f.02.1 | 36822 | 2 | 0 | 0 | 0 | 0 | 0 | 0 | 0 |
| 2410 | RTA00000424F.i.15.1 | 78043 | 1 | 0 | 0 | 0 | 0 | 0 | 0 | 0 |
| 2412 | RTA00000522F.m.03.1 | 79194 | 1 | 0 | 0 | 0 | 0 | 0 | 0 | 0 |
| 2413 | RTA00000522F.a.20.1 | 74070 | 1 | 0 | 0 | 0 | 0 | 0 | 0 | 0 |
| 2414 | RTA00000424F.b.15.4 | 74958 | 1 | 0 | 0 | 0 | 0 | 0 | 0 | 0 |
| 2415 | RTA00000527F.g.14.1 | 37532 | 2 | 0 | 0 | 0 | 0 | 0 | 0 | 0 |
| 2416 | RTA00000522F.d.06.1 | 74809 | 1 | 0 | 0 | 0 | 0 | 0 | 0 | 0 |
| 2418 | RTA00000427F.e.10.1 | 64599 | 1 | 0 | 0 | 0 | 0 | 0 | 0 | 0 |
| 2419 | RTA00000527F.c.16.1 | 22908 | 3 | 0 | 0 | 0 | 0 | 0 | 0 | 0 |
| 2421 | RTA00000523F.f.17.1 | 63984 | 1 | 0 | 0 | 0 | 0 | 0 | 0 | 0 |
| 2423 | RTA00000527F.p.24.1 | 36832 | 2 | 0 | 0 | 0 | 0 | 0 | 0 | 0 |
| 2424 | RTA00000425F.n.17.1 | 78304 | 1 | 0 | 0 | 0 | 0 | 0 | 0 | 0 |
| 2426 | RTA00000425F.e.07.1 | 75992 | 1 | 0 | 0 | 0 | 0 | 0 | 0 | 0 |
| 2428 | RTA00000523F.h.08.1 | 62893 | 1 | 0 | 0 | 0 | 0 | 0 | 0 | 0 |

TABLE 19-continued

Polynucleotides Specifically Expressed in C I n

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2429 | RTA00000522F.o.10.1 | 78798 | 1 | 0 | 0 | 0 | 0 | 0 | 0 | 0 |
| 2430 | RTA00000425F.l.10.1 | 26893 | 1 | 0 | 0 | 0 | 0 | 0 | 0 | 0 |
| 2431 | RTA00000427F.f.16.1 | 64122 | 1 | 0 | 0 | 0 | 0 | 0 | 0 | 0 |
| 2434 | RTA00000425F.i.10.1 | 78736 | 1 | 0 | 0 | 0 | 0 | 0 | 0 | 0 |
| 2435 | RTA00000426F.m.12.1 | 63740 | 1 | 0 | 0 | 0 | 0 | 0 | 0 | 0 |
| 2436 | RTA00000527F.g.12.1 | 37746 | 2 | 0 | 0 | 0 | 0 | 0 | 0 | 0 |
| 2439 | RTA00000425F.i.18.1 | 42255 | 1 | 1 | 0 | 0 | 0 | 0 | 0 | 0 |
| 2441 | RTA00000424F.j.13.1 | 74485 | 1 | 0 | 0 | 0 | 0 | 0 | 0 | 0 |
| 2445 | RTA00000424F.k.10.1 | 73232 | 1 | 0 | 0 | 0 | 0 | 0 | 0 | 0 |
| 2446 | RTA00000522F.i.07.2 | 78377 | 1 | 0 | 0 | 0 | 0 | 0 | 0 | 0 |
| 2448 | RTA00000522F.b.08.1 | 26915 | 1 | 0 | 0 | 0 | 0 | 0 | 0 | 0 |
| 2449 | RTA00000522F.l.08.1 | 78781 | 1 | 0 | 0 | 0 | 0 | 0 | 0 | 0 |
| 2450 | RTA00000525F.a.14.1 | 37566 | 2 | 0 | 0 | 0 | 0 | 0 | 0 | 0 |
| 2451 | RTA00000424F.g.08.1 | 74928 | 1 | 0 | 0 | 0 | 0 | 0 | 0 | 0 |
| 2452 | RTA00000425F.l.09.1 | 75251 | 1 | 0 | 0 | 0 | 0 | 0 | 0 | 0 |
| 2453 | RTA00000522F.o.20.1 | 74853 | 1 | 0 | 0 | 0 | 0 | 0 | 0 | 0 |
| 2454 | RTA00000527F.j.04.2 | 11809 | 3 | 1 | 0 | 0 | 0 | 0 | 0 | 0 |
| 2456 | RTA00000523F.c.13.1 | 40668 | 1 | 1 | 0 | 0 | 0 | 0 | 0 | 0 |
| 2457 | RTA00000427F.i.21.1 | 65540 | 1 | 0 | 0 | 0 | 0 | 0 | 0 | 0 |
| 2459 | RTA00000522F.h.02.1 | 74947 | 1 | 0 | 0 | 0 | 0 | 0 | 0 | 0 |
| 2460 | RTA00000522F.g.10.1 | 74294 | 1 | 0 | 0 | 0 | 0 | 0 | 0 | 0 |
| 2464 | RTA00000425F.k.16.1 | 75282 | 1 | 0 | 0 | 0 | 0 | 0 | 0 | 0 |
| 2465 | RTA00000525F.b.09.1 | 23472 | 2 | 1 | 0 | 0 | 0 | 0 | 0 | 0 |
| 2466 | RTA00000522F.j.08.2 | 76613 | 1 | 0 | 0 | 0 | 0 | 0 | 0 | 0 |
| 2468 | RTA00000523F.f.19.1 | 34169 | 1 | 1 | 0 | 0 | 0 | 0 | 0 | 0 |
| 2469 | RTA00000425F.j.18.1 | 75561 | 1 | 0 | 0 | 0 | 0 | 1 | 0 | 0 |
| 2470 | RTA00000426F.m.04.1 | 36865 | 2 | 0 | 0 | 0 | 0 | 0 | 0 | 0 |
| 2471 | RTA00000527F.g.21.1 | 36028 | 2 | 0 | 0 | 0 | 0 | 0 | 0 | 0 |
| 2473 | RTA00000525F.a.22.1 | 36848 | 2 | 0 | 0 | 0 | 0 | 0 | 0 | 0 |
| 2474 | RTA00000522F.p.22.1 | 73322 | 1 | 0 | 0 | 0 | 0 | 0 | 0 | 0 |
| 2475 | RTA00000424F.d.12.2 | 74342 | 1 | 0 | 0 | 0 | 0 | 0 | 0 | 0 |
| 2476 | RTA00000424F.g.24.1 | 79156 | 1 | 0 | 0 | 0 | 0 | 0 | 0 | 0 |
| 2477 | RTA00000427F.a.10.1 | 65370 | 1 | 0 | 0 | 0 | 0 | 0 | 0 | 0 |
| 2478 | RTA00000426F.h.20.1 | 23187 | 3 | 0 | 0 | 0 | 0 | 0 | 0 | 0 |
| 2479 | RTA00000424F.d.12.3 | 74342 | 1 | 0 | 0 | 0 | 0 | 0 | 0 | 0 |
| 2480 | RTA00000425F.c.03.1 | 74643 | 1 | 0 | 0 | 0 | 0 | 0 | 0 | 0 |
| 2481 | RTA00000523F.f.16.1 | 26522 | 1 | 0 | 0 | 0 | 0 | 0 | 0 | 0 |
| 2482 | RTA00000427F.f.15.1 | 66734 | 1 | 0 | 0 | 0 | 0 | 0 | 0 | 0 |
| 2485 | RTA00000522F.p.18.1 | 76376 | 1 | 0 | 0 | 0 | 0 | 0 | 0 | 0 |
| 2493 | RTA00000522F.g.18.1 | 73226 | 1 | 0 | 0 | 0 | 0 | 0 | 0 | 0 |
| 2495 | RTA00000522F.h.05.1 | 73358 | 1 | 0 | 0 | 0 | 0 | 0 | 0 | 0 |
| 2497 | RTA00000425F.n.16.1 | 18265 | 1 | 0 | 0 | 0 | 0 | 0 | 0 | 0 |
| 2498 | RTA00000527F.l.21.1 | 36439 | 2 | 0 | 0 | 0 | 0 | 0 | 0 | 0 |
| 2501 | RTA00000424F.d.17.3 | 73958 | 1 | 0 | 0 | 0 | 0 | 0 | 0 | 0 |
| 2502 | RTA00000523F.j.02.1 | 62853 | 1 | 0 | 0 | 0 | 0 | 0 | 0 | 0 |

TABLE 21

Clones Deposited on Jan. 22, 1999

| cDNA Library Ref. ATCC No | Library ES17 207064 | Library ES18 207065 | Library ES19 207066 |
|---|---|---|---|
| Clone Names | M00001601A:E09 | M00001594A:D06 | M00003906A:F04 |
| | M00001368A:D07 | M00001613D:H10 | M00003908A:F12 |
| | M00003917A:D02 | M00001596D:E10 | M00003914A:G09 |
| | M00001673A:A04 | M00001592C:G04 | M00003915C:H04 |
| | M00003868B:G11 | M00001599D:A09 | M00003905D:B08 |
| | M00003917C:D03 | M00001619B:A09 | M00003908C:G09 |
| | M00003791C:E09 | M00001593B:E11 | M00003914B:A11 |
| | M00003870A:C05 | M00001605A:E06 | M00003916C:C05 |
| | M00003922A:D02 | M00001608A:D03 | M00003959A:A03 |
| | M00003861C:H02 | M00001616C:A02 | M00003905D:C08 |
| | M00003931B:A11 | M00001617A:D06 | M00003908D:D12 |
| | M00001679D:B05 | M00001595C:E01 | M00003901B:H04 |
| | M00001679C:D05 | M00001616C:A11 | M00004031A:E01 |
| | M00001687A:G01 | M00001608C:E11 | M00004029C:C12 |
| | M00003945A:E09 | M00001610C:E06 | M00003911A:F10 |
| | M00003908A:H09 | M00001612B:D11 | M00003914C:F09 |
| | M00001649B:G12 | M00001618B:E05 | M00003963D:B05 |
| | M00003813D:H12 | M00001621C:C10 | M00003986C:E09 |
| | M00004087C:D03 | M00001647A:H08 | M00004031A:F07 |
| | M00004269B:C08 | M00001631D:B10 | M00003907C:C02 |
| | M00004348A:A02 | M00001608D:E09 | M00003911B:F08 |
| | M00001679C:D01 | M00001641B:C10 | M00003914C:H05 |
| | M00001490A:E11 | M00001641D:E02 | M00003918C:C12 |
| | M00001387A:E10 | M00001630D:H10 | M00003914C:C02 |
| | M00001397B:G03 | M00001585C:D10 | M00003914A:E04 |
| | M00001441D:E04 | M00001560A:H10 | M00003903B:D03 |

TABLE 21-continued

Clones Deposited on Jan. 22, 1999

| cDNA Library Ref. ATCC No | Library ES17 207064 | Library ES18 207065 | Library ES19 207066 |
|---|---|---|---|
| | M00001352C:G09 | M00001573B:C06 | M00003905A:F09 |
| | M00001370D:A12 | M00001660C:D11 | M00003867C:E11 |
| | M00001387B:A06 | M00001641C:C05 | M00003870B:B08 |
| | M00001397C:A10 | M00001578B:B05 | M00003879D:A08 |
| | M00001536D:G02 | M00001587C:C10 | M00003891D:B10 |
| | M00003895C:A10 | M00001590B:C07 | M00003901C:A08 |
| | M00001464B:B03 | M00001554A:E04 | M00003903C:C04 |
| | M00004370A:G05 | M00001570C:G06 | M00003905A:F10 |
| | M00001490B:H11 | M00001576A:B09 | M00003906C:D06 |
| | M00001530B:D10 | M00001582A:H01 | M00003907D:A12 |
| | M00001579C:E09 | M00001582B:E12 | M00003905C:G11 |
| | M00001587A:H03 | M00001615B:F07 | M00003914D:D10 |
| | M00001457C:H12 | M00001571C:A04 | M00003972A:G09 |
| | M00001535C:E01 | M00001573D:D10 | M00003975D:C06 |
| | M00001561D:C05 | M00001576A:F11 | M00003905C:B02 |
| | M00001589A:C01 | M00001579C:G05 | M00003907D:F11 |
| | M00001664D:G07 | M00001582D:A02 | M00003914A:G06 |
| | M00001565A:H09 | M00001589B:E07 | M00003914D:E03 |
| | M00001381C:B08 | M00001575B:B02 | M00003972C:F08 |
| | M00001395C:F11 | M00001578C:G06 | M00003976C:D06 |
| | M00001429D:F11 | M00001591A:B08 | M00003907C:C04 |
| | M00001449A:F01 | M00001607A:F11 | M00003905B:C06 |
| | M00001391C:H02 | M00001579C:E06 | M00004088C:A12 |
| | M00001429D:H12 | M00001661C:F11 | M00004103C:D04 |
| | M00001450A:G11 | M00001650B:C10 | M00004107A:D01 |
| | M00001344B:F12 | M00001654C:E04 | M00004110A:E04 |
| | M00001391D:C06 | M00001656B:A08 | M00004062A:H06 |
| | M00003971A:A06 | M00001662C:B02 | M00004075D:C10 |
| | M00001346A:E04 | M00001653B:D05 | M00004081D:H09 |
| | M00001455C:G07 | M00001661C:F10 | M00004089A:B08 |
| | M00001402D:F02 | M00001663A:C11 | M00004103D:F10 |
| | M00001438D:C06 | M00001669A:C10 | M00004107B:B04 |
| | M00001349B:G05 | M00001651B:B12 | M00004043C:B02 |
| | M00001389C:A08 | M00001653B:E06 | M00004078C:F04 |
| | M00001439B:A10 | M00001659C:F02 | M00004038B:H10 |
| | M00001455B:A09 | M00001661B:F03 | M00004089A:E02 |
| | M00001441B:D11 | M00001663C:F10 | M00004096B:F05 |
| | M00001453A:B01 | M00001669A:G12 | M00004104C:H12 |
| | M00001456D:E08 | M00001674D:C10 | M00004110D:A10 |
| | M00001399A:C03 | M00001651B:E06 | M00004036D:F02 |
| | M00004496C:H03 | M00001651C:C05 | M00004038C:E04 |
| | M00004135D:G02 | M00001657C:C07 | M00004104C:A04 |
| | M00004692A:E07 | M00001662A:C12 | M00004107D:E12 |
| | M00004374D:E10 | M00001663D:C06 | M00004115D:D08 |
| | M00004405D:C04 | M00001590B:C05 | M00003846A:D03 |
| | M00004312B:H07 | M00001483C:C06 | M00004072C:F08 |
| | M00003976A:A10 | M00001653A:G07 | M00004039B:G08 |
| | M00004043A:D02 | M00001625B:C10 | M00003986D:D02 |
| | M00004081C:H06 | M00001626C:D12 | M00003914A:B07 |
| | M00004050D:A06 | M00001634D:D02 | M00003914B:B02 |
| | M00001361B:C07 | M00001641C:C06 | M00003971B:B07 |
| | M00004341B:G03 | M00001642D:F02 | M00003978C:A03 |
| | M00001342B:E01 | M00001647B:E04 | M00003983B:C08 |
| | M00004064D:A11 | M00001632B:E05 | M00004033D:D07 |
| | M00004087A:G08 | M00001639A:C11 | M00004072D:H12 |
| | M00004344B:H04 | M00001642D:G10 | M00004077B:H11 |
| | M00004497A:H03 | M00001624A:G11 | M00004080A:F01 |
| | M00001338C:E10 | M00001626C:G08 | M00004092C:B03 |
| | M00001366D:E12 | M00001672D:D04 | M60004037B:C04 |
| | M00001390D:E03 | M00001639A:H06 | M00004073C:D04 |
| | M00001413B:H09 | M00001662C:A04 | M00004081A:A08 |
| | M00004271B:B06 | M00001641B:D01 | M00004085B:B05 |
| | M00004151D:E03 | M00001673C:A02 | M00004090C:C07 |
| | M00001660B:C04 | M00001650A:A12 | M00004086D:B09 |
| | M00003802D:B11 | M00001659D:D03 | M00004088D:B03 |
| | M00001579C:E08 | M00001661B:B05 | M00004090C:C10 |
| | M00001557D:C08 | M00001671D:E10 | M00004102C:D09 |
| | M00003779B:E12 | M00001652D:A06 | M00004105C:E09 |
| | M00001638A:D10 | M00001654C:D05 | M00004035A:G10 |
| | M00003794A:B03 | M00001656B:A07 | M00003906A:H07 |
| | M00001616C:F07 | M00001647B:C09 | M00004083B:G03 |
| M00001679A:F01 | M00001635A:C06 | M00001675B:E02 |
| M00001604C:E09 | M00001482D:A04 | M00003793C:D09 |
| M00001653B:E09 | M00001485C:B10 | M00003762B:H09 |
| M00001585A:F07 | M00001457D:A07 | M00001694C:F12 |
| M00003811D:A12 | M00001461A:E05 | M00001678D:C11 |
| M00001653C:F12 | M00001477A:G07 | M00001677B:B07 |
| M00001679D:F06 | M00001479D:H03 | M00001677B:A02 |
| M00003751D:B02 | M00001482C:D02 | M00001675B:H03 |
| M00003801A:B10 | M00001484D:G05 | M00003808D:D04 |
| M00003844C:A08 | M00001459B:D03 | M00003752B:C02 |
| M00001636C:C01 | M00001464B:C11 | M00003819D:B11 |
| M00001669C:B01 | M00001511A:A05 | M00001677D:B02 |
| M00003755A:A09 | M00001477B:C02 | M00001694C:G04 |
| M00003798D:H08 | M00001471A:D04 | M00003789C:F06 |
| M00001444C:D05 | M00001485C:H10 | M00001678C:C06 |
| M00004040B:F10 | M00001485D:E05 | M00001675B:D02 |
| M00001355A:C12 | M00001487C:G03 | M00003750C:H05 |
| M00001401A:H07 | M00001514C:B04 | M00001694A:B12 |
| M00001393B:B09 | M00001530C:G10 | M00001677B:H06 |
| M00001409D:F11 | M00001534A:G06 | M00001675C:G01 |
| M00001387B:H07 | M00001539A:C12 | M00001675B:C01 |
| M00001394C:C11 | M00001547C:F11 | M00003857B:F07 |
| M00001344A:H07 | M00001550D:A04 | M00003812B:D07 |
| M00001490C:D07 | M00001460A:F07 | M00001694B:B08 |
| M00003352C:F06 | M00001472C:A01 | M00001677B:E06 |
| M00001476D:003 | M00001481A:A07 | M00004037A:E04 |
| M00001399C:D09 | M00001456D:F05 | M00003870A:H01 |
| M00001347C:G08 | M00001456D:G11 | M00003842C:D11 |
| M00001453D:G12 | M00001477D:F10 | M00003828B:F09 |
| M00001382A:F04 | M00001481A:G06 | M00003856C:H09 |
| M00001392D:H04 | M00001464A:B03 | M00003851A:C10 |
| M00001429C:G12 | M00001469A:G11 | M00003841C:E04 |
| M00001454A:C11 | M00001478B:D07 | M00003837C:G08 |
| M00001517B:G08 | M00001473A:C11 | M00003828B:E07 |
| M00001535A:D02 | M00001457A:G03 | M00003772C:B12 |
| M00001352A:E12 | M00001669B:G02 | M00001677D:F03 |
| M00001381B:F06 | M00001479D:G06 | M00001678B:B12 |
| M00004117A:D11 | M00001473B:B11 | M00001678D:G03 |
| M00004217C:D03 | M00001475A:A12 | M00001675C:F01 |
| M00004270A:F11 | M00001460A:G07 | M00003809A:H04 |
| M00003996A:A06 | M00001464A:D03 | M00003771D:G05 |
| M00004056B:D09 | M00001473D:G01 | M00001678A:F05 |
| M00004142A:B12 | M00001476D:C05 | M00001677B:B06 |
| M00001396B:B03 | M00001484A:A10 | M00003794A:E12 |
| M00001370D:E12 | M00001457C:F02 | M00003771B:E05 |
| M00001390C:C11 | M00001459B:A12 | M00001678A:A11 |
| M00003989A:H11 | M00001464A:E07 | M00003805B:C04 |
| M00001426A:A09 | M00001467A:B03 | M00001680B:E10 |
| M00004498D:D05 | M00001514A:B08 | M00001679B:H07 |
| M00001391B:G12 | M00001464A:B07 | M00003904B:B12 |
| M00001391D:D10 | M00001579A:C03 | M00003856C:B08 |
| M00001376B:A02 | M00001517A:G08 | M00003858D:G06 |
| M00001405B:D07 | M00001530B:G09 | M00003870B:F04 |
| M00001368A:A03 | M00001538A:F12 | M00003871C:B05 |
| M00001392D:B11 | M00001540C:B03 | M00003875A:C04 |
| M00003900D:B10 | M00001547A:F06 | M00003901B:A09 |
| M00001494B:C01 | M00001550A:F07 | M00003901C:D03 |
| M00001352C:A05 | M00001567B:G11 | M00003904C:B06 |
| M00001408B:G06 | M00001572A:A10 | M00003901C:F09 |
| M00004252C:E03 | M00001575B:G01 | M00003904B:B10 |
| M00003901C:A03 | M00001487D:C11 | M00003850D:H11 |
| M00004071D:A10 | M00001577B:A03 | M00003902B:D06 |
| M00001377B:H01 | M00001539D:E10 | M00003879A:C01 |
| M00003939A:A02 | M00001587B:F05 | M00003877D:G05 |
| M00004250D:D10 | M00001560A:F03 | M00003881D:C12 |
| M00004290A:A06 | M00001569B:G11 | M00003903A:H09 |
| M00003911D:B04 | M00001573A:A06 | M00003905A:A06 |
| M00004128B:G01 | M00001575A:A10 | M00003875D:D09 |
| M00004142A:D08 | M00001583A:D01 | M00003879B:A06 |
| M00003977A:E04 | M00001587A:F08 | M00003823D:G05 |
| M00004236C:D10 | M00001590B:B02 | M00003763A:C01 |

TABLE 21-continued

Clones Deposited on Jan. 22, 1999

| cDNA Library Ref. ATCC No | Library ES17 207064 | Library ES18 207065 | Library ES19 207066 |
|---|---|---|---|
| | M00004388B:A08 | M00001553A:E07 | M00003903B:C02 |
| | M00004409B:A11 | M00001560A:H06 | M00003905A:E07 |
| | M00003965A:B11 | M00001589C:A11 | M00003867A:D12 |
| | M00003988A:E10 | M00001538A:C08 | M00003857C:C09 |
| | M00004138A:H09 | M00001531A:H03 | M00003829C:D10 |
| | M00003933C:D06 | M00001548A:G01 | M00003839D:E02 |
| | M00004193C:G11 | M00001531A:H07 | M00003841C:F03 |
| | M00004039C:C01 | M00001542A:E04 | M00003982B:H07 |
| | M00003924B:D04 | M00001487A:F10 | M00003852D:E08 |
| | M00004375C:D01 | M00001503C:G05 | M00003845D:A09 |
| | | M00001511A:G08 | M00003824A:G10 |
| | | M00001539A:H12 | M00003841C:F06 |
| | | M00001542A:F06 | M00003848A:C09 |
| | | M00001549A:F01 | M00003857C:F11 |
| | | M00001514A:A12 | M00003816C:C01 |
| | | M00001516A:D05 | M00003843A:E08 |
| | | M00001546C:C07 | M00003850A:F06 |
| | | M00001549A:H11 | M00003813B:A11 |
| | | M00001538A:D03 | M00003855C:F10 |
| | | M00001544A:C09 | M00003850D:B05 |
| | | M00001546B:F12 | M00003841D:F06 |
| | | M00001550A:D09 | M00003858B:G05 |
| | | M00001487B:F02 | M00003854D:A12 |
| | | M00001513A:G07 | M00003857C:G01 |
| | | M00001530A:F12 | M00003816C:E09 |
| | | M00001538A:D12 | M00003813A:G04 |
| | | M00001587A:G06 | M00003850D:A05 |
| | | M00001551A:D04 | |
| | | M00001485B:C03 | |

TABLE 22

Clones Deposited on Jan. 23, 1999

| cDNA Ref No.; ATCC Accession | cDNA Library Ref ES20 ATCC No. 207067 | cDNA Ref No. ES27 ATCC No. 207074 | cDNA Library Ref ES28 ATCC No. 207075 |
|---|---|---|---|
| Clone Names in Library | M00004891D:A07 | M00001623B:G07 | M00001550D:H02 |
| | M00004118B:C11 | M00001619D:G05 | M00001549C:D02 |
| | M00004105A:B10 | M00001616C:C09 | M00001549A:A09 |
| | M00004099A:F11 | M00001615C:F03 | M00001548A:B11 |
| | M00004037C:D07 | M00001614D:D09 | M00001546C:G10 |
| | M00004033C:C05 | M00001608B:A03 | M00001544C:C06 |
| | M00003983D:A09 | M00001607D:F07 | M00003820B:C05 |
| | M00004029B:H08 | M00001623D:C10 | M00001543A:H12 |
| | M00004927A:A02 | M00001599B:E09 | M00001540C:B10 |
| | M00003983C:F10 | M00001632C:C09 | M00001538B:G05 |
| | M00003980B:C06 | M00001605C:D12 | M00001543C:F01 |
| | M00004033D:B07 | M00001625D:C07 | M00001552D:G08 |
| | M00004034C:E08 | M00001629B:E06 | M00001554B:B07 |
| | M00005100B:H07 | M00001594A:B2 | M00001555A:B01 |
| | M00005136A:D10 | M00001632C:A02 | M00001557A:F01 |
| | M00005173D:H02 | M00001567C:H12 | M00001558A:E11 |
| | M00004891D:C11 | M00001635C:A03 | M00001561C:E11 |
| | M00004101A:F07 | M00001638C:H09 | M00001571D:B11 |
| | M00003982B:B06 | M00001638A:E07 | M00001563B:D11 |
| | M00004108C:E01 | M00001639A:F10 | M00001569C:B06 |
| | M00005136D:B07 | M00001656C:G08 | M00001539B:H06 |
| | M00004118D:A11 | M00001632A:F12 | M00001571B:E03 |
| | M00005102C:C01 | M00001557A:D02 | M00001561D:C11 |
| | M00005177C:A01 | M00001529B:C04 | M00001487C:D06 |
| | M00004927C:H11 | M00001534B:C12 | M00001454B:D08 |
| | M00005174D:B02 | M00001535D:C01 | M00003772D:E10 |
| | M00004027A:D06 | M00001536D:A12 | M00001573C:D03 |

TABLE 22-continued

Clones Deposited on Jan. 23, 1999

| cDNA Ref No.; ATCC Accession | cDNA Library Ref ES20 ATCC No. 207067 | cDNA Ref No. ES27 ATCC No. 207074 | cDNA Library Ref ES28 ATCC No. 207075 |
|---|---|---|---|
| | M00005217A:G10 | M00001540B:C09 | M00001454D:E05 |
| | M00003984A:B06 | M00001540D:D02 | M00001455D:F09 |
| | M00003851C:D07 | M00001541C:B07 | M00001457C:C11 |
| | M00003959C:G06 | M00001546B:B02 | M00001459B:C09 |
| | M00005100B:G11 | M00001575B:C09 | M00001460A:E01 |
| | M00005213C:G01 | M00001554B:C07 | M00001460C:H02 |
| | M00003982B:H07 | M00001578D:C04 | M00001456A:H02 |
| | M00004029C:B03 | M00001557B:H07 | M00001477B:F04 |
| | M00004033D:G06 | M00001558B:D08 | M00003845B:B04 |
| | M00004091B:H09 | M00001560D:A03 | M00001488A:E01 |
| | M00003959D:A04 | M00001561C:F06 | M00001492D:A11 |
| | M00004030D:B06 | M00001564C:D09 | M00001496C:G10 |
| | M00004034C:C06 | M00003748B:F02 | M00001499A:A05 |
| | M00004030C:D12 | M00001570D:A03 | M00001500A:B02 |
| | M00003982C:H10 | M00001660C:B12 | M00001500D:E10 |
| | M00003971C:F09 | M00001577B:H02 | M00001513D:A03 |
| | M00004031B:A06 | M00001548A:A08 | M00001528A:C11 |
| | M00003966B:D02 | M00003868B:D12 | M00001528C:H04 |
| | M00004028B:G08 | M00001718D:F07 | M00001531B:E09 |
| | M00004031C:H10 | M00003829C:A11 | M00001463A:F06 |
| | M00004076B:B09 | M00003832B:E01 | M00003755A:B03 |
| | M00004092D:B11 | M00003842B:D09 | M00001653B:G07 |
| | M00003981C:F05 | M00003845A:H12 | M00001654D:G11 |
| | M00004031D:F05 | M00003847B:003 | M00001656B:A07 |
| | M00004097B:D03 | M00003847C:E09 | M00001664B:D06 |
| | M00003986D:G07 | M00003853D:G08 | M00001664C:H10 |
| | M00004033B:C02 | M00003828A:E04 | M00001680B:C01 |
| | M00004037B:A04 | M00003867C:H09 | M00001681A:F03 |
| | M00004092C:B12 | M00003822A:F02 | M00001684B:G03 |
| | M00005140D:G09 | M00003868C:H10 | M00001771A:A07 |
| | M00004897D:G05 | M00003871A:A05 | M00003774C:D02 |
| | M00004960B:D12 | M00003879C:G10 | M00003754D:D02 |
| | M00005134C:G04 | M00003880C:F10 | M00001640B:F03 |
| | M00005139A:F01 | M00003881D:D06 | M00003763B:H01 |
| | M00005176A:C12 | M00003884D:007 | M00003812C:A05 |
| | M00005178A:A07 | M00003887A:A06 | M00003803C:D09 |
| | M00005212A:A02 | M00003889A:D10 | M00003801B:B10 |
| | M00005229D:H07 | M00003889D:B09 | M00003798D:E03 |
| | M00004115C:H04 | M00003858D:F12 | M00003773B:G01 |
| | M00004687A:C03 | M00003774C:B08 | M00003771A:G10 |
| | M00004900C:E11 | M00001680D:D02 | M00001452A:E07 |
| | M00004695B:E04 | M00001528A:F09 | M00004029B:F11 |
| | M00005134D:A06 | M00003748A:B07 | M00003751B:A05 |
| | M00004103B:B07 | M00001655A:F06 | M00001609B:A11 |
| | M00005177A:B06 | M00003750A:D01 | M00001573D:F10 |
| | M00005178A:A08 | M00003761D:E02 | M00001579C:B11 |
| | M00004104D:B05 | M00003763D:E10 | M00001579C:H10 |
| | M00004117B:G01 | M00003768A:E02 | M00001579D:G07 |
| | M00004900D:B10 | M00003829B:G03 | M00001583B:E10 |
| | M00005134D:H03 | M00003772D:A07 | M00001586D:E02 |
| | M00005173C:A02 | M00001661B:C08 | M00001587A:A10 |
| | M00005177A:H09 | M00003778A:D08 | M00001589A:D12 |
| | M00005178B:H01 | M00003799A:D09 | M00001590C:H08 |
| | M00005216C:B09 | M00003800A:C09 | M00001651B:A11 |
| | M00003826B:E11 | M00003804A:H04 | M00001597A:E12 |
| | M00001596A:G06 | M00003806D:G05 | M00001649C:B10 |
| | M00005100B:D02 | M00003808C:B05 | M00001614A:E06 |
| | M00005137A:E01 | M00003511A:E03 | M00001615C:D02 |
| | M00004119A:A06 | M00003815D:H09 | M00001621D:D03 |
| | M00004891D:E07 | M00003818B:G12 | M00001623D:G03 |
| | M00004958B:D01 | M00003769B:D03 | M00001624A:F09 |
| | M00005102C:F09 | M00001390A:A09 | M00001624C:A06 |
| | M00005136D:C01 | M00001432A:E06 | M00001630B:A11 |
| | M00005174D:H02 | M00001381A:D02 | M00001634B:C10 |
| | M00005177C:B04 | M00001383A:G04 | M00001639B:B07 |
| | M00005218B:D09 | M00001384C:E03 | M00001573D:F04 |
| | M00004102C:F03 | M00001384C:F12 | M00001595B:A09 |
| | M00004114B:D09 | M00001384D:H07 | M00004156B:A12 |
| | M00004119D:A07 | M00001385B:F10 | M00004319D:G09 |
| | M00004895C:G05 | M00001385C:H11 | M00004096A:G02 |

TABLE 22-continued

Clones Deposited on Jan. 23, 1999

| cDNA Ref No.; ATCC Accession | cDNA Library Ref ES20 ATCC No. 207067 | cDNA Ref No. ES27 ATCC No. 207074 | cDNA Library Ref ES28 ATCC No. 207075 |
|---|---|---|---|
| | M00004235A:A12 | M00001386A:C02 | M00004101C:G08 |
| | M00005134B:E01 | M00001372C:F07 | M00004102A:H02 |
| | M00004115C:G03 | M00001389D:G11 | M00004108A:A09 |
| | M00005175B:H04 | M00001371D:G01 | M00004111D:D11 |
| | M00005214B:D11 | M00001392C:D10 | M00004115D:C08 |
| | M00004102D:B05 | M00001392D:H06 | M00004118D:E08 |
| | M00004115A:B12 | M00001397B:B09 | M00004121C:F06 |
| | M00004119D:H06 | M00001398A:003 | M00004131B:H09 |
| | M00004897D:F03 | M00001400A:F06 | M00004141D:A09 |
| | M00004960B:A09 | M00001410B:G05 | M00004090A:F09 |
| | M00005134C:E11 | M00001413A:F02 | M00004146A:C08 |
| | M00005138B:D12 | M00001415B:E09 | M00004078B:A11 |
| | M00005176A:A05 | M00001425A:C11 | M00004176B:E08 |
| | M00005214c:A09 | M00001386A:D11 | M00004188C:A09 |
| | M00004102C:D01 | M00001354C:B06 | M00004233C:H09 |
| | M00004960B:A08 | M00001339D:G02 | M00004241D:F11 |
| | M00001476D:A09 | M00001660A:C12 | M00004246c:A09 |
| | M00001572A:B06 | M00001528A:A01 | M00004247C:C12 |
| | M00005217D:F12 | M00001343D:C04 | M00004248B:E08 |
| | M00005233A:G08 | M00001347B:E01 | M00004257C:H06 |
| | M00005236B:F10 | M00001345A:D04 | M00004260D:C12 |
| | M00005259B:C01 | M00001349C:C05 | M00004295B:D02 |
| | M00005254D:B08 | M00001350A:D06 | M00004040D:F01 |
| | M00005259C:B05 | M00001352D:C05 | M00004142D:E10 |
| | M00001575A:D06 | M00001380C:E05 | M00003853D:D03 |
| | M00005259D:H08 | M00001354B:B10 | M00003860D:H07 |
| | M00003813C:D08 | M00001380C:F02 | M00003878C:E04 |
| | M00001530D:E06 | M00001354C:C10 | M00003879A:G05 |
| | M00004891B:B12 | M00001355B:G11 | M00003880B:C08 |
| | M00001596B:C11 | M00001356D:F06 | M00003881A:D09 |
| | M00004300C:H09 | M00001360D:E11 | M00003881C:G09 |
| | M00001486D:D12 | M00001361C:H11 | M00003901B:A05 |
| | M00001585D:F03 | M00001362C:A10 | M00003904D:D10 |
| | M00001596B:D09 | M00001363C:H02 | M00003905C:G10 |
| | M00001570D:E06 | M00001366D:G02 | M00003906B:F12 |
| | M00001582C:E01 | M00001369A:H12 | M00003909A:H04 |
| | M00001586C:E06 | M00001352D:D02 | M00004091B:D11 |
| | M00001593B:D10 | M00001485D:B10 | M00003963A:E03 |
| | M00001595C:H11 | M00001457B:E03 | M00004353C:H07 |
| | M00001596B:H05 | M00001457C:C12 | M00003919A:A10 |
| | M00001576A:C11 | M00001458C:E01 | M00003938A:B04 |
| | M00001596C:F09 | M00001462B:A10 | M00003939C:F04 |
| | M00001567A:H05 | M00001464D:F06 | M00003946D:C11 |
| | M00001585D:D11 | M00001467D:H05 | M00003979A:F03 |
| | M00004688A:A02 | M00001468D:H06 | M00003985C:F01 |
| | M00004927A:E06 | M00001505C:H01 | M00003997B:G07 |
| | M00005229D:H09 | M00001470A:H01 | M00003860D:A01 |
| | M00004117B:A12 | M00001457A:B07 | M00004035A:A04 |
| | M00004187D:G09 | M00001479B:A01 | M00004042D:H02 |
| | M00005173B:F01 | M00001469D:D02 | M00004073B:B01 |
| | M00005218A:G05 | M00001487A:A05 | M00003946A:H10 |
| | M00004118A:H08 | M00001352C:H02 | M00001423D:A09 |
| | M00005134A:D11 | M00001488D:C10 | M00004314B:G07 |
| | M00005176C:C09 | M00001490C:C12 | M00001405D:D11 |
| | M00005230D:F06 | M00001493B:D09 | M00001408A:H04 |
| | M00005234D:B04 | M00001504D:D11 | M00001408D:D04 |
| | M00005101C:E09 | M00001376B:C06 | M00001411D:F05 |
| | M00004206A:E02 | M00001506B:D09 | M00001412A:E04 |
| | M00001570C:A05 | M00001511B:C06 | M00001413A:F03 |
| | M00005231A:H04 | M00001476B:F10 | M00001417B:C04 |
| | M00005235A:A03 | M00001450D:D04 | M00001417D:A04 |
| | M00004118B:B04 | M00001433A:G07 | M00001418B:F07 |
| | M00005136D:D06 | M00001470C:B10 | M00001419D:C10 |
| | M00005231C:B01 | M00001437D:C04 | M00001402B:F12 |
| | M00004153B:B03 | M00001447C:C01 | M00001423A:G05 |
| | M00004897C:D06 | M00001448B:F06 | M00001401C:H03 |
| | M00005136D:G06 | M00001449D:A06 | M00001423D:D12 |
| | M00005212B:A02 | M00001433B:H11 | M00001424B:H04 |
| | M00005232A:C10 | M00001451D:C10 | M00001428B:A09 |
| | M00004692A:H10 | M00001452A:C07 | M00001430A:A02 |
| | M00005101C:B09 | M00001453C:A11 | M00001432D:F05 |
| | M00004144A:F04 | M00001456B:C09 | M00001438B:B09 |
| | M00003852B:D11 | M00001454B:G03 | M00001445B:E04 |
| | M00001660D:E05 | M00001454B:G07 | M00001445C:A08 |
| | M00003808A:F09 | M00001454C:C08 | M00001446C:D09 |
| | M00001656A:D10 | M00001454C:F02 | M00001448A:G09 |
| | M00001671A:H06 | M00001454D:D06 | M00001449C:H12 |
| | M00003809C:H07 | M00001456B:F10 | M00001422C:F12 |
| | M00003853C:C06 | M00001455D:A09 | M00001352C:H10 |
| | M00003860A:A08 | M00001455D:A11 | M00004375A:H01 |
| | M00003822B:D08 | M00001448D:F09 | M00004380A:A05 |
| | M00003845B:E12 | | M00004444B:D11 |
| | M00003854C:C02 | | M00001338B:E02 |
| | M00003860B:G09 | | M00001341A:F12 |
| | M00003822B:G01 | | M00001344A:G07 |
| | M00001670A:C11 | | M00001345A:G11 |
| | M00003852A:B03 | | M00001345B:E10 |
| | M00003829D:A11 | | M00001345C:B01 |
| | M00003854C:F01 | | M00001346B:B07 |
| | M00003856B:C04 | | M00001405B:E09 |
| | M00003905A:H11 | | M00001352B:F04 |
| | M00001530A:F11 | | M00001451C:E01 |
| | M00003840B:E07 | | M00001361A:H07 |
| | M00003905B:G03 | | M00001362B:H06 |
| | M00003840B:E08 | | M00001372C:G12 |
| | M00003855A:C12 | | M00001375B:G12 |
| | M00003905B:H05 | | M00001376A:C05 |
| | M00003826B:B04 | | M00001376B:A08 |
| | M00003851C:B06 | | M00001377C:E12 |
| | M00003853C:C08 | | M00001382B:F12 |
| | M00003829A:F03 | | M00001385A:F12 |
| | M00001638C:G01 | | M00001394A:E04 |
| | M00003845D:B02 | | M00001395A:C09 |
| | M00001653D:G07 | | M00001396A:H03 |
| | M00001578B:A02 | | M00001350B:G11 |
| | M00001590B:H10 | | |
| | M00001595C:A09 | | |
| | M00001596A:E07 | | |
| | M00001607A:B06 | | |
| | M00001607A:D10 | | |
| | M00001652C:B09 | | |
| | M00001671B:F02 | | |
| | M00001632C:D08 | | |
| | M00001638C:H07 | | |
| | M00001652D:B09 | | |
| | M00001614C:E11 | | |
| | M00001633B:B11 | | |
| | M00001651C:A04 | | |
| | M00001639D:G12 | | |
| | M00001671C:F11 | | |
| | M00001638A:B04 | | |
| | M00001637C:H12 | | |
| | M00001669B:H06 | | |
| | M00001639D:F02 | | |
| | M00001590A:C08 | | |
| | M00001636A:C02 | | |
| | M00001614A:A04 | | |
| | M00001639D:G06 | | |

TABLE 23

Library Deposited on Jan. 22, 1999

| cDNA Ref No.; ATCC Accession No. | cDNA Library Ref ES29 ATCC No. 207076 | cDNA Library Ref ES30 ATCC No. 207077 |
|---|---|---|
| Clone Names in Library | M00001449D:B01 | M00001594D:B08 |
| | M00001476D:F03 | M00001593A:B07 |
| | M00001456C:B12 | M00001594A:C01 |
| | M00001469B:B01 | M00001594A:D08 |
| | M00001471A:B04 | M00001594A:G09 |
| | M00001472A:D08 | M00001595C:B05 |
| | M00001473A:A07 | M00001594B:F12 |
| | M00001473C:D09 | M00001596D:E03 |
| | M00001475B:C04 | M00001594D:C03 |
| | M00001475C:G11 | M00001592C:F11 |
| | M00001476A:D11 | M00001590D:G07 |
| | M00001476B:D10 | M00001595D:A04 |
| | M00001468A:C05 | M00001595D:G03 |
| | M00001476C:C11 | M00001601A:A06 |
| | M00001467A:H07 | M00001590C:F10 |
| | M00001477B:E02 | M00001589B:B08 |
| | M00001478B:H08 | M00001589C:E06 |
| | M00001479C:E01 | M00001611B:A05 |
| | M00001480A:D03 | M00001601A:E02 |
| | M00001480C:A05 | M00001587A:D01 |
| | M00001481A:H08 | M00001591B:B12 |
| | M00001481B:D09 | M00001590B:G08 |
| | M00001482A:H05 | M00001592C:E05 |
| | M00001482D:H11 | M00001591B:B06 |
| | M00001483C:G09 | M00001591D:C07 |
| | M00001485A:C05 | M00001591D:F06 |
| | M00001476B:F08 | M00001592A:E02 |
| | M00001460A:E11 | M00001592A:H05 |
| | M00001456C:C11 | M00001592B:A04 |
| | M00001457A:C05 | M00001587A:B10 |
| | M00001457A:G12 | M00001609D:G10 |
| | M00001458A:A11 | M00005231D:B09 |
| | M00001458C:D10 | M00001614B:E08 |
| | M00001458D:A01 | M00005217C:C01 |
| | M00001458D:A02 | M00001587A:B01 |
| | M00001458D:C11 | M00001613D:B03 |
| | M00001458D:D01 | M00001613A:F03 |
| | M00001459B:C11 | M00001611C:H11 |
| | M00001468A:H10 | M00001611C:C12 |
| | M00001460A:C10 | M00001611B:E06 |
| | M00001485B:F05 | M00001611B:A09 |
| | M00001460A:H11 | M00001610D:D05 |
| | M00001461A:F05 | M00001610B:C07 |
| | M00001462A:D03 | M00001610C:E07 |
| | M00001464A:B02 | M00001610A:E09 |
| | M00001464A:E10 | M00001601A:E12 |
| | M00001465A:B12 | M00001609B:C09 |
| | M00001465A:C12 | M00001608D:D11 |
| | M00001465A:E10 | M00001608B:A09 |
| | M00001465A:G06 | M00001607D:F06 |
| | M00001466A:F08 | M00001607B:C05 |
| | M00001467A:C10 | M00001606A:H09 |
| | M00001460A:B12 | M00001605A:H03 |
| | M00001545A:B12 | M00001605A:E09 |
| | M00001535A:D10 | M00001605A:A06 |
| | M00001536A:F11 | M00001604A:C11 |
| | M00001537A:H05 | M00001604A:C07 |
| | M00001539A:E01 | M00001604A:B08 |
| | M00001539A:H02 | M00001604A:A09 |
| | M00001539B:G07 | M00001610A:H05 |
| | M00001539D:B10 | M00005214B:A06 |
| | M00001540D:E02 | M00005228A:A09 |
| | M00001541B:E05 | M00001567A:B09 |
| | M00001542A:G12 | M00001561A:D01 |
| | M00001485B:D09 | M00001559A:C08 |
| | M00001545A:B10 | M00001559A:A11 |
| | M00001533A:G05 | M00001558A:G09 |
| | M00001545A:F02 | M00001555A:B12 |
| | M00001545A:G05 | M00001554A:A08 |
| | M00001546A:D08 | M00001552A:H10 |
| | M00001548A:H04 | M00001552A:F06 |
| | M00001550A:E07 | M00005231C:B07 |
| | M00001551A:A11 | M00005218D:G10 |
| | M00001551A:D06 | M00001570A:H01 |
| | M00001551A:H06 | M00005214D:D10 |
| | M00001551D:H07 | M00001570C:G03 |
| | M00001552A:E10 | M00005213C:A01 |
| | M00001450A:B08 | M00005212D:F08 |
| | M00001544A:F05 | M00005212A:D10 |
| | M00001512A:G05 | M00005211C:E09 |
| | M00001483B:D04 | M00005211A:E09 |
| | M00001485B:H03 | M00005210D:C09 |
| | M00001485C:C08 | M00005179D:B03 |
| | M00001486B:D07 | M00005179B:H02 |
| | M00001486B:E12 | M00005177D:F09 |
| | M00001487B:A11 | M00005177C:G04 |
| | M00001487B:E10 | M00005177B:H02 |
| | M00001507A:A11 | M00001614D:B08 |
| | M00001507A:B02 | M00001615A:D06 |
| | M00001507A:C05 | M00005216B:D02 |
| | M00001507A:E04 | M00001579C:A01 |
| | M00001534A:D03 | M00001585B:C03 |
| | M00001511A:G01 | M00001585B:A06 |
| | M00001533D:A08 | M00001584D:H02 |
| | M00001513A:F05 | M00001584A:G03 |
| | M00001514A:G03 | M00001583D:B08 |
| | M00001516A:D02 | M00001583B:F02 |
| | M00001516A:F06 | M00001583A:F07 |
| | M00001517A:B11 | M00001583A:A05 |
| | M00001529D:C05 | M00001582D:F02 |
| | M00001530A:A09 | M00001582D:B01 |
| | M00001530A:E10 | M00001582A:A03 |
| | M00001532A:C01 | M00001579D:H09 |
| | M00001532D:A06 | M00001567D:B03 |
| | M00001485B:D10 | M00001579C:H06 |
| | M00001511A:A02 | M00001585B:F01 |
| | M00004249D:B08 | M00001579B:F04 |
| | M00004185D:E04 | M00001579A:E03 |
| | M00004188D:G08 | M00001578C:F05 |
| | M00004197C:F03 | M00001577D:H06 |
| | M00004198B:D02 | M00001577B:F10 |
| | M00004204D:C03 | M00001576C:G05 |
| | M00004208B:F05 | M00001575D:D12 |
| | M00004208D:B10 | M00001575D:B10 |
| | M00004210B:B05 | M00001575D:A02 |
| | M00001362D:H01 | M00001573B:G08 |
| | M00004216D:D03 | M00001573A:E01 |
| | M00004167A:H03 | M00001572A:B05 |
| | M00004275A:B03 | M00001571D:F05 |
| | M00004285C:A08 | M00001579D:F04 |
| | M00004316A:G09 | M00001636A:F08 |
| | M00004465B:D04 | M00001643B:E05 |
| | M00004493B:D09 | M00001642C:G02 |
| | M00001347B:H04 | M00001642A:F03 |
| | M00001351C:B06 | M00001641D:C04 |
| | M00001360A:G10 | M00001641C:H07 |
| | M00004216D:C03 | M00001641C:F01 |
| | M00004076D:D04 | M00001641C:D02 |
| | M00001484C:A04 | M00001641B:F12 |
| | M00001456B:G01 | M00001634A:B04 |
| | M00003972D:C09 | M00001636B:G11 |
| | M00003974C:E04 | M00001649C:D05 |
| | M00003979A:E11 | M00001636A:C03 |
| | M00003983C:F03 | M00001635D:D05 |
| | M00003989B:F11 | M00001635D:C12 |
| | M00004031D:B05 | M00001635B:H02 |
| | M00004177C:A01 | M00001635B:H01 |
| | M00004076B:G03 | M00001634D:G11 |
| | M00004167D:A07 | M00001634D:D04 |
| | M00004078A:A06 | M00001634A:H05 |
| | M00004085A:B02 | M00001641A:A11 |
| | M00004107B:A06 | M00001638B:E12 |
| | M00004111C:E11 | M00001640A:H02 |
| | M00004130D:H01 | M00001614C:E06 |
| | M00004157D:B03 | M00001636D:F09 |
| | M00004159C:F09 | M00001637A:A03 |

TABLE 23-continued

Library Deposited on Jan. 22, 1999

| cDNA Ref No.; ATCC Accession No. | cDNA Library Ref ES29 ATCC No. 207076 | cDNA Library Ref ES30 ATCC No. 207077 |
|---|---|---|
| | M00004162C:A07 | M00001637A:A06 |
| | M00004135B:G01 | M00001637A:E10 |
| | M00004040A:G12 | M00001637A:F10 |
| | M00001453B:H12 | M00001637C:C06 |
| | M00001448A:E11 | M00001644A:H01 |
| | M00001448B:F09 | M00001638B:E03 |
| | M00001448B:H05 | M00001649A:E11 |
| | M00001448C:E11 | M00001638B:F10 |
| | M00001448C:F10 | M00001639A:C03 |
| | M00001448D:F12 | M00001639A:G07 |
| | M00001449B:B03 | M00001639B:H01 |
| | M00001449C:C05 | M00001639B:H05 |
| | M00001449D:G10 | M00001639C:A09 |
| | M00001448A:B12 | M00001639C:C02 |
| | M00001453A:D08 | M00001649C:E11 |
| | M00001451B:A04 | M00001649C:H10 |
| | M00001454A:F11 | M00001637C:E03 |
| | M00001454A:G03 | M00001617A:A08 |
| | M00001455A:F04 | M00001622A:H12 |
| | M00001455B:E07 | M00001621C:H12 |
| | M00001455D:A06 | M00001621B:G05 |
| | M00001364B:B06 | M00001620D:H02 |
| | M00004117A:G01 | M00001620D:G11 |
| | M00001455D:D11 | M00001619D:D10 |
| | M00001456B:A06 | M00001619C:C07 |
| | M00001451C:C10 | M00001619A:E05 |
| | M00001395A:E03 | M00001623A:F04 |
| | M00001366D:C06 | M00001618A:A03 |
| | M00001365A:H10 | M00001615B:D09 |
| | M00001366D:C12 | M00001617A:A01 |
| | M00001373D:B03 | M00001616D:C11 |
| | M00001453B:F08 | M00001615C:G05 |
| | M00001444D:C01 | M00001615C:A11 |
| | M00001375D:C06 | M00001615B:G07 |
| | M00001392C:D05 | M00001633D:H06 |
| | M00001395A:A12 | M00001639C:A10 |
| | M00001395A:H02 | M00001615B:A09 |
| | M00001397D:G08 | M00001615B:G01 |
| | M00001434A:B10 | M00001618A:F10 |
| | M00001416A:D09 | M00001632C:H07 |
| | M00001433C:F10 | M00001633D:D12 |
| | M00001416A:H02 | M00001633D:D09 |
| | M00001428D:B10 | M00001618A:F08 |
| | M00001428B:D01 | M00001633D:G09 |
| | M00001426D:D12 | M00001624A:A03 |
| | M00001400C:D02 | M00001633C:F09 |
| | M00001427C:D01 | M00001633C:H05 |
| | | M00001633C:B09 |
| | | M00001633A:E06 |
| | | M00001633C:H11 |
| | | M00001632C:B10 |
| | | M00001625D:G10 |
| | | M00001631D:G05 |
| | | M00001629C:E07 |
| | | M00001629B:B08 |
| | | M00001626C:E04 |
| | | M00001626C:C11 |
| | | M00001632A:B10 |
| | | M00001624B:B10 |
| | | M00001633C:A05 |
| | | M00001625C:G05 |

TABLE 24

Clones Deposited on Jan. 22, 1999

| cDNA Ref No.; ATCC Accession No. | cDNA Library Ref ES31 ATCC No. 207078 | cDNA Ref No. ES32 ATCC No. 207079 | cDNA Library Ref ES33 ATCC No. 207080 |
|---|---|---|---|
| Clone Names in Library | M00003843A:E04 | M00003906A:F12 | M00005254D:A10 |
| | M00003842C:G03 | M00003906B:H06 | M00005260B:E11 |
| | M00003842A:A03 | M00003906C:C05 | M00005260A:F04 |
| | M00003841D:A04 | M00003997A:F01 | M00005260A:A12 |
| | M00003841B:E06 | M00003907B:C03 | M00005259B:D12 |
| | M00003841C:H11 | M00003907B:D05 | M00005257D:H11 |
| | M00003844A:A11 | M00003918A:D08 | M00005257D:G07 |
| | M00003841C:F01 | M00003918A:F09 | M00005257D:A06 |
| | M00003841C:H08 | M00003918C:H10 | M00005257C:G01 |
| | M00003841C:D07 | M00003924A:D08 | M00005257A:H11 |
| | M00003844D:A07 | M00003958A:E11 | M00005236B:H10 |
| | M00003845D:G08 | M00003958A:H08 | M00005236B:G03 |
| | M00003852C:B06 | MOOO03960A:G07 | M00005257C:E05 |
| | M00003854B:A07 | M00003971B:A10 | M00001608C:D02 |
| | M00003854B:D04 | M00003972D:H02 | M00001608C:G04 |
| | M00003859D:C05 | M00003973C:C03 | M00001608D:F11 |
| | M00003860B:F11 | M00003974B:B11 | M00001609C:A12 |
| | M00003867B:G07 | M00003974A:F02 | M00001609C:G05 |
| | M00003867B:G08 | M00003974D:H04 | M00001610C:B07 |
| | M00003841B:E03 | M00003975:F07 | M00001612C:D12 |
| | M00003822B:B10 | M00003977C:A06 | M00001612D:F06 |
| | M00003867D:A06 | M00003977C:B03 | M00001613A:D02 |
| | M00003868B:G06 | M00003977D:A03 | M00001614A:B10 |
| | M00003867B:D10 | M00003977D:A06 | M00001614C:G07 |
| | M00003831C:G05 | M00003977D:D04 | M00001615C:E07 |
| | M00003901C:B01 | M00003978D:G04 | M00001625C:F10 |
| | M00003868C:C07 | M00003980A:F04 | M00001626D:A02 |
| | M00003820A:A08 | M00003980B:C11 | M00001629A:H09 |
| | M00003820B:D07 | M00003981C:B04 | M00001629D:B10 |
| | M00003820B:D10 | M00003982A:B12 | M00001629D:D10 |
| | M00003822D:C06 | M00003982C:G04 | M0000163OC:F09 |
| | M00003823B:F07 | M00003984C:B08 | M00001631A:D03 |
| | M0000382AC:D07 | M00003985B:G04 | M00001631A:F06 |
| | M00003825B:B10 | M00003985D:E10 | M00001631A:F12 |
| | M00003825B:B11 | M00003986B:A08 | M00001631B:H04 |
| | M00003828A:D05 | M00003986C:D09 | M00001633A:F11 |
| | M00003822D:D04 | M00003986C:C08 | M00001633A:G10 |
| | M00003830C:A03 | M00003987B:E12 | M00001633B:A12 |
| | M00003840D:H10 | M00003987B:F08 | M00001633B:E03 |
| | M00003832A:A09 | M00003987C:G03 | M00001633C:A08 |
| | M00003833B:B03 | M00003988D:A08 | M00001633C:E12 |
| | M00003833B:C12 | M00003989C:D03 | M00001635B:B02 |
| | M00003834B:G04 | M00003989C:G05 | M00001636A:H12 |
| | M00003835A:A09 | M00003989B:F12 | M00001638A:C08 |
| | M00003835B:H11 | M00004029B:F01 | M00001638B:C08 |
| | M00003835D:G06 | M00004029C:C05 | M00001639D:C12 |
| | M00003837C:E05 | M00004029C:G10 | M00001640A:F05 |
| | M00003837C:F10 | M00004030D:F11 | M00001642D:G08 |
| | M00003839A:D07 | M00004034A:A01 | M00001647C:G07 |
| | M00003839D:E11 | M00004034C:G02 | M00001649A:E10 |
| | M00003829C:H05 | M00004034D:E09 | M00001650D:D10 |
| | M0000390IB:C03 | M00004035B:H09 | M00001650D:F11 |
| | M00003878C:F06 | M00004036C:B04 | M00001651C:D11 |
| | M00003878C:G08 | M00004036C:B09 | M00001651C:G12 |
| | M00003879A:A02 | M00004038A:F02 | M00001652B:D06 |
| | M00003879A:B08 | M00004038D:G06 | M00001652D:G02 |
| | M00003879A:C11 | M00004039C:C03 | M00001652D:G06 |
| | M00003879A:D02 | M00004039A:H11 | M00001653A:A05 |
| | M00003879B:G02 | M00004039B:A05 | M00001653D:H07 |
| | M00003880B:D11 | M00004039B:E12 | M00001654A:E08 |
| | M00003880C:E11 | M00004040C:A01 | M00001654B:A01 |
| | M00003880C:H03 | M00004051D:E01 | M00001654C:D10 |
| | M00003901B:F10 | M00004072C:F09 | M00001655C:G07 |
| | M00003890B:C08 | M00004073A:D10 | M00001654C:G09 |
| | M00003877C:A11 | M00004075B:G09 | M00001655C:C07 |
| | M00003819D:B01 | M00004076C:D12 | M00001655D:E08 |
| | M00003901B:G11 | M00004076D:H07 | M00001655D:H11 |
| | M00001692A:G06 | M00004078A:C11 | M00001656A:H12 |
| | M00003903C:C05 | M00004078A:E05 | M00001656D:C04 |

TABLE 24-continued

Clones Deposited on Jan. 22, 1999

| cDNA Ref No.; ATCC Accession No. | cDNA Library Ref ES31 ATCC No. 207078 | cDNA Ref No. ES32 ATCC No. 207079 | cDNA Library Ref ES33 ATCC No. 207080 |
|---|---|---|---|
| | M00003903C:E12 | M00004078A:F07 | M00001656D:C04 |
| | M00003903D:C12 | M00004078B:C11 | M00001657C:C11 |
| | M00003903D:D10 | M00004078B:F12 | M00001657D:A10 |
| | M00003903D:H11 | M00004079D:G08 | M00001659D:A09 |
| | M00003904A:C04 | M00004081A:E02 | M00001661D:D05 |
| | M00003904B:C03 | M00004081A:G01 | M00001664B:E08 |
| | M00003904C:A08 | M00004081C:A10 | M00001664B:F06 |
| | M00003881B:F10 | M00004083A:E08 | M00001669B:C12 |
| | M00003871D:G06 | M00004083B:C01 | M00001669C:B09 |
| | M00003868D:D09 | M00004086D:G08 | M00001670A:F09 |
| | M00003868D:D11 | M00004087B:A12 | M00001678C:F09 |
| | M00003870C:A01 | M00004087C:A01 | M00001693A:H06 |
| | M00003870C:A10 | M00004088C:F01 | M00003805D:E06 |
| | M00003870C:E10 | M00004088D:A11 | M00003806C:A06 |
| | M00003871A:A02 | M00004088D:B05 | M00003809B:A03 |
| | M00003871A:B09 | M00004088D:B10 | M00003810A:A02 |
| | M00003871A:C11 | M00004090B:B04 | M00003810B:B11 |
| | M00003871A:G09 | M00004090B:H06 | M00003810C:B06 |
| | M00003871C:E04 | M00004092B:E05 | M00003810D:H09 |
| | M00003871C:F12 | M00004093C:C02 | M00003811C:C02 |
| | M00003878C:D08 | M00004096D:H03 | M00003813B:F02 |
| | M00003871D:E11 | M00004099D:F01 | M00003813C:H08 |
| | M00003877C:G12 | M00004100B:C07 | M00003813D:B12 |
| | M00003875A:A07 | M00004103B:E09 | M00003813D:C02 |
| | M00003875A:B01 | M00004105C:B05 | M00003813D:G06 |
| | M00003875B:F12 | M00004105C:C08 | M00003814B:C01 |
| | M00003875C:A01 | M00004107A:A12 | M00003817C:A10 |
| | M00003875C:A09 | M00004107B:D07 | M00003817C:G06 |
| | M00003875C:G02 | M00004108B:B02 | M00003817D:D12 |
| | M00003876B:C05 | M00004108D:E07 | M00003821A:H09 |
| | M00003876C:D02 | M00004108D:G04 | M00003822B:G12 |
| | M00003876C:F02 | M00004110A:A10 | M00003822C:A07 |
| | M00003877B:H10 | M00004110B:A07 | M00003823C:B01 |
| | M00003868D:B09 | M00004118B:A03 | M00003823C:C04 |
| | M00003871D:A10 | M00004118B:F01 | M00003824A:G11 |
| | M00001669D:D06 | M00004118D:B05 | M00003824B:C09 |
| | M00001661A:B11 | M00004119A:C09 | M00003824C:A10 |
| | M00001661B:F06 | M00004136D:B02 | M00003824D:D08 |
| | M00001662A:C07 | M00004137A:D06 | M00003825B:F10 |
| | M00001662A:G01 | M00004139C:A12 | M00003825D:F01 |
| | M00001662B:F06 | M00004149C:B02 | M00003826C:F05 |
| | M00001663C:F12 | M00004159C:G12 | M00003829A:B08 |
| | M00001664A:F08 | M00004169B:B11 | M00003829C:E08 |
| | M00001664D:F04 | M00004187D:H06 | M00003829D:D12 |
| | M00001661A:E06 | M00004228C:H03 | M00003829D:F03 |
| | M00001669A:B02 | M00004244C:G07 | M00003830D:B11 |
| | M00001669B:B12 | M00004358D:C02 | M00003830D:H11 |
| | M00001669C:C08 | M00004690A:G08 | M00003833D:H08 |
| | M00001675A:G10 | M00004891B:D01 | M00003833D:H10 |
| | M00001669D:C03 | M00004891C:D04 | M00003840A:C10 |
| | M00001660B:E03 | M00004895B:E12 | M00003840B:F05 |
| | M00001669D:F05 | M00004895B:G04 | M00003840C:C02 |
| | M00001670B:G12 | M00004895D:G07 | M00003845C:D04 |
| | M00001671A:A10 | M00004898C:F03 | M00003845D:A04 |
| | M00001671B:G05 | M00004899D:G06 | M00003846B:C05 |
| | M00001671C:C11 | M00004959D:H12 | M00003846B:C05 |
| | M00001672D:E08 | M00004960A:B08 | M00003848B:E07 |
| | M00001673A:G08 | M00004960C:E10 | M00003848D:G02 |
| | M00001673B:B07 | M00005100A:B02 | M00003850C:G09 |
| | M00001673B:F07 | M00005100A:C01 | M00003851A:A06 |
| | M00001673D:D06 | M00005101C:E12 | M00003851B:D03 |
| | M00001673D:F10 | M00005102C:D03 | M00003851B:E01 |
| | M00001674A:G07 | M00005134B:E08 | M00003851C:F09 |
| | M00001692B:D01 | M00005139A:H03 | M00003851D:H11 |
| | M00001669C:D09 | M00005140C:B10 | M00003852B:G04 |
| | M00001655C:E01 | M00005140D:C06 | M00003852C:F07 |
| | M00001649D:A08 | M00005178D:H04 | M00003853B:C10 |
| | M00001650A:C11 | M00005210A:E06 | M00003854C:C09 |
| | M00001651A:H11 | M00005212B:E01 | M00003855A:A01 |
| | M00001652A:A01 | M00005212C:C03 | M00003855A:F01 |
| | M00001652B:G10 | M00005212C:D02 | M00003855B:B09 |
| | M00001652D:E05 | M00005212D:H02 | M00003856A:G04 |
| | M00001652D:E09 | M00005212D:D09 | M00003856B:A12 |
| | M00001653B:C06 | M00005212D:H01 | M00003857A:E12 |
| | M00001653B:C10 | M00005216A:D09 | M00003857A:H10 |
| | M00001653C:D10 | M00005216A:H01 | M00003857C:E05 |
| | M00001654D:A03 | M00005217A:A06 | M00003858B:G02 |
| | M00001654D:E12 | M00005218A:F09 | M00003860D:E06 |
| | M00001654D:F11 | M00005228A:B03 | M00003905C:F12 |
| | M00001660C:B06 | M00005228C:C05 | M00003911A:D12 |
| | M00001658D:G12 | M00005229B:G12 | M00003966B:A04 |
| | M00001675C:A04 | M00005229B:H04 | M00003966C:A12 |
| | M00001660B:D03 | M00005229B:H06 | M00003966C:F03 |
| | M00001660B:A09 | M00005229D:H03 | M00003973D:F08 |
| | M00001659D:C09 | M00005230D:H09 | M00003974D:E01 |
| | M00001659D:B05 | M00005232A:H12 | M00003974D:H07 |
| | M00001654D:F12 | M00005233B:D04 | M00003976B:E06 |
| | M00001659A:D12 | M00005233D:H07 | M00003976B:H07 |
| | M00001655A:B11 | M00005235B:F10 | M00003978A:E01 |
| | M00001658B:A07 | M00005236A:E04 | M00003978A:E09 |
| | M00001658A:G09 | M00005236A:G10 | M00003978C:A12 |
| | M00001657D:A04 | M00005236A:A12 | M00003980C:E12 |
| | M00001657B:D04 | M00001448B:A07 | M00003980C:F12 |
| | M00001656B:E01 | M00001448B:G07 | M00003981A:A07 |
| | M00001660B:E04 | M00001448D:E11 | M00003981B:B12 |
| | M00001659C:F10 | M00001455A:D10 | M00003982A:G03 |
| | M00003808C:A05 | M00001455A:E11 | M00003982B:C10 |
| | M00001694D:C12 | M00001476D:F12 | M00003982B:H10 |
| | M00003746C:E02 | M00001478A:F12 | M00003983A:D02 |
| | M00003779D:E08 | M00001482C:F09 | M00003983A:F06 |
| | M00003792A:B10 | M00001485C:D07 | M00003983A:G02 |
| | M00003793D:A11 | M00001485C:G06 | M00003983D:E08 |
| | M00003794D:G03 | M00001485D:A05 | M00003983D:H02 |
| | M00003797A:C11 | M00001487C:A11 | M00003985A:C01 |
| | M00003797A:D06 | M00001487C:G09 | M00003986C:G11 |
| | M00003797A:G03 | M00001530A:B02 | M00003986D:H12 |
| | M00003800B:F03 | M00001530A:H05 | M00004027A:A08 |
| | M00003805A:F02 | M00001530D:A11 | M00004028A:B10 |
| | M00003806B:C09 | M00001539B:B10 | M00004028A:G03 |
| | M00001674A:G11 | M00001567A:C04 | M00004029A:A01 |
| | M00003806D:D11 | M00001567A:C11 | M00004029B:A06 |
| | M00001693D:E08 | M00001567C:B08 | M00004029B:G10 |
| | M00003808D:D08 | M00001567C:E07 | M00004029C:F02 |
| | M00003809A:C01 | M00001570C:B02 | M00004029C:F05 |
| | M00003809A:F01 | M00001570C:E05 | M00004030A:A12 |
| | M00003809B:B02 | M00001570D:E07 | M00004030B:D08 |
| | M00003809B:E10 | M00001573B:A06 | M00004030C:A08 |
| | M00003813A:B02 | M00001573B:H12 | M00004030C:C02 |
| | M00003813A:D08 | M00001575A:D05 | M00004034C:F05 |
| | M00003813B:E09 | M00001575B:C01 | M00004035B:F05 |
| | M00003814B:C12 | M00001576C:H02 | M00004036A:A11 |
| | M00003814B:F12 | M00001577A:A03 | M00004037D:D04 |
| | M00003815C:C06 | M00001578B:A06 | M00004038A:E05 |
| | M00003815C:D12 | M00001579D:F02 | M00004038B:D01 |
| | M00003817B:C04 | M00001582C:C04 | M00004039C:E02 |
| | M00003806C:B05 | M00001582C:G02 | M00004039D:B10 |
| | M00001679A:D10 | M00001584A:A07 | M00004040A:A07 |
| | M00001675C:C03 | M00001584D:B06 | M00004040A:B04 |
| | M00001675C:D12 | M00001584D:C11 | M00004040A:C08 |
| | M00001675D:E10 | M00001585D:B12 | M00004040B:C05 |
| | M00001676B:B09 | M00001586C:H07 | M00004040B:F07 |
| | M00001676B:E01 | M00001589D:A01 | M00004069A:E12 |
| | M00001676C:A04 | M00001590D:B04 | M00004069C:C08 |
| | M00001676C:E07 | M00001592B:B02 | M00004077A:G12 |
| | M00001676D:A02 | M00001592D:H02 | M00004085B:G01 |
| | M00001676D:B02 | M00000159AC:E05 | M00004087A:B05 |
| | M00001677A:G11 | M00000159AC:H03 | M00004090D:F12 |
| | M00001677B:A12 | M00001594D:G11 | M00004092C:D08 |

TABLE 24-continued

Clones Deposited on Jan. 22, 1999

| cDNA Ref No.; ATCC Accession No. | cDNA Library Ref ES31 ATCC No. 207078 | cDNA Ref No. ES32 ATCC No. 207079 | cDNA Library Ref ES33 ATCC No. 207080 |
|---|---|---|---|
| | M00001677B:B04 | M00001595A:C07 | M00004097C:E03 |
| | M00001677D:B01 | M00001595A:D12 | M00004097C:H08 |
| | M00001678D:B11 | M00001595A:E07 | M00004097D:B05 |
| | M00001681C:A08 | M00001595B:G07 | |
| | M00003819B:G01 | M00001595B:G10 | |
| | M00001693C:E09 | M00001595B:H11 | |
| | M00001693C:C12 | M00001595C:A01 | |
| | M00001692B:E01 | M00001595C:A05 | |
| | M00001692A:B06 | M00001595C:B12 | |
| | M00001678B:H01 | M00001595C:E05 | |
| | M00001681D:C12 | M00001595C:E09 | |
| | M00001694A:E03 | M00001595D:C11 | |
| | M00001680B:D02 | M00001596A:A02 | |
| | M00001680A:B02 | M00001596A:D01 | |
| | M00001679D:F02 | M00001596C:G05 | |
| | M00001679D:B02 | M00001607A:A01 | |
| | M00001679A:G06 | | |

SEQUENCE LISTING (5252 sequences)

SEQ ID NO: 1 - DNA, 273 bp, Homo sapiens
  misc_feature (1)...(273): n = A,T,C or G
gtggtttcttagcatgatggtgtatgtatggggtaatggaaannnnnnnaaanttacnggagngnancaaacangngcacnnngngaataactanannnaannccnaaangatgcacnacaanacccatntnntnatngccntnncatnnannntanattttcncannttctnanaatcnnaccttcnnncnnnnntccnctntnntnntcacnccttnncnnnttnncantatnnactnanancntctnnanncaanantnnntctatntac

SEQ ID NO: 2 - DNA, 300 bp, Homo sapiens
gtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaa

SEQ ID NO: 3 - DNA, 294 bp, Homo sapiens
  misc_feature (1)...(294): n = A,T,C or G
ggggattcataattccagacaggtagagaacggttttatttatgtagagacagagtctcgctctgtcgccaggctgaggcgggagaatcacttgaacctgggaggtggaggttgcgctgagctgagatcattacactgcactccagcctgggcaacagagtgagactatgtctcaaaaaaaaaaaaaaaaaaaaaaaannnnnnnnnttnaaanntntngggggnctnntnncnnaaanccaancttnanaaaanccttngnnnatttggnnnaacccccanttaaanggcggg

SEQ ID NO: 4 - DNA, 300 bp, Homo sapiens
  misc_feature (1)...(300): n = A,T,C or G
cggcaaaactngganggangcgancgtngggcnanacccntgtttttgangccngggccctnttgtanggggcggntttntgntgcngtnctttnanacnttttgagntnnaaaaggntaangnntnaanttcngtnccttttgaacccngatntnntcnnaaaattncccttncctancaggangnttttgggnttgnatttgnntannccngntcntctttctggttttgcctgaacaccaagtagcttcataatcaaagggtcattttctggtttgtatcagaccgtatttataaag

SEQ ID NO: 5 - DNA, 285 bp, Homo sapiens
  misc_feature (1)...(285): n = A,T,C or G
caattagnttannntcgncccntgcnnttccanctnggnnnaccccatatggaacatgttaaaaaaaaaagccaggccgagcgtgttggctcacgcttgtaatcccagcactttgggaggccgaggcgggtggatcacgaggtcaggagatcgagttccatcctggctaacacagtgaaacgtgtttttactaaaagtacaaaaaactagctgggcgtggtggcaggagcctgtagtcccagctactcgggaggctgaggcaggagaattgcttgaaccggggag

SEQ ID NO: 6 - DNA, 131 bp, Homo sapiens
gctactcgggaggctgaggcaggagaatcgcttgaacctaggaggcataggttgcagtgagctgagattgcaccactgcaccccagcctgggcaataagagtgaaactccatctcaaaaaaaaaaaaaaaa

SEQ ID NO: 7 - DNA, 287 bp, Homo sapiens
  misc_feature (1)...(287): n = A,T,C or G
atataggnttttannaatnanannntggtgngntaaagantnantangnttttgctgntgnattttaggncnaaaaaatttnanatttnntnggnantnaaggaaaangggnnttttgntangntgcctnancnnacnngnangttcnaaaaaccccngtttnaaacngngccncaggntttnnnannnnacagatattctggttccagatgtcttgtaagttaacctgcctccatttccctttctgtaaagcaaaataatgtttacacctaatctgtctctcaggg

SEQ ID NO: 8 - DNA, 300 bp, Homo sapiens
  misc_feature (1)...(300): n = A,T,C or G
gaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggnnnnnnnnnatgaatcctacntgagctatgttcnngcccggaanataacgaacttgattggngctncttnncccacngctcttggagattccngacttnnnntatatgacnctnnagcactggcatnaacttg

SEQ ID NO: 9 - DNA, 300 bp, Homo sapiens
gtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggccta

SEQ ID NO: 10 - DNA, 296 bp, Homo sapiens
  misc_feature (1)...(296): n = A,T,C or G
gccatgtgaggacatagggagaaagcagccaccattggcaagccaagagagagccctcaccaggaacgattggaccagcaccttgatcttggattttctagcctccagaacttacagtacgggtggctgtnnnnnnnnnnngnttctgacnaggtgnnacactnnnncttccgtgntctntnactgnnntcnntcngctgcngnntctggacntccagaggttcnatgcgcnatcaggacnnnttgctatancccttgctcacgatgagnactntgactttgtgngatgnccgact

SEQ ID NO: 11 - DNA, 300 bp, Homo sapiens
  misc_feature (1)...(300): n = A,T,C or G
gagaaaccccgcctctactaaaaatacagaaaattagccaggcatggaggcacatgcctataatcccagctactcgggaggctgaggtaggagaatcgcttgaatccgggagctggaggttgcagtgagccaagatcgcaccattgcactccagcctgggcaacaagagcgaaactccatctcaaaaaaaaaaannnnnnnnnnnnngggatgatnancntgganctgnntntttttaaacgtngtttttngangcttnaaactntnaangctttnatataangntntcanctgtatgtt

SEQ ID NO: 12 - DNA, 300 bp, Homo sapiens
aaggagtcacccctgggtcacccaagctgagacatcagttggtggttggtcagaacttgtgcccaaatatgctgagtcagcggctctgcccgggcccaaatgctgagtcagcacctctgcccgggcagtctgcaggctggccctacctttgctttctgcctgtggttcctatcagggcacgcacttcagttctgttgggcagggagacgtgcatcagactctctccagggcatatgtgctgtcttgcgcttgcgcgtggcctcccaaacccctagggatacctggggccagctgggcagt

SEQ ID NO: 13 - DNA, 300 bp, Homo sapiens
gagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccag

SEQ ID NO: 14 - DNA, 300 bp, Homo sapiens
cccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaa

SEQ ID NO: 15 - DNA, 126 bp, Homo sapiens
  misc_feature (1)...(126): n = A,T,C or G
gggaaaanngnnanaccngtgcnttggaaanntttggngaannntccctnanatgaggtagcaaaanccgcagactgganaaangtgtcaaaacttttntaaacctctctgggtctnanacattnt

SEQ ID NO: 16 - DNA, 300 bp, Homo sapiens
agaagttctagcacatcttaatttccttaatagtttaattgatgaagagcattgatgaagagttaggaggtctccctttgtacctacattttccgcttttttagaatgagaagatgagaacgacctccagttcacatgtacgggtgctgtgaggatccagtaggggagatacagtgctcagcaccaagcaggtgcaagtgagcacaatccaattttacatcaggttacccctccaggacagttgctttgacgtggaaggtagagagggagttgaaaggagggtttgcatggttggcagag

SEQ ID NO: 17 - DNA, 281 bp, Homo sapiens
  misc_feature (1)...(281): n = A,T,C or G
agggatacgtgttgttntaanaagtgannnnnnngcntncanggtgncngtcantcctataagatatggcanctgntnagccctttaaggncccttnagccncnggctacccgtttacctcagatnangtttantaangngtaagttttaatcnggaaggggggangnggtgttngnagctccagtaatnttnttantnaanaatacccntcctcttgnaggctcccnagtntcccagccccatnnanaangntnngnaagnnncagaccatgtacagccn

SEQ ID NO: 18 - DNA, 300 bp, Homo sapiens
ggtaaatggcagccccatccttgaactgagaaaacaggtttaaagagtccggtgactaacccccagaaagcagagagttgaagatgaaatcagaacctgagtctggttttcctgacatccggcaggttcaaccctcagaccacagcttattagctatgagcgcagatggttctagcgtttatcctccctgctcctgtgtaaatcagggctgatggggcgacaggtgggaaaactcacctgggagaacagggctctacttccttaggcaagtccttggataagcaagcctggtcctgtcct

SEQ ID NO: 19 - DNA, 300 bp, Homo sapiens
atacaaatactacgttggacgcaaggctatgtttgacagcgattttaagcaagatgctggttatgttgacataggaaatggagattaggacaacatttagttcagcgactgacttcatgacctacacatcccgcatggagatgacttagaagcaggggatatgcccttggacctggtgtcaaagctctcgtttaaacagcctcgtgcagtgtgtcgctaccacagagctcctgtttaaacagcctcgcacggcgtgtcgctgccacacctgacactattgtattagtttacgttgctgag

SEQ ID NO: 20 - DNA, 300 bp, Homo sapiens
tggaggtgctgacgccaggtaggtcagcagtagacccagccccaacccacaagtttcgctctccagactgcgcaagcgcaaaggatacgaaaacgcccccggcgttctgggggctgggaccgaggaaagcgctgagtatagctcttgcgcgtccagtcacaaatgacgtcccttctgtaccccgccctgtaggcgggagcatccaatcaacttcgagagcgtaggccccacctatcgtgggtcgagttgcttggcggtcgtggttccggaggttcctcgggatgtcggtggccttcgtac

SEQ ID NO: 21 - DNA, 300 bp, Homo sapiens
gtccttttgaaccaccccaaagaactcaacatggcaaagcaaatggtaaaagcttcccgactgttctactttgggtccgcgcgaagcccactcacgtgtgatctgtgttgcccctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgc

SEQ ID NO: 22 - DNA, 300 bp, Homo sapiens
ctgcacctcaagaacgctagaccactcgccaccagccttctcattccctcttcctccattctaatcatttctagctggctggcctcctcagagcataggaaacctgaggtcaggaattcgagaccagcctggccaacatggtaaaaccccatctctactaaaaatataaaaattagccaggcatggtggcgcacacctgtaatcccagctaatcaagaggctgaggcaggagaattgcttaaatctgggaggcggaagttgcagtgagccaagatcgcgccactgaactccagcctaggc

SEQ ID NO: 23 - DNA, 300 bp, Homo sapiens
aagttcaagcaatgattaatctagcttccctcctggtggatgactgaggcctttgcctgaggacaactttaaagagatattgaatgaagctatgatacctgtagcagttactgccattttggacccataaactgacaatccttaaacattaccaggagggcagagcggaaagaacattgatgtcatcactgagttgctggattaccttactctagaaatagccaactctgcatgtttggttatttttttaaaaagtcttctttattatttacatcattttgaatgggctctaactctagc

SEQ ID NO: 24 - DNA, 300 bp, Homo sapiens
  misc_feature (1)...(300): n = A,T,C or G
agtcaatccaaatgatttcagagacctgactttgctgtttgaccactctcagctttttggtatcagactcccttcactggctcccaaaaactccagggccatgtttctggaacagtggaaagcagggaaatagaaatggggcctcaggaattagaaataaggctttggcattcaaatgtcgcacctagcatgctgtgactagcgataagtgtgcaaggagtgttgaagcagtaggaagacttgtggtgaggcggggcaggggaatnnnnnnnnnnnnnnnncagagaccannggcctttc

SEQ ID NO: 25 - DNA, 281 bp, Homo sapiens
  misc_feature (1)...(281): n = A,T,C or G
tgttcctgtgccagaaagaaagttaaaatacttgcttaagaaagggaggggggtgggaggggtgtagggagagggaagggagggnnnnnnnnnnnnggcntacnttttcctacatttcantntcccttttncctatctaagcngtnctatctngtcaatncacttntcnntnnnttaacnccnttccnnnncanctttcccttnntcctncctntatactnttgctntganntgctgnccanatntgtttcccttcctccatcctnncataccccttactt

SEQ ID NO: 26 - DNA, 300 bp, Homo sapiens
cgaggcagttagctagttgtctgtgaaataaaatactaatgattgaactttctaggaagtacctattctgctaatagtgtaaatatacacttatccagggtcagaaatactcaagtttacccacttaaaagatctagaaaatacatgaacttgggcttacttgccagttaaaattgtttatctcagaattgtaccatcaccttaattaaagtagatatgctaggattatcctgataactaattaacatagcctttccccttagtgttcttcacctgaatgtagtagtggactcttcaagt

SEQ ID NO: 27 - DNA, 277 bp, Homo sapiens
  misc_feature (1)...(277): n = A,T,C or G
gtgctgcagacaacacaccttcctgatggaggtgtccggctgatggagaagtctgtgggcttgtaaatcatctttgatgttaaccaggccgacgctgtggccacattccgaaagattaaccctgtcaaaccctannnnnnnnnnnnnnnnnnnggatttgatnagcctgtnccanacctctgcagcctcnancggtngtnntaccatagtggggatgaccctctgatactttgncctggtngancatgntgacanntgcttctacagcttnngggac

SEQ ID NO: 28 - DNA, 293 bp, Homo sapiens
  misc_feature (1)...(293): n = A,T,C or G
tggcatcancnagccgtgcagtccgctnttcactgttnnanggcctccnagtgnntcanagcattggacccatctntancaaaagtngaggccaaaaagntnagtgacttgacaagtgncagagtaaccgtgtagacagagcagtgtanacagaaatcaancntcagtcccangngtanacctgatcntggngatcactgccctgagtggcttgccagcacagccagngccatcagtaatttgnangacntancacnnncnnnnttaagttaaaaaacccccattnnnnaagg

SEQ ID NO: 29 - DNA, 300 bp, Homo sapiens
ggctaacttgccttgttttactattgatgtttgtgtcctgtgtccttaacactttaagcagcgtgttctcacctaaaggctaatagttttaagtaagtttctttttctttttttaatttaaaaattaaaaaatttttaattaactttttttaaattaaaaaaaattattaattatttttaatagacaggatcttgctatgctgtccaggctggtcttgaactcctgggctcaagtgatcctcctgccttggcctcccaaagtgctggtattacaggtgtgagtcactgcacctggccaag

SEQ ID NO: 30 - DNA, 281 bp, Homo sapiens
  misc_feature (1)...(281): n = A,T,C or G
ttaaaggatttaaggannnananntncttntggtttgcccnttccnacnntnctgggggaaanganncncnannaggtnattctnnttccctnangccnananggnaacntggnttgnccttaaacntttgnnttanatngggtanntgnntttttnaaaantnggtgccntnaangannntttgagctttgcagtagattatgctgcatcctcgtggcaaaattctgtattcttagtgattgttacaaacccctttattgctgtctgagaaaggaaagat

SEQ ID NO: 31 - DNA, 300 bp, Homo sapiens
gtcaagggctgcatgaagtgcgagggccgaagagtctgtgtggactcagtgggacatgggcgtggaagagcagggaggtctgaatgggaagtaaagacacagatgcgggtatgcacacagttctttgaagatgctcggccgaggagacaagagtaatcaggtcaggggcaaaaaggggtactcgcctgaggaagtaaacattggatgtccacagctcagagttagttcaaggtcacattcaaattagataccccgatttcccccggcctgctgtctaaatgccaaatcaagtcatggctt

SEQ ID NO: 32 - DNA, 300 bp, Homo sapiens
gagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagta

SEQ ID NO: 33 - DNA, 286 bp, Homo sapiens
  misc_feature (1)...(286): n = A,T,C or G
gtccagggcccangttttaatttntttttaaaaagctttaggtcttgccgggacggtggttcacncnnnnnnnnnnnnnnnnnnnnnaggcctaggcgggtggatcacaaggtcagcagttcaagaccagcctgaccagcatggtgagaccctgtctctactggaaatacaaaaaaattggctgggcgaggtggcaggcacctgtggtcccagctacctgggaggctgaggcgggagagtctcttgaaactggaaggcagaggttgcggtgagccgagattgcgcc

SEQ ID NO: 34 - DNA, 300 bp, Homo sapiens
  misc_feature (1)...(300): n = A,T,C or G
gtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaannnnnnnnnnnnnnnntttgntcctgcgctgtacnnanaccttanantgggtaatct

SEQ ID NO: 35 - DNA, 300 bp, Homo sapiens
  misc_feature (1)...(300): n = A,T,C or G
attgaggaagatctaggtaaaacctttaagttaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtatatcgggataattccaaatttgaggagtggtgtattgaaatggctgagatgcnnnnnnnnnnnnnnnnnaaaggaaaagctnancacgaagaggntaaggagctgtaccaaaggttacctgc

SEQ ID NO: 36 - DNA, 294 bp, Homo sapiens
  misc_feature (1)...(294): n = A,T,C or G
gcttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggannnnnnnnnncccctggncaagcacnacacacatgtngccccancccacggcttantcctcanntcacgcgctgtacnggaacctctncnctgcctnctgcaccctgcaggntnnaaactacngcacccactgataa

SEQ ID NO: 37 - DNA, 300 bp, Homo sapiens
gtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtatgaaaccaagggctgctatatgaccggagctggatggttgtgaatcacaatggtgtttgcctgagtcagaagcaggaaccccggctctgcctgatccagcccttcatcgacttgcggcaaaggatc

SEQ ID NO: 38 - DNA, 300 bp, Homo sapiens
tcttgttcaacattatatccttagggattagtacataggcttgcaaatagcaggtatgaataaaaaattattgaatgagtaaatgaatttaaaatataagttacttaggcggtatcttcaggcatatctgtgtttatgtggtattcaatggcccacaaatgtctacatcctaattcctaagatctgtaaacattaatttgcatgacaaaagagactttacagatgtgattaaatgaaaggattttgacatgcagataatatcctgtattcttcatgtggaaccaatgtatttacaagggt

SEQ ID NO: 39 - DNA, 300 bp, Homo sapiens
cttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggt

SEQ ID NO: 40 - DNA, 285 bp, Homo sapiens
  misc_feature (1)...(285): n = A,T,C or G
aatttcnctttcnnagnttncgnncggncttaangntttttngggcnaaagnccccntnnggngnctantttgtgatncngngngaaaanatttttctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaagaataa

SEQ ID NO: 41 - DNA, 300 bp, Homo sapiens
gtttcatttaagaagaatgagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggact

SEQ ID NO: 42 - DNA, 300 bp, Homo sapiens
  misc_feature (1)...(300): n = A,T,C or G
cgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaannnnnnnnnnnnnatcctttggncgggttctcccaaattnttttgaggggnccatggncaacngcttnagctttgttttggcaaccccntgcccnaagncncatataggctgtncttnaccttgtttccaaggctgaggancanaaagtancctntgtttt

SEQ ID NO: 43 - DNA, 300 bp, Homo sapiens
ccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatctataaaaatccatgctttacacctggacagtacacagggacttcagagattgcacgttggaatacattctcccaagactgaggttgttcggttttaattcctgtagtccaatcacacaatttcttatggaaaacct

SEQ ID NO: 44 - DNA, 300 bp, Homo sapiens
caaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgctctcctgccctgcaactcaattgggcctttttcggtgacctcatccaaggcca

SEQ ID NO: 45 - DNA, 300 bp, Homo sapiens
cttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcact

SEQ ID NO: 46 - DNA, 300 bp, Homo sapiens
ggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacat

SEQ ID NO: 47 - DNA, 300 bp, Homo sapiens
gttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgcgatggatttatggagtatgtgggtatagaaatca

SEQ ID NO: 48 - DNA, 300 bp, Homo sapiens
gatgtcactagacaactggcagtttaatgctcacacccctgaactagaagaggttccacaggatccctggccaatgccagggatctttaggtcagcagtcatgtcaagatgctctgattctccacaaacccagcttctttcccaaactgcagggaggtcggtctgcagtgacttacctagtattttgttgtatccctggctcacagtgtctccccggtctaggatcttcgaatcgaaatcccatgaagcacatattgcagtgctctctgactctcacccctgaaatagagctggtgggat

SEQ ID NO: 49 - DNA, 297 bp, Homo sapiens
  misc_feature (1)...(297): n = A,T,C or G
ctgtttcnntcctaatggatagttagctgatttctgttgtttttctctganaaccaatgttgcaatgtgtctttagtctggatagctattgttaaactgcctacaaagtgagcagatctattaatatcagtttacacttgggcctttggggtttgagaggacctttttctctgcaaccatctgtgggctgatttttgcattttacttgtgataacaagggagggtaactgccccctttccatcatcccccaaaagggaaaaaatgagcactagcataaaagttctttggagaaatat

SEQ ID NO: 50 - DNA, 300 bp, Homo sapiens
ttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggtggagtagttgtgggctggacaaatcaatcgtgggaaattgttaggagttttat

SEQ ID NO: 51 - DNA, 288 bp, Homo sapiens
  misc_feature (1)...(288): n = A,T,C or G
agttctnttaacaggatnnnatcgattcnaattnggcntnangnntggccnccctggggtncncaccagaagntcgganaaaggcccaaggngnangccacgcccagcagtggtnattgccccccactccttttttgagtctatnagcattgnttggttttagctgtcatcagaagctgtgagggacccacagattttggaaacgacctggacacactattgggaaggagatgtggacggcctgtctcctcctgcagggcccaccctaagaatgtatttttaaacaca

SEQ ID NO: 52 - DNA, 300 bp, Homo sapiens
agaaaggataatggagtttctgtacaagatttaccagaaagagagtggtgtgtagacatgcctggagcagacaccttggagccgctgacagaaggtgaagcagtccaagaaaatgtggaaacttttccgctgctctacacagtccacaaacctgtccattttatttcgttgaagctttgtctgagagataaccaaatagacagtcaaagtaagttatctcagccacatatggggagtggatgctgctgaattgtgattaattgggggagccatataggtacatttggcatgatctgggcc

SEQ ID NO: 53 - DNA, 298 bp, Homo sapiens
  misc_feature (1)...(298): n = A,T,C or G
gctactcttacgcactcacgttcattaactgcgttctgatggcagaaggtagacagcaactggacaagggtgaatttacggagaagtacgtggtcccgcggacaaggctggcatccaagttcatcacactctaccgggcgatacgggagcatggcttctacgtcactgactgtccccagcagcaggcacaaccccctgagggcggcggtttgtgctgagagctatgtaagcgcagcctnnnnnnnnnnnnnnnnnnnngttgntacctttnatcataactatggatatctaaatgcat

SEQ ID NO: 54 - DNA, 268 bp, Homo sapiens
  misc_feature (1)...(268): n = A,T,C or G
agtccctgagaggtggtgggaatggctgcttcattcctcgaggatgcccgggccccacctgggcttgtctttctgtttagagggaagtgtaacntatctgccatgaggaacataaattcatgtaangccattttctcttatncannncntntctttctangtacantcnttntctaggatttgngaagctncttgcncttgnaacaggnctcangtnngngnancnntttngnnnttnccncnnntcntgntgnttttttcntntnnt

SEQ ID NO: 55 - DNA, 278 bp, Homo sapiens
  misc_feature (1)...(278): n = A,T,C or G
aatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggatttcttatttggngcncttnnctgnntancntnnnnctnnttnattngggnntcctntnanctnttgtnnncatcgnntaagttagtt

SEQ ID NO: 56 - DNA, 254 bp, Homo sapiens
  misc_feature (1)...(254): n = A,T,C or G
ggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagnnnnnnnnnnnnntntacncncaggcnttnnntnttnatnnccnnngtcnccttncnantnnatnttnantncnnnnttngnagntatctngtcgtnntcctt

SEQ ID NO: 57 - DNA, 300 bp, Homo sapiens
  misc_feature (1)...(300): n = A,T,C or G
gagacatcatgtcaacagaaatggagatgtgcactggggaaactgccggccgggccgctggcccgtggacgcctgggaggtggccaaggccttcatgccccgaggactagcagacaaacaaggacctgaggaatgtgatgcagttgctcttttaagtctcatcaacttctnnnnnnnctntgnngcnnatgtntacantgccaccaacgtgnttntgtgnactcgcncantcatggactatctctatgatnatgannnttctaggancntngnggataatactacnttnnantccttctg

SEQ ID NO: 58 - DNA, 300 bp, Homo sapiens
acaaggtgctggcagtgaagtgggggcagactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctacaggtgacagttgttggtgtccagttggatatgtaccatgaagggaagaagcagtcagagtgggcaccaagctttctagcctggaggactgaatggttctgtgcacatt

SEQ ID NO: 59 - DNA, 300 bp, Homo sapiens
ctctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagt

SEQ ID NO: 60 - DNA, 300 bp, Homo sapiens
aacgtgctgtacaccagcctgcccgtgctcctcatggggctgctcgaccaggtaggagcctcgcacaagcagggacacttctggacagatgagaatgcgttagagaagtcccaagcaaacgtttcaatgcattcttctggtgtttacttctttctgatcaaaccctattataattctgttgtcaggcatcaagggtcatggctgtgcttcttgttttgtaataaggaaagaggatttctctgtagtcccagctactcgggaggctgatgcaggagtatgacttgagcccaggtgttcaag

SEQ ID NO: 61 - DNA, 300 bp, Homo sapiens
ctgttcctaaccctttcaactggggggtctcaagtgggtgaggactccatggccacggcagcagaactgtctcttctgaaaaccagactccggggcccctgggtcagcacctctaggtcattccacagacttacacagtttaaagaaagagccagcgaacatggggtgatcctggggtgccactgggatcccaagccaggcccggaggtctgcctgtttcgtccccagaaacttgagctggcatcctccgttggtttgcactgggcacggggactggagagccaccaggccactgagcgc

SEQ ID NO: 62 - DNA, 300 bp, Homo sapiens
cctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagc

SEQ ID NO: 63 - DNA, 300 bp, Homo sapiens
  misc_feature (1)...(300): n = A,T,C or G
ccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgcctgagcagnacggangtctttacgtgaacccacttga

SEQ ID NO: 64 - DNA, 300 bp, Homo sapiens
gagttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcaccgtgagaagcagaaagagctggtaaataaagccttgggcaagcgacttcttagatcagaa

SEQ ID NO: 65 - DNA, 299 bp, Homo sapiens
  misc_feature (1)...(299): n = A,T,C or G
cacctgaccttggcctgcacccccggcagctcccccacacttttgcgctggttccacgactgcctgggcttttgccacttgccgctgagcccaggtgaagatcccgagctgggccttgaaatgacagcagggtttgggcttgggggaatgagaggttacagcnnnnnnnnnggccatgangggcananattgnatcccacatatttgannngngcngagancccttttnggggggngtaaangtacaacnangaagcnctnttaggactaaggtttaanaaagntgctttttacccatt

SEQ ID NO: 66 - DNA, 300 bp, Homo sapiens
atttgtaccaactgtaccatctgcttgccactgctccaaacttttacccacttgcttttggtaaagaggtcacctgcgtatttaaaatatccttttgtaatgtattgggaaggtgcgagaacatatgaaaatggttgtcaatggagatggaaggggctttattctcacttaagagagccctgggaggaataaggttttatctggatcaggtatccaattgcattggataaacgtggcctgaggcaggataaaatttaaaaacacaataataagcctcctggtgacatctctgttcctttt

SEQ ID NO: 67 - DNA, 297 bp, Homo sapiens
  misc_feature (1)...(297): n = A,T,C or G
tgtatcgggtcctgttccagccggcatcgccgggtggcttccaggcctcagagctgtgtggcagggccccctgctggggctggacatcactgcagtccagtgcaaagccgnnnnnnnnacccaggtgtnccccccaactaaacnaaactggnggcttggaagccccnncnnatgggaangtncaaaaaaaggtcttggntttctcttctaatgcctttcttaactcctgaantcgtttgctcctaaatcttggtaattctttttctctggattttggtttcttttggctttcccttg

SEQ ID NO: 68 - DNA, 300 bp, Homo sapiens
ccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaacccactt

SEQ ID NO: 69 - DNA, 300 bp, Homo sapiens
ccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcacaagttcacaagatgttccttgaccatactggctctcacctgctgattgccctgagcagcacggaggtcctctacgtgaacccactt

SEQ ID NO: 70 - DNA, 300 bp, Homo sapiens
  misc_feature (1)...(300): n = A,T,C or G
gtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccannnnnnnnnnnntgaggaagaggaacaggcanatgtcaatgaaaagaaggctgatctcattggaagtctcacccacaagctggagaccctccaggaggcg

SEQ ID NO: 71 - DNA, 300 bp, Homo sapiens
tcaggccgctgggtgacggtgtgctggccagatagttcctggggctgcaggtggcttctttcgccccatccctcccatcccctttcattcttcctgtcaacacatctcagaccctggacaccgaatgagccgtcggtacccacaccccagggcaattcagtggaggggtaggtggctcgttcccccacgttgccccaggaagaggaccctgtccccggcatcctgacccacctcccttagagaccgagagcctctaaggataaacccattcacccgtgtttcagaggcttttttttcctc

SEQ ID NO: 72 - DNA, 300 bp, Homo sapiens
gttcagggttggtgggtctgtggaccttgagctagtttttaatcaacatggaaactccagtgatctatttaaaaacttgcattgggtcatgccaggtttattggaggttataccctccaatgtatttccaactcagggttaaagccaaggtccttatggtggaagatggggcatataaactggcattctggcgctcacacactccaatatctactactctcccctcttgctcgctcagctgtggcttgcttattcagctttttgctcttcctggaatacatcaaacatatgtaggcccag

SEQ ID NO: 73 - DNA, 300 bp, Homo sapiens
ctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagagga

SEQ ID NO: 74 - DNA, 300 bp, Homo sapiens
  misc_feature (1)...(300): n = A,T,C or G
gggattaacaatgctgaaggactcttagtagtagtgactgtcatctgtgcccctctaactttcctgagcctcacacacaacctgtgggcaggatggagtagatcatgttgctgactgctgccgtaggcaagtaaatggagccagaaagtcccactgttgacagggtgccacagctgaccagggactgtcattctctccacccacaggctgtggagggtgaccacagcatgtgcccacctccaccaatccgcaacgagcagccggnactggtgctgnggcagaggntgccgtcattgccca

SEQ ID NO: 75 - DNA, 300 bp, Homo sapiens
tgggggctctgaagtttcaccaggtggacgctggggagcgggctcccgagcacttgtctacctcccgccagtcctgacaacttttctggccaacctacccagcttcgcttggctggcgagcgcatctgctgctggggttcgcggtgcagatggagacgcagtggtggccagagggtgatggagaagacgggaaaagcgacagccacgctcctggctgaagccgcaggacgcaaataacttactttgtacctgacagtttctcacgttgttgtggaggccctgtttcctggaaataaactc

SEQ ID NO: 76 - DNA, 300 bp, Homo sapiens
gcagggcagggctaaagttggaaatggaaatgaaggagcaggtagccatgcagccttgtgctttccagcaacagggtggacacttggtcccaagaggacgcagctgaaagaccctctggcagggagaacgtgtgaggactctgtggtggattctgagttgtgcctctctggcttaatctcatctgattctagcagtaactccaagaggtaagcacatttgtgagtcctgttttccaatggaaaagctacatgaggcccaccaggtcccagaactcaacaatggtggggctggggttcaaa

SEQ ID NO: 77 - DNA, 296 bp, Homo sapiens
  misc_feature (1)...(296): n = A,T,C or G
aaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagntctccagtgcccgcntanntgnntacnttgntngtngtngntgatttt

SEQ ID NO: 78 - DNA, 300 bp, Homo sapiens
tgaaaaaaatcacagctcctgcagcaagtctatgcctgggtaacaaccaacccacaaaatccaagaggaggtccccctctcccgcctctgtgaggcttgaggagcagtatgtatctgggccagcctggtcctcagagtgtggaattaacacctttcctctagcaactgtttgtgctgctgagaacagcacagactctctggcagcctggttctctccagagggaagcctgtgaagcagaagaaacatatggcatctgcactcagggcgcccagttccatccggccttgctataaaatgac

SEQ ID NO: 79 - DNA, 300 bp, Homo sapiens
  misc_feature (1)...(300): n = A,T,C or G
caaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagancccttccttagcttcggagactccagacaatcgccttttgcctcctcgtcggagcacgccccatattagtggtccgggcccgggcaggcccagctcaaaagagggcagacgcagcgacacttgttcttacacacccccat

SEQ ID NO: 80 - DNA, 300 bp, Homo sapiens
ctcccagcctcctcctccaacgcccttttgatccaagattgagtaagagacattggcagatgctgagaaggacaacccaattgttttaacttgcagaccgagggggagatgggttccagtctgcacatgactcgtgcacagtccccccaccccaccctgacttagaaaattccaaaccgactacaagaccagaaacaaaccacatgccagtcgcccccttgtctgtacacacatgtggagttcagagccacccttggagagaggctgctcaggctcagctccctgtgctgggctttctag

SEQ ID NO: 81 - DNA, 300 bp, Homo sapiens
acatagcccccacccctgagggatgagacagctccctgcaggcaggctgtgcccagtcatctcaagcctacagctgggctgctggctgcagggtctggagggcggtggggagggtggcagacagagtagcaagacccccacttccctggccttcttcacagacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtg

SEQ ID NO: 82 - DNA, 300 bp, Homo sapiens
ggaagaggatgactgggtatgctgtgccacccttgagggccatgaatccactgtgtggagcttgggctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtt

SEQ ID NO: 83 - DNA, 300 bp, Homo sapiens
  misc_feature (1)...(300): n = A,T,C or G
cagagctgtatcttcagtggtgtgatgaagctacagtaggggagatcactcatgctaggtatggatctccttacccttggcctctgaatcatattttggcctatcaaaaacagtggnnnnnnnnnnnnnnnngtaaaaaaattttnggnggggggagaaaaaatcnggacccggtgttanaggatgtagaccagtgctgtcaagctctctctcaaagactgggaacacaaccgtatttcttcaataagcagcctactgaacttgacgcactggtatttggccatctatacaccattctta

SEQ ID NO: 84 - DNA, 300 bp, Homo sapiens
gtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaagg

SEQ ID NO: 85 - DNA, 300 bp, Homo sapiens
  misc_feature (1)...(300): n = A,T,C or G
tggtgcccatattgatgtggatanacagaaagataagaatggcgagagaatgatcacaataaggggtggcccagaatcaccaagatatgcagttcaactaatcaatgcactcattcaagatcctgctaaggaactggaagacttgattcctaaaaatcatatcagaacacctgccagcaccaaatcaattcatgctaacttctcatctggagtaggtaccccagcagcttccagtaaaaatgcatttcctttgggtgctccaactcttgtaacttcacaggcaacaacgttatttacgtc

SEQ ID NO: 86 - DNA, 300 bp, Homo sapiens
  misc_feature (1)...(300): n = A,T,C or G
gaattccattaccanatgctactngctctttgttgctttatcncnangccatcgattcgaatnnaggacgagncgannggtatcgncanngatngntntnntncgctcntgacccatangcttngnatngggatnnagngacagtntcntgnnaaacatctatnacnntnatganggctatcnntttaatgatnttgagaatnatgacnggcttgatgactanaacaatgcngaagatnancgccactgatggtggnacatacttccctcttttactactcgcctnacaatcacaatctg

SEQ ID NO: 87 - DNA, 300 bp, Homo sapiens
gtgcgctgtccaggaatgacgtgctgaagcaggaggtgccagagggctttccctttgcccatgtcctttgggcaggatgtggatgcagctgtcggggcagctctggtcatgctccggagacacctcaaccagaaggaatcttagacagcaaactctttcgccaaacgactgctgtgaattttacctgattaacattcctgacaccatctgtgggtcatcctttccctggaccgttcagtggacagctttcaagcagtgcttgttgtgaggtcccatcttggccaagaacttaccttcaga

SEQ ID NO: 88 - DNA, 300 bp, Homo sapiens
ccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcct

SEQ ID NO: 89 - DNA, 300 bp, Homo sapiens
agaaatcggaacaaaagtagaagttgtggaaaggaaagaacatttgcatactgacattttaaaacgtggctctgaaatggacaacaactgctcaccaaccaggaaagacttcactgaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgc

SEQ ID NO: 90 - DNA, 300 bp, Homo sapiens
ttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttga

SEQ ID NO: 91 - DNA, 267 bp, Homo sapiens
  misc_feature (1)...(267): n = A,T,C or G
ataggaaagggaagcccatttcccaggtcaaagcctttgcttactcgtttatgtttattttatttttgagacagagtctagctttgttgcccaggctggagttgcaggtgcaatctcggctcattgcaacctccgccttttggattcgtgcagttctcctgcctcagcctccaagtggtggggatcgcaggcacacgccaccatgcctggctaatttttgnnnnnttannggctgncncngngaancctnnnntntnctnnnnntnc

SEQ ID NO: 92 - DNA, 300 bp, Homo sapiens
aaaaattgtgatgtaagtggtacagtggggagaatttagggctctcagaatgcagaaaactagccacctccagttctgtgcctgaccaccatctgactttggataaatcccttctgctctcccacctagctttatcatttgtaaaatgagtctctaggtacagccctttctgggttgagacagagtttctgaggagtaaaagccatgtcattgtggaaacaggcagctattctcacagctggcatgagcccactactcccctataatcagtgctgataaactgctctcatttgttggact

SEQ ID NO: 93 - DNA, 277 bp, Homo sapiens
  misc_feature (1)...(277): n = A,T,C or G
agtgtatccagatctaagtaatctcagtgaactatacattgcctaaaaagtggttttgtaatgatttgtagtcacatttctattgggatatgtnnnnnnnaaggcgaaatgcttaaagttccttttattttttaaaagcagntagatagacacagacttgccacctnatacatctgctccttggcaacatcnnggggaacnnactagccnacatgcctatggctaaaaactttnctttgcnnactancgcnctgnttggngcttcngnttntannnt

SEQ ID NO: 94 - DNA, 300 bp, Homo sapiens
  misc_feature (1)...(300): n = A,T,C or G
attcggcacgancccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaagctggtggacagatctgctctgtggaggggcgggcaccagntccacttatgtgcctgtgctccgagggccaatgggctgcagggcctgcttggaggaaggatttgtgtgtaggaggcctctccgagggcaattctgtt

SEQ ID NO: 95 - DNA, 300 bp, Homo sapiens
aaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctgg

SEQ ID NO: 96 - DNA, 283 bp, Homo sapiens
  misc_feature (1)...(283): n = A,T,C or G
gtaacctgacacccagggagggagggagggaggggctgnnnnnnnnnnncctgnanngngggnctcacctgttctnnnttnttnttnttttnnntntangntcacnntngttancatnntttntancttgnntttatttntntttnttttntnanctttntttntnttgttntnnttctttttttncntttatttttgnnttctnccntnntntttntggtttttanttnntntttntttttttnttttntntttnnnttngnttctnttntntgtcttcttt

SEQ ID NO: 97 - DNA, 277 bp, Homo sapiens
  misc_feature (1)...(277): n = A,T,C or G
gtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgnnnnnnnngnncgggacatttgccctcagtggtgtggttnc

SEQ ID NO: 98 - DNA, 300 bp, Homo sapiens
aagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggagtccccttaggctcgaatgcccgagaagaga

SEQ ID NO: 99 - DNA, 300 bp, Homo sapiens
gctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaa

SEQ ID NO: 100 - DNA, 300 bp, Homo sapiens
aagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttctgtataaaatgcaa

SEQ ID NO: 101 - DNA, 300 bp, Homo sapiens
atgttgcccaggctggtctcaaactcttgacctcaagcaatactcctgccttggcctcccaaagtgctgggataataggcatgagccatcatgcctggccgaacttatttttaaattctttgggaatctaaaaggactatgtgctttcttttttactggattatgtgagaagataatagtttgcagagaaattcagtgaagcagctgataaaatgctttaaaaatatatttcagagaattgagcaataacagtgatgtcaaaatagtagccccaccttctccagcccacctaaaccaaca

SEQ ID NO: 102 - DNA, 300 bp, Homo sapiens
gatgcaagggctgaagctgaaacttcagagagcatcggcatttaaggaagaaccttggctgggcgtggtggctcacgcctgtaatcccagcactttgggaggctgaggcgggcggattgcttgagcccaggagtttgagaccagctggccaacgtggtgaaaccccgtctctactaaaaatacataaattagctgggcggtagtggcatgtgcctgtaatcccagctactcgggaggctgagagaggagaatcacttgattctcctgggaggcagaggttgtggtagctgagatcgtgcc

SEQ ID NO: 103 - DNA, 300 bp, Homo sapiens
attttagtggttttacagtcatttttcatttaatatttacagaagtcctatgaaataatgactgtgattagatactgttattattaaggaaactgagccttagagaggttaggtaacttgtctaaggtagagctatgatacaaacccgggtctcattggttgggcatttgtgtcagtcactgagtataaggtaactgggacaaggagctcaagcagctcgtcgtttagtatcagagacagagagctcaggccatggccccactatgaacaaagtggtcttaggacacagaaaaagagtga

SEQ ID NO: 104 - DNA, 300 bp, Homo sapiens
gcctgtagtcccagctgctcgggaggctgaggcaggagaattgcttgggcccgggaggcggtggttgcagtgagccgaggttgcgccactgcactccagcctgagcaacagagcgagactctgtctcaaacaaaaaccaaaagacatcaggaaacatgcctcttatggaatttgagggggaaaagtcagggtcttggcagtgaccttggacaagccattagcctcttgatacctcttttctcatctgtaaaatgaaggtggtagttacctacttcacagggttattaggggattcaatgt

SEQ ID NO: 105 - DNA, 300 bp, Homo sapiens
cagaggctttgctagtatccttcaaccaatttctagtaaaaatatcctatataaccataattatcaaaaccagaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctat

SEQ ID NO: 106 - DNA, 287 bp, Homo sapiens
  misc_feature (1)...(287): n = A,T,C or G
acctgagctagggttgcagcagaaattgagttgcagcttgcccttgtccagacctattttctgcttgcgtttttgaaacaggaggtgcacgtaccacccaattatctatggcagcatgcatgtataggccgaactattatcagctctgatgtttnnnnnnnnnnnnnnnataatgcganagangccatcacnntnctattgtgtctnaantntngccntgngntattccatgncntcntnntatnnanctntacnaatangttttacgtnatncnnttcgatttttg

SEQ ID NO: 107 - DNA, 300 bp, Homo sapiens
ccctggatgaaaacctaggcagtaccattcaggacataggcatgggcaaatacttcatgactaaaacaccaaaagcaatgtcaacaaaagccaaaattgacaaatgggatctaactaaactaaagaacttgtgtgcagttttatttgggagtgtgtgtggggtacctctgagtttcaaaaatgaagaaagtaagtagtcatgctttcctgactctttggtagacatagcctttaagacagtcattctgagctgttatggtcttagggttccctatactactaaaacttattgatgacatg

SEQ ID NO: 108 - DNA, 285 bp, Homo sapiens
  misc_feature (1)...(285): n = A,T,C or G
atgcccntagtacgcaacaantccttcntgctccaagagtaggaaaattactgttctntntgccagtgagattcctcttctggtattacctttgcttcaaagtccctgaattgcccattccccacttcatagcacttattgctatctggaattacactaaatgtcaccttcatgatggtaggcaatttattgccttagtcacagttatgtctagagaacaagcagctggctcatagtaggcactcaacaaatatttgttcaatgaatgaatttataaatgaatgc

SEQ ID NO: 109 - DNA, 300 bp, Homo sapiens
aattgtaacttattccaggataaatgtcatatgcatatgattttcatatgactttgatgagtatcttcagggaaaattcctaaaaatgaaattgctggattaaggggtaaatgcatgtatagttttgttagacagggccacatacccttccttagaggtagtacccttttgtattcctgccagtaatatatgagagtccacagagtatgtggttaagctttagaatgcttgtccatctgatagggaagaaatcgtgttgccttaatttgcccttcttttattatgaatcagattttaatc

SEQ ID NO: 110 - DNA, 300 bp, Homo sapiens
cagccaatagccatgtaactgagcttggaagaggatcttgctgtcctggccaacatctcactgcaattctatcagttgaattccctggatagtccaagctttgtggatccctccaccagaacaactggatcccagtacctgaatcctgaatcttagactcttatacttcaaacactgatcacgggaacagccggctcagcagctcctgagttcctaatgctcagaacatggatgagatgataaatgtttgttgtgttaagctgccaacctttggcgggggggtattcgtcacaggcaaca

SEQ ID NO: 111 - DNA, 300 bp, Homo sapiens
aagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaa

SEQ ID NO: 112 - DNA, 300 bp, Homo sapiens
ggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgagtgattaatgcattctaaacatcctaccccactttataaacggacgtggggaacgcttggtcatttaagccaacaataaatttatgggaatgtccctaagtgtttactgtctttatccagtcaaggatttgcttttccttgaacat

SEQ ID NO: 113 - DNA, 300 bp, Homo sapiens
gacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccac

SEQ ID NO: 114 - DNA, 291 bp, Homo sapiens
  misc_feature (1)...(291): n = A,T,C or G
ggggggnnaaaaaannnatttnannnntttttttncaaannanagggggntntngntttttnnattaaaannnccggggnnnnnccatnnngttttttttaaaaannntggnaannctnnggngtnggggcccctnaantgttttnaaagacncccccttccaaattttgaaaacattgtaattggagaagaaggtanctctgcaaggttaatctgtcattctcaatttgccttattgtcttgtttattaagatgttggaaaagcaggaggtagctgtgcctcaattattg

SEQ ID NO: 115 - DNA, 300 bp, Homo sapiens
aaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcgggaaaaaaggca

SEQ ID NO: 116 - DNA, 300 bp, Homo sapiens
aacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcggtgaaataaaggc

SEQ ID NO: 117 - DNA, 298 bp, Homo sapiens
  misc_feature (1)...(298): n = A,T,C or G
caaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattggtngnnnnnnnnnnggtanatncatgtgaac

SEQ ID NO: 118 - DNA, 300 bp, Homo sapiens
cccgctgagtggcagtggcaggaagtcggtggaagcagatccctgtgcagaagttgaattaccagggcggccacacacgggctgcacaacctttgcagtcgtgcacggcaagtgggatgtggcctccgcccatgattgggcacctggtcaggctgggagatccaaatagcacccagtgggcagctgtccgacccctggaggggcaagccaggaaagaaacttagggcccgctgtgaccagatgtccctcccagttgggaagactaaactggtttggccaatatctcccaggattcccctg

SEQ ID NO: 119 - DNA, 300 bp, Homo sapiens
  misc_feature (1)...(300): n = A,T,C or G
gaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagacnaaagaaccttaattttttctcttggactgcaataaagtatagctgcctaaaatacgtttcctg

SEQ ID NO: 120 - DNA, 300 bp, Homo sapiens
atttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaa

SEQ ID NO: 121 - DNA, 300 bp, Homo sapiens
ggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgt

SEQ ID NO: 122 - DNA, 300 bp, Homo sapiens
  misc_feature (1)...(300): n = A,T,C or G
ctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgnnnnnnnntgattgtagcacactttggccaccaactcctgggctcaagtgatcctcctgctttggcctcctctgagaagctgggattactggggcacacca

SEQ ID NO: 123 - DNA, 300 bp, Homo sapiens
cacctttcctccagtttccaataacacattcctcttttccacctgagacctcaccagaatcacctttaatgtctatattcctaccaatagtctttttaaggcaatataggctttctctaacatgcacttcaaacttcaagatggaggggatgccatacaacaggactatgtgatggtttttggctgtgtccataggaagtcacaacaggcaagggaaagaaaccagaacccagtcatggagttaagaagtgagtcagagagtagatgggtagggacagtgaggtaaggcctctttctaag

SEQ ID NO: 124 - DNA, 300 bp, Homo sapiens
ggaactatgcccctcccactcccatcattgccaattaagtctttttcccttaaaaatcagctaaacatctttccccttgatcccttagttatgtactctcattcttcgtgtactccatgtgattcaatagcacagatacttcagtagcacttaccataattgccatgaaataattgtgtagtttgcttaatatttgtttctcatattagaatgtaagctccatgagagctaggatcatgtctgatttctttgccattgtattgcagtgcctaaaacaatattttacaaatttaagtaatt

SEQ ID NO: 125 - DNA, 276 bp, Homo sapiens
  misc_feature (1)...(276): n = A,T,C or G
accatttctgtacaacacaagctggccttggcagtttcggtgcatagaaaatcaggtcctacagctcgagagggcagagccacagtccctggacggcgtggactgaggccggatccttcctggaggcctnnnnnnnnnggggaccccagnanctcatcatcancattgctggagccaaggagtctgntacccacgtnnnntngnggatgcccgatgncngntttggtnttnttgacntgttnntgntnaantnnttnnngnttctantnntctgat

SEQ ID NO: 126 - DNA, 300 bp, Homo sapiens
cctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcag

SEQ ID NO: 127 - DNA, 300 bp, Homo sapiens
cataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatt

SEQ ID NO: 128 - DNA, 300 bp, Homo sapiens
aggtgcatagagttttgcctataatcccaacactttgggaggctgagatggggagatcgcttaaggccaggagttcgaggccagcctaggcaacatagcaagacccccatctctattaaaacaaacaaacaaacaaaatgttaaataaaggaagcagatgagtatgtgctaactaggctggcatgtgtctttgttggtgacatggagcctctgtcatcccctcacagactgcatacgaggattggttcatcaccctctacaacgtgctgtacaccagcctgcccgtgctcctcatggggc

SEQ ID NO: 129 - DNA, 300 bp, Homo sapiens
gacccaggtagaccagctcaagagttcatgttctttgtcatcctcctgtgagctctctgtaagtctctttcttgcccatcaccacatccctagtactgggtatcagtctggccacttggctttctggtttgccccaatgtggtctattcttgatgcagctaccaaagtaatgttttaaaaccattataccaagttactatccttgtcaaaacccccagtaactgccaatctcacttagaataaaatccggactcctgtgaagcacagcataaactggccactgcctatgcagcaacctca

SEQ ID NO: 130 - DNA, 300 bp, Homo sapiens
  misc_feature (1)...(300): n = A,T,C or G
gtcgaatgaatcctttgtcgcctttagcttttagtcctttgaagagaggtgagagtggaaatcaagagatttttttccacggggaagttctttttacaaagcgttgatttctcggcaccccgcggggcgggcaactgacacggcctccggtgcaccttctgcgctgtggagcctctggggctcagctgnnnnnnnntcgggtcgtgnggcggtagggcgggagcggnggaagggaaaagcnaangctggaaaagaagcagggcagttgngaaccagacatccagacctcctgaagggctc

SEQ ID NO: 131 - DNA, 300 bp, Homo sapiens
ctggactctgagtcgtcttggtcccaggagccagtagtgaaggcaacagtctgcccacctgtggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccac

SEQ ID NO: 132 - DNA, 300 bp, Homo sapiens
aaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaagaattgcctgggctcaccttgatcgtaagttgacagtgctggactggcagcaaagtgaccgttggagtttaatgagaggaatatactcatcatcagtctatttagaagagatttcc

SEQ ID NO: 133 - DNA, 294 bp, Homo sapiens
  misc_feature (1)...(294): n = A,T,C or G
tagggtaanncngnannaaaangngcantangttnagacnngncnnncnntnacnatnnnngantagaacatntctatnnngnnnnnanatntnannngnnaaanagggttntatgnnagnacnctcntcncnnnnatccattctcatcagcactgtcccaggatcctggagagggagaacccctggccccaggggaaagagggcggggtctcccgtttcctgtgcctgcaccagccctgcccccattgcgtctgcacacccctgcgtgtaactgcattccataccaactaata

SEQ ID NO: 134 - DNA, 300 bp, Homo sapiens
ccaatggatgcaggaaaactgagatgggatttccccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctg

SEQ ID NO: 135 - DNA, 300 bp, Homo sapiens
agactcttcattctatcaccctgtctcacaaaagacttgcccaaggctacgaagcaaggcagtgactagagtccagacatcagaactagttccatgttttttttttcactaccagtccctaggccccaaaccgcagatcctgctgtgtgaccattaagcccctgactgttctaggctcaacttccaaccctttctgcaggtcctattacctctgcctcatcctcccaacatgataaccagagtcttccttcacattgtactgcctacccccttatgttcccaggctctcccttggtttta

SEQ ID NO: 136 - DNA, 300 bp, Homo sapiens
gtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacact

SEQ ID NO: 137 - DNA, 300 bp, Homo sapiens
gctgcatctgcaatgaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcaccagacatctgcctactctcctccacgtgcaggccaagagcactgaagacaccctggtcctcccggaagggcagtcccacaggcagcggcacccatttctgggccccgccacag

SEQ ID NO: 138 - DNA, 300 bp, Homo sapiens
gcagggcagagttctaccttctcaaaccccccagccggcacatcacacaccggaggccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattct

SEQ ID NO: 139 - DNA, 300 bp, Homo sapiens
aaaagatgagtgattttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaaccta

SEQ ID NO: 140 - DNA, 300 bp, Homo sapiens
ctgctccgagtcaggcgcggtaaaaggcattttacatatgttacaaccgtgctctgaggtgggtgttgtcttcttttgcccgaaaaggaaacagagaggttaagaactcccccagagccacatggacagagctgggatcgaaccgaggctccaagtcccagtgttctttccagtacctcatgcatagaccagccttttcctcatcaggcagatcctgcagaactggcacctgggttgcactcagtggcctctctgacgccccgcctgtgtggacctctccaccccctgccttggcagcag

SEQ ID NO: 141 - DNA, 300 bp, Homo sapiens
gccacattctgaggaacatgtcatgttctgggagggctaaggcatcaagtaaggcctgtggggctggaggatcccaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaag

SEQ ID NO: 142 - DNA, 300 bp, Homo sapiens
ggagtgtgttcctcttgaccctggggctgcatctcctcgttggtgacttcctggggttcagaccctgccacctcctccattttggggagcaagatctcatctgtctctgggacaggaggacctgggttctgcactggtgaggctgagtgtggggagcaggctctgagcccccagctccccgtgtcccctgctccccaggtgtacagtgccaccaacgtggagctggtgacacgcacacgcacggagcacctctctgatcaggacaagtcgaggagcaaagcggggaagactccattccag

SEQ ID NO: 143 - DNA, 300 bp, Homo sapiens
caagcgcccatggagctgcccctggagcaggtgcccccaccgagagtgatggaaaagcccgtcctcgccacctccaggcatggccagcagcgagcggctggctctgcaggagaagtgctgggtctgagctccgtcacggccgctcccgagagcccgaggtccaagcccaacacgacttggaataaatgatcaagttatgaattaaacacaagagaaatgtaattaccacaggagccagctgagaataaaatggattacgcacatcacagtcattaaacggtgatcacatgcgcctttcta

SEQ ID NO: 144 - DNA, 298 bp, Homo sapiens
  misc_feature (1)...(298): n = A,T,C or G
gccctgcccaacctgctccagggaccagtggtcttgggaagcttgggctgactgggattgcagactccgggtctggtgtatagggcccttggcaaatccctattcctttctgggcctccttgaagagacagtgggctgagcttctaggctccctttgattcttctgtgtgtggcccagaatgggacagacagactgagctgggcacagaaataccatagtgacagaaccattcgaagaccctgccctgatggaggccccgggccaggggaggaggcnnnnnnnggctgtcnatctgaa

SEQ ID NO: 145 - DNA, 300 bp, Homo sapiens
gcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggtacgaaggggaagtgggtagaagcgggaagtggtgcgccttccttcagccggggctttaagccctcagcttggcgctcctctgtttttccaccgtaggaccttcctgcagacggtgagcagtgagaaggtccgctccactaatctcaactgctcagtgattgc

SEQ ID NO: 146 - DNA, 300 bp, Homo sapiens
aattgatgagccttattaactatcttttcattatgagacaaaggttctgattatgcctactggttgaaatttttgaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacattt

SEQ ID NO: 147 - DNA, 300 bp, Homo sapiens
tgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgtgtttgctatattagcagcaatgtcaat

SEQ ID NO: 148 - DNA, 300 bp, Homo sapiens
attttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttat

SEQ ID NO: 149 - DNA, 300 bp, Homo sapiens
ttcaccaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaagaaaa

SEQ ID NO: 150 - DNA, 300 bp, Homo sapiens
  misc_feature (1)...(300): n = A,T,C or G
gcaggagaatcacttgaaccctggaggtggcggttgcagtgagcacagatcatgccactgcactccagcctgggcaacaaaacgagacttcgtctcaaaaaaaaaaannnnnnnnnnnnnatcctttggncgggttctcccaaattnttttgaggggnccatggncaacngcttnagctttgttttggcaaccccntgcccnaagncgcatataggctgttcttnaccttgtttccaaggctgaggaacanaaagtancctntgttttgaggaggnggaagttaagtatncnttaatttt

SEQ ID NO: 151 - DNA, 300 bp, Homo sapiens
agaaattaaggcctctgggttcaatttttggccccagtgttgacctctgtgtaagcctggcaggatgtctcatttctgggtcaccttttccttgccaacatagtgaggtatgtagaccaaatcattgctaagagccttctaactcctaagacactaggtttagtcagccaaaagcatgtgattttcccagatttcccaaactccttgtaacctaattgaaagtacacaatgaacttgcaagaatttaagcatccttagatgccagtcttcactttgggtattttccagcctcctcagtga

SEQ ID NO: 152 - DNA, 300 bp, Homo sapiens
gcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgac

SEQ ID NO: 153 - DNA, 293 bp, Homo sapiens
  misc_feature (1)...(293): n = A,T,C or G
gagcttcggaagctgccagtgccacagggacccaaccccgtggtggtggtgctgcagcaggtcttccagcttatccagaaggtgctgagcaaatggttgaatgatgcccaggttgnnnnnnnggtgtgctctatctttgataagtttgntnntanactgctgnatgactttnanntcatggtgcanaaatgtgaaagatgctttgccaaatatgntaaatantgcttggggccttgttntgaattttcntcaatntnnccatanatgatgnatctttanngntcaccctattc

SEQ ID NO: 154 - DNA, 270 bp, Homo sapiens
  misc_feature (1)...(270): n = A,T,C or G
tatcagacaatattttattattttttcatagatgttctgccacacaaagaacttggggtgtaaggataaggcaaaagctccaatcccattattcagttctcctaggatgcacccctcagggagcctggccagagttccgaggccnnnnnnnnnnnnntgncncntgntcnacnntgnnnggctncggcgcaggcnngnctgagnantnccatgangctgatagnannctgantctgccggngaacngtnagganagagacnttactcgga

SEQ ID NO: 155 - DNA, 300 bp, Homo sapiens
ctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccct

SEQ ID NO: 156 - DNA, 300 bp, Homo sapiens
  misc_feature (1)...(300): n = A,T,C or G
ttgattaaaaacngcctccttaacctctgaagactgattttgctttatcatgtttcaataataacatttcagaggttactctgtagccccagttgtaagcttataaaaacaaactggaaggctgaggaggttatgggctggcagccaggctatgtttacagctgctggagatggcagtagccttatactttgagcaggtagtacatcccaggctgtgctagaggtagatttgttttttcacgtttgatctgtggctggtggccacctttgttgatttgggcttacgagtttcatagtagc

SEQ ID NO: 157 - DNA, 300 bp, Homo sapiens
gttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgta

SEQ ID NO: 158 - DNA, 295 bp, Homo sapiens
  misc_feature (1)...(295): n = A,T,C or G
ggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccagagcccggtcccttgnnnnnnntaagctgnnnnnncactgggagactntgntantgaaatnctnntcctnngctaatttantcntanncgngnggtntcttncctgnnnccaagncancncatgcatgtttt

SEQ ID NO: 159 - DNA, 300 bp, Homo sapiens
aagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccaggga

SEQ ID NO: 160 - DNA, 300 bp, Homo sapiens
tgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggcc

SEQ ID NO: 161 - DNA, 300 bp, Homo sapiens
cccagctggacctggtggccctttcctagtgcctctgctgggggaggagagcctgtgtgcacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagccccatgcacgtggaggaggagctggctttcagccccagaccccacgctagcactttccacgctgcttgcccgctgatgat

SEQ ID NO: 162 - DNA, 300 bp, Homo sapiens
gtccttgtccagcctccaagacccacaagtcccttcctctgggaagcccccctggcctggaggtgcaccaggaagaagtggtctggggctggcactaagccatggcccagggaagactgggggacccactaggccaggatgagacctgcacgcagtggctcacagcagcacgatttgtgacagcccgaggcggagaacaccgaacacccagtgaaggtgaggggatcagcacggcgcggccacccacgcacccacgcgctggaatgagactcagccacaaggaggtgcgaagctctgacc

SEQ ID NO: 163 - DNA, 300 bp, Homo sapiens
ctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcc

SEQ ID NO: 164 - DNA, 300 bp, Homo sapiens
aggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaaagccaaggccaggttctgggtgtagggcccagagaagcagaacagc

SEQ ID NO: 165 - DNA, 300 bp, Homo sapiens
agacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggc

SEQ ID NO: 166 - DNA, 286 bp, Homo sapiens
  misc_feature (1)...(286): n = A,T,C or G
cttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgnnnnnnnnnnnnaagaggaatacgccaaagaggctcagcanatgcctgcgggctgcaggactggncantgacctggatgctntantctggactgatcct

SEQ ID NO: 167 - DNA, 300 bp, Homo sapiens
ggattctttcactgagcacaaagagttgttggggctttagcatctgactgatttttttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaa

SEQ ID NO: 168 - DNA, 300 bp, Homo sapiens
caaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttg

SEQ ID NO: 169 - DNA, 300 bp, Homo sapiens
gcaagccaggagtgctggcacaggcctgtggtcgcagctactcgggaggctgaggccggaggatcgcttgagcccaggaggtcaaggctacagtgagccgtgatcatgccactgcactccagcctgggtgacagagcgagaccctgtctcttaacaacaaaacccatgagcggcagccccccagtcctggatggtggtaaagaatcctcaagatcaaacccacgcagtgctgagagcttggcctgattctagggctggggctggagaaactgctagagatgatgccgatagccagtgtga

SEQ ID NO: 170 - DNA, 300 bp, Homo sapiens
caagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaa

SEQ ID NO: 171 - DNA, 300 bp, Homo sapiens
  misc_feature (1)...(300): n = A,T,C or G
tttgcagccccccctaggtggacccnttaangatttggnttttcccctgggcanccaacctgccccanaggcnccagacctgggntttcagctttgggnccaggctgcccaaaggnactccnttatacncccggcnccttncncgaaananggnncttnccaagcaagcccctangatttgtccctatananggaaangtgtggcangcncatgagttnaaattnttttangcnattcttataatcaaaatctgaagggaaaaaaatgttttagttctttccccactcgttgggttcaac

SEQ ID NO: 172 - DNA, 300 bp, Homo sapiens
cctagtcccagagtcctggagcggcatactgggggtggctgtgcagtcccagcatccccaacccagcatgtatagagagcatccatccttacatccagctgacccatgcccatgctcctccctgtggctggaggttcaacaataacataagtctcttctttgccctccagatatttctccctcgagtggctgggaaacttggcaagagaccagaggacccaaatgcagacccttcaagtgaggccaaggcaatggctgtgccctatcttctgagaagaaagttcagtaattccctgaaaa

SEQ ID NO: 173 - DNA, 300 bp, Homo sapiens
cgtgctaatggaaaaattgttagtaaaaataggttcatgcagtcttattgatcatgcttgtaattctgaagattccacttgtactttttgtaaccatatttctcttctcttccattctctagttgtgagaaaacccagttgtccaataattgtcaagctttcctcggccttagggaatgagcactcaagacctttctgggccaagtgtggtcgccgactcctgtaatcctagcactttgggaggccgaggagggagagctgcttgagcctaggagttcaagactagcctgagcaacagca

SEQ ID NO: 174 - DNA, 300 bp, Homo sapiens
ggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaatt

SEQ ID NO: 175 - DNA, 300 bp, Homo sapiens
ctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctcc

SEQ ID NO: 176 - DNA, 300 bp, Homo sapiens
  misc_feature (1)...(300): n = A,T,C or G
cgaaagcccatttcaagctttgtgctgcctcttgatctacctctttgtccaggtggnngcgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaa

SEQ ID NO: 177 - DNA, 300 bp, Homo sapiens
accctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtct

SEQ ID NO: 178 - DNA, 298 bp, Homo sapiens
  misc_feature (1)...(298): n = A,T,C or G
actgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaggaagttgtacgaaggtcaaagaaattgtctgttccagcctcagtggtgtcggaggataatgggaagaggaggatgcnncatcnctgcnntacaggatgttactgg

SEQ ID NO: 179 - DNA, 300 bp, Homo sapiens
gcaaggttgtgacattgtcacttttttgttctagactcttttaaattttctgcatttgcctgaaaagcacccctgtaagaatagatttctcatggctctaaaaattattcccaagaataccttacttggttcaaaagcagactgtttctcttcatttcatctcaaatcagacttctgggcaagatgttctttagagtaagcaaacctacaacctaaaaatctcttcaagaggcatctctggtcttgtgacaagacctcttcaaaaacccacagtaaaactcccctccctccagttggcca

SEQ ID NO: 180 - DNA, 300 bp, Homo sapiens
attacttagaagcttataacgaaagctaaaaagcaattttaataggttcagtaaagccaactaccacatagattttacttaatatgtataagaatacaagataaaagatctttagacactttacaaaactgccaaacttgctaaagaagatgaacctgataaacagccacaggtacacagcctgtacactgaaatgtacgtgggaaagcacagtgcaagaatttcttgagctgtcctgagggttatgttaaccagagcttctcaacctcactacatattcaaatggcccgggagcttttc

SEQ ID NO: 181 - DNA, 300 bp, Homo sapiens
cttctaaatgtcctcctccccacttgttttattattactgtttttttctctctttaatgtttttttttatagagacatggtctcactatgttgcctgggctgatctcagactcctgggctcaagtgatcctcctgcctcagcctcccaaagtgctgggattataggcgtgagccattgcgcctggctctgttactggttttctaacctgagttacttaggatcatattttcattcttttttaaaaagatgggagttttctgaacttttccttaactaaaaagttggaatgcatcttaata

SEQ ID NO: 182 - DNA, 300 bp, Homo sapiens
  misc_feature (1)...(300): n = A,T,C or G
gtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggannnnnnnnngctgactgaagaggagctgaccaccacactaaaggtactgtgcatgcctgctgaggagttcagagagcttaaagaccaggatggagggggagatgataaaagggaa

SEQ ID NO: 183 - DNA, 298 bp, Homo sapiens
  misc_feature (1)...(298): n = A,T,C or G
gtctaattttttccatttttctctcctctttctcaagtcttctttttgattttacttttgcttttcctgcagttccttctttatcatgtatgtgctttttggaactctttctgtcagtggtaaagtctgtagagtttccagactgaagactcagctctaagcaaggtttcacttgcgcttcaagattttcctgatacaaagacttttccatgtaactttcatcactnnnnnnnnnngntntgtaaatccttttgattnttgattnntcccancatataaannntctntannncctcct

SEQ ID NO: 184 - DNA, 300 bp, Homo sapiens
gaacagacaagttctgtcccagcctctgctacctctaaccccatggcattctatccttttctacactgggcttccatttcttaccccaacaatgatctgttcttccaggtgctgtcatttaatttcccagacacttgacctccttctgatttgtgtactccctccaaggctgagttgcagtgagtgacaataatctgtgctaattacttatcttgccagaagactcaaagggtttatggcttttactaactgaactctatgctagatgttagggataaatggttaacaggacacagttct

SEQ ID NO: 185 - DNA, 300 bp, Homo sapiens
aaggccttaggctttttttttgtagggtgagagtgggggagagatctcttgctctgttgcccaggctggtctccagctcctggcctccggcagtcctcccacctcagcctcccagagtactaggattatgggcatgagccaccacacctagccaggctttttatattgagttggttatatatgcttcatagccacactttataatattggagtatagtattaaattacagcttgttgtcaagtcagtgtttctgtaagacagtatatccaatattggttagagtaacacctatttggtga

SEQ ID NO: 186 - DNA, 300 bp, Homo sapiens
aaaactttaagaaaaccaatgtttggggccaagcaatggggagcttggccgacctcatttttttagtgattttgaactcaatctttaaaatcctggaagagaaggaaaaaaagggtgtatattcgtgtaatgacatccagatctcactgttctcttggctcctagtgatgggggaaaaaaggtgcgcccagggttgacccttcagtaacacctgcagccatgcatcatgacctccaggtgttcagaggccctgcccatgtgacacgtgcctggtacttcccatacatgtgcctctttaat

SEQ ID NO: 187 - DNA, 275 bp, Homo sapiens
  misc_feature (1)...(275): n = A,T,C or G
aannatnnnatatnttannnaacnnnaacnnaccnannnnnnntanngaanntaanaatnaangnacnntaangannnnnnntgaanacntncannnaantcnctaaaannggngtanatgacttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaa

SEQ ID NO: 188 - DNA, 300 bp, Homo sapiens
cctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacc

SEQ ID NO: 189 - DNA, 300 bp, Homo sapiens
gaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgag

SEQ ID NO: 190 - DNA, 300 bp, Homo sapiens
cgaaagcccatttcaagctttgtgctgcctcttgatctacctctttgtccaggtggatacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaa

SEQ ID NO: 191 - DNA, 300 bp, Homo sapiens
gaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggt

SEQ ID NO: 192 - DNA, 300 bp, Homo sapiens
gatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggttta

SEQ ID NO: 193 - DNA, 300 bp, Homo sapiens
ggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctca

SEQ ID NO: 194 - DNA, 300 bp, Homo sapiens
gaagaatactgtgaattctatgactttatcaaaatccagccacatccaggagcttgcagttgttgaccaaatgaatgatgacatagagtagttcagatctatcatgtgctcttctatctaatcagtcaatatttccttggccctcaagccaacattcattttttatgtataaccttcttcatgattttgaaattttgatagggtaactgctaatgagttcacaaatgtagcactttaaaaggaaaataaatggagagtgaaaacaacttggctacgtataattgtgggttttaatttttc

SEQ ID NO: 195 - DNA, 300 bp, Homo sapiens
gttgagcaatatgaatataatgccaagtactgataaaatacggaattcatttagaatcaacataggtagacagactgtttttagtaaggttttgttttttggtgaataccatgtttgggctgtcagacttacttttcccctgagatccatattttgtacatgacataccagatatatgcaatatgaaacggaaacagtttttcaatctaatatccaggagtttgtgttaatatcttgtgaacttgtggctcttggtatctggcattgataaggctgtctactaatcctagagaaagggaa

SEQ ID NO: 196 - DNA, 300 bp, Homo sapiens
ttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtga

SEQ ID NO: 197 - DNA, 264 bp, Homo sapiens
  misc_feature (1)...(264): n = A,T,C or G
ctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggccnanncgannggntncatgantnnttnntgntgnnngcnntncngatgannnnntnggannangnngntnnnactngntggnnctg

SEQ ID NO: 198 - DNA, 300 bp, Homo sapiens
cactcatttggaagagtgagttttgtgagcacaaagtattaagggccaagactggggctgcacatgagcaattatggggtggagttgagaaaaaaaagtgtagcctgatggaggtctctggaatagaacaagccttgcccatgcaggcttccgagcagccctgggtggggttgtggggaggcccccagcggcttgtggcagccttcagctctgcaggagcccgtggggtctagagtcaccgccctctgtgaactggaagctgctctaatgctgtgcacgttttgatgtcacaactatttt

SEQ ID NO: 199 - DNA, 300 bp, Homo sapiens
cctagaatttgtggagctgggttgtatcataggaaatgcaagctgtgctggtgttcacagctagagaggagaatggttggatgtgcacctggctctgcaggaagcccatctcaggttattgctgaggataagaagctggcactggaatggttggaaaggctgtaagagctccacatgccacctggccctttttgggtatgtggtgcccagacctgagctgctatttagtctgacaaagatagagggattttttttcttccccctttgggcaacctgcccatgtattgtacagaggaaggc

SEQ ID NO: 200 - DNA, 300 bp, Homo sapiens
gagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcat

SEQ ID NO: 201 - DNA, 300 bp, Homo sapiens
gcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgc

SEQ ID NO: 202 - DNA, 300 bp, Homo sapiens
aaatatgctacttagaaattaaggcctctgggttcaatttttggccccagtgttgacctctgtgtaagcctggcaggatgtctcatttctgggtcaccttttccttgccaacatagtgaggtatgtagaccaaatcattgctaagagccttctaactttaagactctaggtttagtcagccaaaagcatgtgattttcccagatttcccaaactccttgtacctaattgaaagtacacaatgaacttgcaagaatttaagcatccttagatgccagtcttcactttgggtattttcctgc

SEQ ID NO: 203 - DNA, 300 bp, Homo sapiens
aattagtggagtgatctctgaagacctagggctatgatctggagctgctgtggctgaaatttggggcctctgaagtggcatggagattgaggtccagagagcctgagatcttgagggctgacatttggagagatggggtcgagggttgtctttgggccttgactgctttgggcctttctcactctcattcccgggatgctttgccagaatctctgctggattggccgtaaccctgtccccgagcgggctcacagggtctgaaggccacgcatgaggcaaaggtaaagttctgagccaccc

SEQ ID NO: 204 - DNA, 300 bp, Homo sapiens
cccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaa

SEQ ID NO: 205 - DNA, 300 bp, Homo sapiens
cacaagcaactttgctttagaatctagaattcctttgcaggcagagaagtctctacctcccagtgtttcctagctaagaacgtaaatgtgaggagggaaatgtacttgcagaggtttcataattatttacttataaaaatagtcttcatagccgggcgcggtggctcacgcctgtaatcccagcactttgggaggccgaggtgggtggatcacaaggtcaggagttcgagaccatcctggctaacacagtgaaaccccgtctctactaaaaatacaaaaaattagccgggcgtggtggca

SEQ ID NO: 206 - DNA, 300 bp, Homo sapiens
ggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagtt

SEQ ID NO: 207 - DNA, 300 bp, Homo sapiens
gaaatcagtagccccagagatacctggcaatagctttttgagaatctggaatacagttagcactcaaacatttgtagaatgaagggcagtagaattatcatttctcctcctgtctaataactgtgacaagggagtggccggtgactttttttggtagagctttttcaagaaaaagtttagtcctacggacagttcggtagttattctacttcagacactgggcatgtttcatgttcttcaaaaagcccagttatactttggttttttgttgtttgagacggagttttgctcttattgcct

SEQ ID NO: 208 - DNA, 300 bp, Homo sapiens
ctgctataaaagtatgattgtcgtcattacagtgattgctgattgagggcttgctcagcacctttctgggggctcaacgaatgttctgtgatgttgagttcaccaccctataccctgggagagagatagtgtgtttccatttcacaggtcagcagactcgagcacagagaggtgaggtaacacagcctggcaggagtggagttgggattcaaggcctggtctgaatggtggtgctctcacattgcagttgcactccaagggacccttgcaaggtgctaacagatgtgaatgccttttgga

SEQ ID NO: 209 - DNA, 300 bp, Homo sapiens
catttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaa

SEQ ID NO: 210 - DNA, 300 bp, Homo sapiens
ttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataa

SEQ ID NO: 211 - DNA, 300 bp, Homo sapiens
gttacatcaagagataaatagagtgaagcagaactagtggtgcggaccagctcgccagcaacagaagggtttgtagtcggcctggcagtggacagggaggttggctagaactattaccttaggtccgtgataatatccctgaatccaacttttcagaaagaaataggtaacatatttttcaccaggaagcttcacccagacactgaacagaatggtctcagtgcactaatggaggctcagttaaagggttgtggtagcacaaggaagagacattctgacttggaaatttggagaaggctt

SEQ ID NO: 212 - DNA, 262 bp, Homo sapiens
  misc_feature (1)...(262): n = A,T,C or G
gtccaatagctgtgaagctggcagcccttccaagcctgggcagatcctaaaaagacagcaggcagagggcgcagggcttatggcctggccggagttgggaggtgaagcagagggcacagggcttatggcctggccggaggtgggaggtgaagcagagggcgcggggcttatggcctgtctggaggtgggaggtgaagcnnnnnnnnngaggangttncntntgnatnnnnntnntnannananantnnntntnnnannnctt

SEQ ID NO: 213 - DNA, 300 bp, Homo sapiens
agcactggatgaaaacaaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaat

SEQ ID NO: 214 - DNA, 300 bp, Homo sapiens
cttttctggagggagacacccatctcctgcccttggacatcaggactccaggttcttcggcctttggactcaggcttgccacagaggcctcccagggctctcggccagtcagcctcagaatgagagttacaccactggcttccttggttcaaccaccttcttacctggactgagcctcacttacagcttctctaggtctccagcttgcagacagcctatgggaggacttctcagcctccataagtgtgtgggccagttcgcctaataaatcccctctcctggccgggcgcggtagctctc

SEQ ID NO: 215 - DNA, 300 bp, Homo sapiens
cctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagatcatggaaccggactccaagatgacgatctaaagacccgggagccagaagccaaggccaggttctgggtgtagggcccagagaagcagaacagcccagagccccaggtgcctggcctggc

SEQ ID NO: 216 - DNA, 272 bp, Homo sapiens
cttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaa

SEQ ID NO: 217 - DNA, 300 bp, Homo sapiens
gaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttata

SEQ ID NO: 218 - DNA, 300 bp, Homo sapiens
cccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaagtctatggggtataatcgagatggatacctgggtctttaaattacgtagggaattttgtatgtttaaataattgtactgggttccataaagcttatcttaaaaacttt

SEQ ID NO: 219 - DNA, 297 bp, Homo sapiens
ggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacggctgagatttattaatccattgaaaaa

SEQ ID NO: 220 - DNA, 300 bp, Homo sapiens
gtggggtaggcatgggggtggacaggggtgacgggctccacagagacaggatggtggagggagttgtgtgcagttgaacttgatcctgtagttggttttgacctggtgtggtccctccatgctgtggaagtgaaatgtgagggaacaggcctgggggcagtgagggagacaggacaagcctttcatctaaaaggtggcacagagcttaaggccagggaggaaggtatgaagaaaaggtgattgagaactaattaccaagggaaactggcaagacaactggatgcgtgtaatccgaatggt

SEQ ID NO: 221 - DNA, 300 bp, Homo sapiens
taaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatt

SEQ ID NO: 222 - DNA, 300 bp, Homo sapiens
gagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggc

SEQ ID NO: 223 - DNA, 271 bp, Homo sapiens
  misc_feature (1)...(271): n = A,T,C or G
attggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttatgagcctaggtaaaagctgctaatattcttttaaaagcnnnnnnnnnnacttgcctgatagaaaactccttccgggggggnggattttataatantacgtgngnnctnaacanagtna

SEQ ID NO: 224 - DNA, 300 bp, Homo sapiens
aagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaa

SEQ ID NO: 225 - DNA, 300 bp, Homo sapiens
gctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtaccca

SEQ ID NO: 226 - DNA, 300 bp, Homo sapiens
gtggtttcctgcacatctttggagtagttatgacttctcagtttttccccccttaaactgcattgcctattcttttttcctgacatgctatcaggtatcagtgtgttgaatacatactgcttgtgtatcagacttacgttactgtcatcaccattaaaagaattgcagctttgtgccccatgaccttcagctcagttgttgactgtcattcatgaatgcctaaagcatactgacaccaggtataagtacttgaagatcaagaactagtcaataaaacatgagcaacataatggtaactat

SEQ ID NO: 227 - DNA, 300 bp, Homo sapiens
acagggtcaaaattttcattctgcataaggtaggtttagtctttttcaaaacattctagtaggcaagtctgtagctgaatcttggaagaaaggcaaccatagtaatatttttgagttcctactgtttattttttcaataaaaactcaggttctcaggttagcagatcatggtcttaggaaggtagctgtagaaccaaaatataaattcctaagcttctaccaattgggtcttactgaaatggcaattgagagagaagtaaatctcttggttttcaccatagttactttatgtttcctttc

SEQ ID NO: 228 - DNA, 300 bp, Homo sapiens
  misc_feature (1)...(300): n = A,T,C or G
gacttgtgttcaggcaggttttcnggacatgnacataaaanaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaa

SEQ ID NO: 229 - DNA, 300 bp, Homo sapiens
ggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccggcctgagacggag

SEQ ID NO: 230 - DNA, 300 bp, Homo sapiens
aatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaac

SEQ ID NO: 231 - DNA, 300 bp, Homo sapiens
cacaaggagaagaaagttaattaacattgaaagatgagaagacatcttggaagaacttgaattgggccttggaagaagaacagccattcaaatagatagaattgtggtagcaaaggcatagaggtaggaaagtatagatctccagggacagtagtcatggggttggggcactgttggaatttaaggttggaaggatatattggagccccttgaatacggtaacaaggcacaccttgggcagtggagagttatcagagtgtttgaaaaggagggttattgagtaaataaatagactggtac

SEQ ID NO: 232 - DNA, 300 bp, Homo sapiens
gttaaactgtcagtattggatcttagaagtaaatgattattaggactgtaatagtaattattaggactgtaaaagtaaaggattattatctgcattagatatcattatatctaatgatatagagactgcagacataactacagggctctttttcttaaatcagaaaatccagattcaatagaaatagggtaaagtgataggaggacaaatagccttccatccagtggttatcaactgacgactacaagtcggcctcacttgctttaattattctattctatcctttgatgctgcttgaag

SEQ ID NO: 233 - DNA, 273 bp, Homo sapiens
  misc_feature (1)...(273): n = A,T,C or G
ggcagctagagtcaggaaaatgaccctcatatgcttttaatctttgtttcagttgtctgtcagggttgaattaagaagctactggtttattcccaattgttgatgcctttaggtatgttggaatctttttttttgcctaggaggggccagttgaaaatctgtgactcaagaggcagtgaacagaatactgttttctggggaaaaattggttggctacttgatgttaattnnnnnncagtaacagganaaggntgtgtctnngctattntgnng

SEQ ID NO: 234 - DNA, 300 bp, Homo sapiens
ccacctctcagacgtgagtaaggaattgccctccttgtctcagtgggacaaggcttgaagctaattggaggaggtggagagaaatttagagggggtcctggttagggtacccataaaaatagagatgcttgggatgttctgagcaaaggagccagaatgcagagaacaggaccacagccctagtagctagggggggagtttgagatgcagcctgggggtgccctgcctaatttcagagacttaagggccagtgtcagtgacagggtcagcaggggtgggtgagaatctgcttaaggctag

SEQ ID NO: 235 - DNA, 300 bp, Homo sapiens
ccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtga

SEQ ID NO: 236 - DNA, 300 bp, Homo sapiens
cagtgagattcctcttctggtattacctttgcttcattgctgaatcttctccaatatcatcttctaaaaagagccttttaaaatcaccttttctattatgccctactcatttccagtccctgaattgcccattccccacttcatagcacttattgctatctgaaattacactaaatgtcaccttcatgatggtaggcaatttattgcctttgtcactgttatgtctagagaacaagcagctggctcatagtaggcactcaacaaatatttgttcaatgaagaatttataaatgaatgcct

SEQ ID NO: 237 - DNA, 274 bp, Homo sapiens
  misc_feature (1)...(274): n = A,T,C or G
ctgggctgcatctggccctggctggaggccttgctttgaggggctgagaccctcttcccccaggccctccccagccgacgacagccaccggagaggagatcggaacacgattgnnnnnnntgcagggcgctgggcggaacnaatccncaaggactctganatnnncccttgnnantnncnangngannnannananannnntatacatananccnnanacccnaannacanacanngngcanancnannnnancannnnnaannagnnnannna

SEQ ID NO: 238 - DNA, 300 bp, Homo sapiens
tgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggcccaggtgctatggttccactggggagagaccatttaattctccagatgctttactccctgattgtcttttagccattattcttttcgttttaagagacatggtctcactctgtcacccaggctggaa

SEQ ID NO: 239 - DNA, 300 bp, Homo sapiens
caggattgttcattttgtcttttgtttgttttggggaacagggtcaaaattttcattctgcataaggtaggtttagtctttttcaaaacattctagtaggcaagtctgtagctgaatcttggaagaaaggcaaccatagtaatatttttgagttcctactgtttattttttcaataaaaactcaggttctcaggttagcagatcatggtcttaggaaggtagctgtagaaccaaaatataaattcctaagcttctaccaattgggtcttactgaaatggcaattgagagagaagtaaatc

SEQ ID NO: 240 - DNA, 300 bp, Homo sapiens
gcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaagga

SEQ ID NO: 241 - DNA, 300 bp, Homo sapiens
gggatgaatatttaaggtgaagcaaagtagctgtggctacttggggccaaaagcttcccagatgctcctgctctaagcacatgatgttttttggggaaagtggtagcaggtagagggtggcagaaagtgtgagaagcacttgttgtaggtgacccagacatgcctcttgaattgaattcggtgatctgcttcttcagctgctttcttgtccctgcccagcaggatgccaggaaacacatagccctgtagaaaatcactggagaagaggatgattggagttcttcatttcttaaaaaacag

SEQ ID NO: 242 - DNA, 300 bp, Homo sapiens
aaatgaagtccttgagccagaaaaggataccagccccactgttaagtgatgattgtgtgctaaagcagcctaagagttctatcctaacacaagagcctagaaagtaacttcttaggcagtgtccaaagaatgccagtagtccttggggacttttcagaggtgcttggcttgaatcaatttctagatcccaaagcagagtcttcatgcacattttgcggctgtagtgtacagcaaatggctcttggctaggtttagaatgctgcttttaccattctctgtacctgacccagtttgagtctc

SEQ ID NO: 243 - DNA, 300 bp, Homo sapiens
agaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccaggtttggcatagaaatggtaccccttgttcaaaatgaacaagaagccttagatttg

SEQ ID NO: 244 - DNA, 300 bp, Homo sapiens
ctccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaaccatactcaatagccgtaaacgctgacaaattccc

SEQ ID NO: 245 - DNA, 300 bp, Homo sapiens
gctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagat

SEQ ID NO: 246 - DNA, 300 bp, Homo sapiens
tggctgctcaccactccattggcctgcctgcgcgccaattcccttcggtgggccccggttggctgcaggctgaggtctattccactgaccacccctctcggtgccgcccacagtgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccaccccc

SEQ ID NO: 247 - DNA, 300 bp, Homo sapiens
agaaaaacaacagagagaaaaagaatacctgagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatct

SEQ ID NO: 248 - DNA, 300 bp, Homo sapiens
ccaccttggcctctcaaagtgctgggattacaagcgtgagccactgtgcccggccagaaggagtgttttgagaatggctaagagaagataggttgaatagctatgcctacatgtcactaattaacatctcagagatctctgctacaggttgtcgtcctcattttgtctaatatttttccaatggcatgagtataggaagataaacggggaatgttttgaagtaataaaaaaattccatccataaagaagaacaacatgtattaagctttgtgcaccaaacaacacaacaggaagacacat

SEQ ID NO: 249 - DNA, 300 bp, Homo sapiens
tgttactggtgcccatatagatgtggataaacaaaaagataagaatggcgagagaatgatcacaataaggggtggcacagaatcagcaagatatgcagttcaactaatcaatgcactcattcaagatcctgctaaggaactggaagacttgattcctaaaaatcatataagaacacctgccagcaccaaatcaattcatgctaacttctcatctggagtaggtaccacagcagcttccagtaaaaatgcatttcctttgggtgctccaactcttgtaacttcacaggcaacaacgttatc

SEQ ID NO: 250 - DNA, 300 bp, Homo sapiens
ggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaa

SEQ ID NO: 251 - DNA, 300 bp, Homo sapiens
tgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattataaaataccatcctctcaaaggtggttctaaattacaaaggactttgatttctaggtagattctg

SEQ ID NO: 252 - DNA, 300 bp, Homo sapiens
gaacaaagaaggaatgtcttcctcatgtttgggtctatagaagacgttaaagaaaacttccagaaagtgggtttgaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataat

SEQ ID NO: 253 - DNA, 300 bp, Homo sapiens
gaacaaagaaggaatgtcttcctcatgtttgggtctatagaagacgttaaagaaaacttcaagaaagtgggtttgaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataat

SEQ ID NO: 254 - DNA, 300 bp, Homo sapiens
gttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctag

SEQ ID NO: 255 - DNA, 300 bp, Homo sapiens
gggctcttgtcattttctcgctctgtggcactgttcagaggatatcacgggccccttgatttgtatccagaattttaccgaattgctacagacccaaccatccacactgtcccagaaggcagacctgtgaatgtctgagtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatcta

SEQ ID NO: 256 - DNA, 300 bp, Homo sapiens
gctttggaaattattagatatatcctattcccttcctcccatttttttcctgctagtgcaaaaggtagatgagtaggaagattaggactcctgagttgcccatgatttcatctaatttttggattcagaatgtattttatgaataatatgcagagatgcatattaggaatgtgaagccagaatgggtcagttgtagctgctgcaaagttctgtagctgatggtcatttaattgcatgggggttattttatctttcatgattgtggtgcacctgatgctggcggggatttgtgtgtttttg

SEQ ID NO: 257 - DNA, 300 bp, Homo sapiens
gccaggtgtattaggatcttttagatgtagtttaatgaagagtttatggcttaaagtgagacagtattacttcagagctcagcttctctccttggattttctctcagcaaatgggagaagtaacgtctgcccttcggagttgttacaaggagacaagataaacacagggtccaagtgcttggtaaatggtaagtgctgttattagagtcaggtgttctagtcacaggtcctcaacagatacagctttggcagtaggaggtgcagctgacctgagctgtttttaaattaaaattaaagcca

SEQ ID NO: 258 - DNA, 300 bp, Homo sapiens
atttgatgctacaaagagctttgttgaatcttcagaaaacaaaatctgaagggcagagcgaaggaatgctggcattttggaaacccttttgaggcttatgttgtcatgttcataattcagccgatagagaaaaaaccgagaaactgtagaataggctatccaacttccacatggggagatacagctacagataatgttctcaggaccctttgtctttaggtgcagtaaatgatctgcatttttagagagtggaagagtatccccattcttgcctgttgcaactgtggatcccagtcgcca

SEQ ID NO: 259 - DNA, 291 bp, Homo sapiens
ctacacagttcccattcattaccttaacattgtactgagagagacccaggtctgacctgtatagcagtttgagtcgaggggctgtcaaaggggttgccaaagtcatctaaaggacttggcaacagaagtagcattatgacttggatccacttctttatagaccaatattggcagccatgaaggctggcttgtcctgggtgcggaattcagttttagtggctgaatgcacagacagcaggaagagagaataggggacaatgaacaacagagagagaagaaatgcagtgtgta

SEQ ID NO: 260 - DNA, 300 bp, Homo sapiens
tgtacttattcttgattgccacgtctcatttggattccccagactctgattagaggcactgccaccaggagagattttatctaaccaatagtacttccaggaagatcctcacccttgtactttcaagaagcacttgtaattaatgttcagcttcctgaacactgagtggtacttgaaaatctctgtggtttatagccttacaaaagctactctggaggctgaggcaggagaatcgcttgaacctgggaggcagaggttgcagtgagccgagatcacgccgttgcactccagcctgggcga

SEQ ID NO: 261 - DNA, 300 bp, Homo sapiens
ccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggccgtgggcagcgggggc

SEQ ID NO: 262 - DNA, 300 bp, Homo sapiens
gcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctc

SEQ ID NO: 263 - DNA, 300 bp, Homo sapiens
atttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtaga

SEQ ID NO: 264 - DNA, 300 bp, Homo sapiens
gctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctcccccacttgatgtttgtgttttgtttggggggatatttttcataatt

SEQ ID NO: 265 - DNA, 300 bp, Homo sapiens
gacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaa

SEQ ID NO: 266 - DNA, 300 bp, Homo sapiens
gtcacctccactagagggggataaaaaggataataggaaatcagaatattttgatttgtagttcaactgttgatcaattatctttgagacttttaacattcatgactaaggaggattaataattaacatgagctgtagaattaaggtttgtatggcatgataagtataaaccagttttgggaccgctataattctaaaaaagcaggtagactagatgattagttgtacacttattactgctaattcttgattgtagaacaaattttcctatgaaaaccatgttgtgtattttatatctct

SEQ ID NO: 267 - DNA, 300 bp, Homo sapiens
gatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatc

SEQ ID NO: 268 - DNA, 276 bp, Homo sapiens
gaggccactctgctggccacctccagtgggtgctgaccacaggatgggctttgggtacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaa

SEQ ID NO: 269 - DNA, 300 bp, Homo sapiens
gctgccaccacccccgggcccagcctgtctgaaagttcagggtttaggccgagaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctc

SEQ ID NO: 270 - DNA, 300 bp, Homo sapiens
  misc_feature (1)...(300): n = A,T,C or G
gactcatntgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttg

SEQ ID NO: 271 - DNA, 300 bp, Homo sapiens
agtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatg

SEQ ID NO: 272 - DNA, 300 bp, Homo sapiens
ggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaa

SEQ ID NO: 273 - DNA, 300 bp, Homo sapiens
ctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggcc

SEQ ID NO: 274 - DNA, 300 bp, Homo sapiens
ccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctct

SEQ ID NO: 275 - DNA, 300 bp, Homo sapiens
  misc_feature (1)...(300): n = A,T,C or G
ccacgactcatttgtttcattcacattcctcacgtgcaacaacataattatattttaagaaaatgtggctttgngcatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctcta

SEQ ID NO: 276 - DNA, 263 bp, Homo sapiens
  misc_feature (1)...(263): n = A,T,C or G
gtggcaacttgatgaaacagccaaatgcaccagggcaggtcactttcccattacactgattccacaattaaaaaaaaaaaaagaaaaaaaactcattgaaatagctacagttctataggttaatttaaagcctcctttttctactcatttttgaaaccaaaattacattttactattttacataaccagtgaaaagacgttgaaagcctacagnnnnnnntntttggngctctgaaaatgntnangnnnnntntntnnnnttt

SEQ ID NO: 277 - DNA, 300 bp, Homo sapiens
tcactacacttaaaaatacaagggacatgttaggcaatcagatgctttgtagaaactgagctatttgtcggcctggcgcggtggcccacacctgtaatcccagcactttgggaggccgaggcagtggctcacgaagtcaagagttcaagagcaacctggccaagatggtgaaaccctgtctctactaaaaatacaaaaattagctgagcatggtggtgggtgcctgaggctgaagcagagaattgcttgaatttcaggaggcggaggttaccgtgagccaagatcgcgtcacagccctcc

SEQ ID NO: 278 - DNA, 296 bp, Homo sapiens
  misc_feature (1)...(296): n = A,T,C or G
cctgtctctactaaaaataaaaaaatgacctgggcatggtggtgggcgcctgtagtcccagctactcggggcgctgaggcaggagaatcgctcgaacccaggaggtggaggttgcagtgagccgaggttgcacaattgcactccagcctggcgacagagcgagactcgtctcaaaaaaaaaannnnnnnnnngggnaancntnnnantggggnnnccacttgccntttgccnggnnnncccangttntncctngttttccnggnattttancccctttccatttttganaaaagac

SEQ ID NO: 279 - DNA, 300 bp, Homo sapiens
ctggctcagatgtgggatgtgtatggaagaatataaatgatggtgtggatgtcagggtgagggaggagacaaaaccacgatgacccctagctttgtggcctgaactgtgggtggctgaggggatcgttaattgaatggggcagactgaggcttgtgaggaagatcagagtctggttcttgacatgagatgcccttcagacatctcttcactcaggtccaactagggatacagaaacactgaatatttcaacagcagaaattgaatggggggattgatagcgctggcgagggaagcagctg

SEQ ID NO: 280 - DNA, 300 bp, Homo sapiens
gaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagctt

SEQ ID NO: 281 - DNA, 300 bp, Homo sapiens
atctttaggctccgtgtgtgaaatgcagcaagcctgcccccagcagcctgtgggctaatcctgagctgttccttcgtttaggtacacaggtgaccctgaagttcccactcggccctctgttttctgagtcctgtctcctctgtagcacagtggggattgttctgaaccgtggcacgccttcttggcgaggcaggctctcttatggaaccatagtctgttacctcatttcttccaactgctctgtcccctaaatgtgtgttcccaggtgcagtgcagcaagggtgctcgctgttggccttt

SEQ ID NO: 282 - DNA, 261 bp, Homo sapiens
cctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggagaggtgtgggagg

SEQ ID NO: 283 - DNA, 300 bp, Homo sapiens
gaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttc

SEQ ID NO: 284 - DNA, 300 bp, Homo sapiens
gaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaa

SEQ ID NO: 285 - DNA, 300 bp, Homo sapiens
atgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgatt

SEQ ID NO: 286 - DNA, 300 bp, Homo sapiens
ctaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccat

SEQ ID NO: 287 - DNA, 300 bp, Homo sapiens
aagtaatacgtcctttcatcttttctttcaagatatttctgcattaaatcatcctcagtatatttttttgaaagccaagttttcccaaagctcctcatttcctcatctccctctgtgccactggtttttcagttgctgggggctacagaccctctctctagaaagatggacatgtgaacataagcactgcattttgcacacaatttccgtggttcagaaaccacctgaacttttccttctagaggaccctgcttaaacacttccattctagggtgtccagcccattaagatggccaagaa

SEQ ID NO: 288 - DNA, 300 bp, Homo sapiens
actttataaataaattatatgtctgatactagccttccattgcctggatcacatctgattgtcctggtaatttgagaaaagggtagccccttggtatggatagtagcttgatgacatggaattcagggaaaagactatgatggtgtcacttgtaactgcttttgtgctgtaaaattgtcatggattaagaagagagttggctgggtgcggtggctcacacctgtaatcctagcactttgggaggccaaagtaaggactgcttgagcccaggagttccagaccaacctggccaacacagcc

SEQ ID NO: 289 - DNA, 300 bp, Homo sapiens
ttactgactgcaacaacttcagattatacctcttctactccaagtgctttcaaagaaagtcctctgccaagacaaattcattacgttttttccctctacctgtttgcctttattctcttttgtatttcatcttctcatctagattgaataatctttgagagcacagatgtttatttatatttttcctttccatttctactcagcatgaggtgtccattgaacaaacttgatgaatttttattgcttaatatcttgctagaggtggggagagaggttgggggcggttaaggaactatcagc

SEQ ID NO: 290 - DNA, 300 bp, Homo sapiens
ccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctg

SEQ ID NO: 291 - DNA, 300 bp, Homo sapiens
  misc_feature (1)...(300): n = A,T,C or G
aataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgcctttttnnnnnnnnnnnnnnnnttnttaagtgctgtattaataatactttctgaaagaaa

SEQ ID NO: 292 - DNA, 300 bp, Homo sapiens
cgccagagcagcagtggggaacatcttcttgtctgctggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaac

SEQ ID NO: 293 - DNA, 289 bp, Homo sapiens
  misc_feature (1)...(289): n = A,T,C or G
ctgcgctatcagcgcaaagaacctcccgacagtgccactgaccccacctccccccagccccacagctgggtctggctgggcactgaccaggaggaactgagccgccagctggaccggcagtcccctggcccgcccaagggggaggggagctgcccctgtgagagtgggggaggaggggagggccctaccctggcccctggccctcctgggggcaccaccagctcctcaagcaccctggcccgaaaggaggctggggggcggcggaagcgannnnnnnttgngacatttg

SEQ ID NO: 294 - DNA, 300 bp, Homo sapiens
cagagctgtgatctgcccccaggtattctgacccccaaactggctctcaaccatgtttacatgatgaaaagaagaggtgactgttgtatcagctctaaaggcctcacttttggtgaaatgggacctaaatttgattgcatacttgattacttgctgtcaatactgaaattggcacttcataattttaatactattgaactttcaccataaccctgtcctataaagttgacttgcaaatgaagaaactctatctcttcaatattataaaatatatccaagagtcacaactagtgagaaaag

SEQ ID NO: 295 - DNA, 300 bp, Homo sapiens
ctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcctcaaattccatgccttttatttttaatttaatcccgttcaaatacttaattgttatacat

SEQ ID NO: 296 - DNA, 300 bp, Homo sapiens
gttttgttctcttctttgactattaaaaagctcagtgccaaatatttctaacatatggcaagtgtttctgtgtaccttacaagtctatatataaatttttcttctcttgacagggttttatctatatttagcaagtcacccctaattcttttagaataaggcagaaaataaatcaacgtaaaggttgagaccaagccagagacagctggccaaagtagctggttcagggatataacctgcaagttgccaacccagcgcattcttctcacccttcttccaccctacgaaaggccatatctt

SEQ ID NO: 297 - DNA, 300 bp, Homo sapiens
cgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtc

SEQ ID NO: 298 - DNA, 300 bp, Homo sapiens
tttctccatgttggtcaggctggtctcgaactaccgacctcaggtgatccacccacctcggcctcccacagtgctgggattacaagcatgagccaccgcgcccggcctccctgttccagttttctataatctgttcatattatattctgggtatatgtgggtggtgtgattatccatgtggtcttattttcacattctttgcattaactataatgtacttaatgttttaagataagtttcattctacaaagatgtatgtacaatacctggtatcaggtaacaatcttaaaaaaaactaat

SEQ ID NO: 299 - DNA, 300 bp, Homo sapiens
cttcagcattcagccacttcgtttcagtggcatctgtaatatactctttaatatgaagatgttgaattaaaagtcaaaatactgatgtgagttgacctagtctcaaagggtaaaagattatttttccagggagcaaatgagaaggttgggtgcacgagccttttgctgaacagttggagccgtgtccaggtggaggtgccaatacagaatcaggattggtgggcacacggagaaacaggctatggcccttgagggctgaaccccccagggtgagggtgcagatgctgcccctgcttcggt

SEQ ID NO: 300 - DNA, 300 bp, Homo sapiens
gctttttgggacagtagaaattttcacattaatactgtaaattctgtaccatattttgacacctgctacatctgattcaaatgcgggaaaaaataccatgtgtgcataatgaaaaatcattcatttttccctttcttaccccagcaggaatagaaagcaattccaagccactctgcaaatgtatccaaggttagagattcgggagctggccaacatcttacaccccaaatgactgaagcatttcagtaggctgactggctcgaaataacaatttaagaaaggggggaaaaaacctacagg

SEQ ID NO: 301 - DNA, 300 bp, Homo sapiens
gaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctc

SEQ ID NO: 302 - DNA, 300 bp, Homo sapiens
agtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatg

SEQ ID NO: 303 - DNA, 300 bp, Homo sapiens
accagtatcagatttgtgattaatcgcattactgtcaagtcctcatgcaggccagtcagacttctgtgtgtgttccctcaccttccatttaagtttcagcctttatctatgtccttttgggtgtctgccatgctgatgatagagctcatcagtctttgataaatactgttaggtccttaagtgattttctgtgaaatcttacgcataggatttctgtggtcagggtttgacgtctgatcttgttcgtcagatccccttgctcaagaatgcaagtgcattacctcttaaattttaaaagct

SEQ ID NO: 304 - DNA, 300 bp, Homo sapiens
attggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttcctaattaaaaagtagcca

SEQ ID NO: 305 - DNA, 300 bp, Homo sapiens
gtggaactggctcaggctggattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaa

SEQ ID NO: 306 - DNA, 300 bp, Homo sapiens
  misc_feature (1)...(300): n = A,T,C or G
cacttgggtgagatccaatttatctcaccttctgatagttttaaaagagaagtaattttaatttacattaactttaaaatatttgtatgccaaacactagttattttgaggggatcgaaacaaatcatagcagagataaggaactttcatactttgggaggattttttttaaataactgtatgtttactctaagtagatatgtgtatgcatgcattcacttatgatatgcacannnnnnnnnnnnnacacacacacacacacacacacagaaatttatgnngcctttaanaatcttggga

SEQ ID NO: 307 - DNA, 300 bp, Homo sapiens
agagggtggggtctggccacataggtacctctgtggctctggtctggggttagacactgttagggactagcatttattggacttgtaaagacagcacctcagaattagtaactacttgcattttagggtctgttttatgaagccaacaagtgaatgtaaaataggctctgcatcttttctgagagccctgtcactgggcagtgagcatttccaaaattgcagctctgtcagaatgaaccatgaatacttaagaaagggaaagtaggaacagggagcagagcaaagcataacttgctgtgt

SEQ ID NO: 308 - DNA, 300 bp, Homo sapiens
cttctgttgattggtttgtttaaagtacctaagtactaccctttgactccctaccaaaagttcttttgttttttaaacaacttttatttgtgacttactttcttgagaagtgttcttaatgaattgcataaaatagtggtagcagcttatttcttaagtactttattatttgtgctttaccatttcaggttcttatctttaacccttatttactcagttttccatctgaatgatcctatctctaaattaaggatttaataaatgctgcaaattgtccactttgcaaattgtccaaaagct

SEQ ID NO: 309 - DNA, 300 bp, Homo sapiens
ggctcagaggggttatgattcggagggttctgccgcacggcatgggccggggcctcttgacccggaggccaaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaagggggttagcttacctaccagagcttgtaggggctgtgcaggtgtatggctcccaaggcggcccttttcaggtggcaggt

SEQ ID NO: 310 - DNA, 300 bp, Homo sapiens
gggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgcca

SEQ ID NO: 311 - DNA, 300 bp, Homo sapiens
acaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagcatggatgtcttcatttgttgcttctgtttttcatcttttttgtttt

SEQ ID NO: 312 - DNA, 300 bp, Homo sapiens
aaagaatccaattttagagctgctaaaaaactctttggaagcacctttgcatttcatggctcacagattgaaaactggcactccatcctgaggaatggtctggttgttgcttctaatacaccgattgcagctccatggtgcaatgtatggaagtggaatctatcttagtccaatgtcaagcatatcatttggttactcagggatgaacaagaaacagaaggtgtcagccaaggaccgaagccagcttcaagcagtaaaagcagcaatacatcacagtcacagaaaaaaggacagcaatcc

SEQ ID NO: 313 - DNA, 300 bp, Homo sapiens
gggtgttggagcagattgtagttgatccacagcaaagagcatcaccaaagccattccaggaggaactagatccaccacttcctctgctgggcatgctccaaaaatggttgtggcttccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggaca

SEQ ID NO: 314 - DNA, 300 bp, Homo sapiens
ggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcg

SEQ ID NO: 315 - DNA, 300 bp, Homo sapiens
aagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaccacttacccttgcccaatttctcaatgaagatctaagttaggaaagacgatggaggtggaatcctttaaga

SEQ ID NO: 316 - DNA, 300 bp, Homo sapiens
gacctatcttgatctggatagtaaagtgaggactttaaaaaaggttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttat

SEQ ID NO: 317 - DNA, 300 bp, Homo sapiens
gattgtgacatggtgtaataaaggtatacatggtgtaataaaggtatacatggtgtaataaaggatgtgggagcacaaatccataggaatttgagagtttaggaattgtatttattattcaggcccttcactctcagactaccctgctctatttgaataatgaggcttgtggtggtctgtggaaaagtggacagagtagaatttgggcagctgctgaaggtttggtctctggaatgagtccacgttaccctaaggacagtaatcccaaattgagacaaaaactttaagaaaaccaatgtt

SEQ ID NO: 318 - DNA, 298 bp, Homo sapiens
  misc_feature (1)...(298): n = A,T,C or G
ggggtcttggatggcttttccaccgtccctgagactggggttgaggggactgacgggggccaccaccgccccgccctccagcgcctcctcccagggtggctgggcctcctgttctcagggatcacannnnnnnnnggggnccaaccccttccggaaccaaggtgcangcttangnctgcggctttctggntgtgtgctggcttctgggcttcancctcctgccccagccgtccctgccanggcacannggaccatgggggctgggagtcccatnanagcagtgangtggccccggcct

SEQ ID NO: 319 - DNA, 277 bp, Homo sapiens
  misc_feature (1)...(277): n = A,T,C or G
agagggtggggtctggccacataggtacctctgtggctctggtctggggttagacactgttagggactagcatttattggacttgtaaagacagcacctcagaattagtaactacttgcattttagggtctgttttatgaanccaacangtgantgtaaaatangctctgcatcttttctgagagccctgtcactgncantnnagcattcncnanattcgnatctctgncntnatgtantatgnctacntttnanttnttttgtttccccntttnct

SEQ ID NO: 320 - DNA, 300 bp, Homo sapiens
aacgttcccccgctacatagtctttcttttgtgttatttagtttaccatttcttttttccatcttgttataacctccacgagttgtgtctcttttgttttctacattatacccaacggctagcacataacaggcacccaatatatactgaacgaactaaggaatgaatgaaggaatgaatgaataggtggcttataggaaacccctggggccagggactctgcaacatcaccatgtaactttttctttgtgctgagaagcagagagaaacaatagaagatatctcttaatctctcaagga

SEQ ID NO: 321 - DNA, 300 bp, Homo sapiens
gaggcaccagcaggtagtggcccctgtaagcagggccagagtcgggacaaagagcaggagtgaagcagccaagagacagaggaccaggctggagccagtgggcacgcaggagcctgcctgggaaaagccggggggcaaggctggcatgggaatgaacacctgctggtgacacctctctgagcttcagttcccttaactagaaaaatagaacaggcccggtgcggtggctcatacctgtaatcccagcactttgggaggctgaggcgggtggatcatgaggtcaggagatcaagaccaccc

SEQ ID NO: 322 - DNA, 300 bp, Homo sapiens
gaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcaggggccagcatttgaaacatagaaatgttctgatgaagaatctgaactgaagaagctgttttatagggttatagaagattgtaattgtagagaaatatttctctt

SEQ ID NO: 323 - DNA, 300 bp, Homo sapiens
gtgatctgcctgccttggtctcccaaagtgctgggaatacaggcatgagccaccgcactcggccaggagctagttttatcagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggagctgccctgtggtgca

SEQ ID NO: 324 - DNA, 300 bp, Homo sapiens
gactggagaagtcagaagtagaaaagcagattgctaggagagacaggatgacagattttggtcagaaaatgggatattggagtttaaagtatcaaatacagaatagttccagatgttcagagatccagcatgggattaggtactgaaatggattagaactaaaagtcactagaatttagaaattgagaaccatgagagtggatgcaatgacttgttgcttgattgaaaaataaattaataataataaaggaccatgagactagcctgttataggggttatctccatgaacattgaatttt

SEQ ID NO: 325 - DNA, 292 bp, Homo sapiens
ttcgagtgcaagctccccatctttctaaagtttccatggcaatacagctaactgaagaactaaaagccagtgatgtacttgccagggttctcagccaagaaagtggggttgcccagactctcaagaaaggagaagtttttttgtatgaaattggaggaaatattggggaaccctgccttgatgatgacacttacatgaaggatttatatcagcttaacccaaatgctgagtgggttataaagtctaagccattgtacaagacttaacaagctgcagataaccatgtggactt

SEQ ID NO: 326 - DNA, 300 bp, Homo sapiens
gtgtgtgtgtgtgtgtgtgtgtgtgtgtgtatacagacattttttttttaacttgttgattcagatgtcttggtccctgaatagtcctagattacttattttgagaattcattgttaaaaattacagggaattaaaataattgcctttttttttagagggtaagagatgggtagaagagtatgcctctgaaaattttattagtttattcttgtggagaataccaagaaaatgtgtatttgcccattgctaaatatgatatatgccattttgtatttatttgtcccaagtgtctttttgta

SEQ ID NO: 327 - DNA, 300 bp, Homo sapiens
gcagggagttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctggttcttaatttttgtcttctcattcctgcttccctctcaccct

SEQ ID NO: 328 - DNA, 300 bp, Homo sapiens
ctctggagtagctgggattacaggcatgcaccaccatgcctggctaattttgtatttctagtagagacagggtttcgccatgttggccaggctggtctcaaactcttgacctcaggtgattcacccacctcagcttcccaaagtgttgggattataggcgcgagccaccatggctcagcctcatgttcgtttttaaaacttaggatggtggctcttttacattgattggtaggaactcttcatattacgaggcagttagctagttgtctgtgaaataaaatactaatgattgaactttct

SEQ ID NO: 329 - DNA, 300 bp, Homo sapiens
ggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttccct

SEQ ID NO: 330 - DNA, 300 bp, Homo sapiens
ggtgttttgttctgtagcagaagcataggcatactgacaatacaaaccgaaatccttctaacgtagtggaccttttcaggccagcattttttccttgaaaacctggagcatgtatccatcttatagcagagatcactttcacaatgtttgggctcttgatttgaattgatgatgtaatgagccctctatccagattgtaactaattactctgcgaattgactggattccacacccttctaatattttacttttcctcttttatcaactctcattctcgctgccatgatcaatggaccaac

SEQ ID NO: 331 - DNA, 300 bp, Homo sapiens
ctgtgcacacaaattagaatccttgtaaaatggccatgattctgtttatgaccctggccctccaaccagaccagcctctctgccctctggcttttttagatcactggcatggtttctgcctactccaggtgccagtattattttgtgaatgttttttttcttcatatctactcatctttatactactttcctcgtaaaaggaaactagagaacatgatcttaaatgaaaaccaacgatcacttgccagaaagaacaggtaactaggctttgaaaaaataagttagaggagatagcataat

SEQ ID NO: 332 - DNA, 300 bp, Homo sapiens
tccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaa

SEQ ID NO: 333 - DNA, 300 bp, Homo sapiens
ctggagggagacccccaaaaagaattagggtgctaacatcccaccaaaagcatcatcccacccaaaatgttgcttttcattctatgtcaataatttaaggtggaatttctctcaccctgtggagatgaaagtggcaaaaggttgtcccagcagtgttgggggatggggtgtgcacatcattcttttgggggtagatgacctgctggctggtgggcttttctccaggactactgcaggtagagaccctctgggcttgtgtggagtgggagcagccgtgttgggactatggggaggagctgg

SEQ ID NO: 334 - DNA, 300 bp, Homo sapiens
gcaccagcaggtagtggcccctgtaagcagggccagagtcgggacaaagagcaggagtgaagcagccaagagacagaggaccaggctggagccagtgggcacgcaggagcctgcctgggaaaagccggggggcaaggctggcatgggaatgaacacctgctggtgacacctctctgagcttcagttcccttaactagaaaaatagaacaggcccggtgcggtggctcatacctgtaatcccagcactttgggaggctgaggcgggtggatcatgaggtcaggagatcaagaccaccctgg

SEQ ID NO: 335 - DNA, 300 bp, Homo sapiens
ggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcg

SEQ ID NO: 336 - DNA, 300 bp, Homo sapiens
cagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttacca

SEQ ID NO: 337 - DNA, 300 bp, Homo sapiens
ataggcatactgacaatacaaaccgaaatccttctaacgtagtggaccttttcaggccagcattttttccttgaaaacctggagcatgtatccatcttatagcagagatcactttcacaatgtttgggctcttgatttgaattgatgatgtaatgagccctctatccagattgtaactaattactctgcgaattgaatggattatacacccttttaatattttacttttcctcttttatcaactctcattctcgctgccatgatcaatggaccaactatgcttataaccacaaatggtga

SEQ ID NO: 338 - DNA, 298 bp, Homo sapiens
  misc_feature (1)...(298): n = A,T,C or G
gcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcctcctgtctccacacagacggcttctgcacgtttgngaatctacaggncactccttgca

SEQ ID NO: 339 - DNA, 300 bp, Homo sapiens
gcagagagaagggccgttctcggctggtatcaggcccaagagagtcaacaaaggggggacgaaagggagacagggaagagaacagtggtggggctgtaagttgacctccaggtggcagaaaataaagttggaagaattgactgggacagacagccagggccctgcaggaagggcgggagaggaagcctgcggacacctgccctttgtgattgaaccgcagacaccaggcctggcggggtcgcttgcctccgctgcccaagctaaggctccgctaagctggtcctgagaacatacttcatg

SEQ ID NO: 340 - DNA, 300 bp, Homo sapiens
ccagcccctcctctccccgccttctgggaggaggaggtcacacgctgatgggcactggagaggccagaagagactcataggagcgggctgccttccgcctggggctccctgtgacctctcagtcccctggcccggccagccaccgtccccagcacccaagcatgcaattgcctgtcccccccggccagcctcccccacttgatgtttgtgttttgtttggggggatatttttcataattatttaaaagacaggccgggcgcggtggctcacgtctgtaatcccagcactttgggaggctg

SEQ ID NO: 341 - DNA, 300 bp, Homo sapiens
  misc_feature (1)...(300): n = A,T,C or G
aagctgctaggttccagttttaatttttagggttagttggactctgttatgaaaagataggttatgggtgggcgacaggttgatacagtcttagaaaaagcaggtaatatcaaaggattggaaagctagcatgcatgccctcttacctgggtatcttcccccttttttccttttaaactcttgagcctcctataacagaaggattatgtgcttcaaaccttcttntttnactgngccatnaagtgggctngngcccaaaatatttacttgcanaanatcngtnactggcttaaatacttc

SEQ ID NO: 342 - DNA, 300 bp, Homo sapiens
agaagattggggatgaggagtgaggagaaggctggagaccagttagaggctaccgtagcagcgtagagaggctgaaaatctaactagggtggaagcagccaggcaggctggtcctaatgttgggagttgttcagatctggtggagaggtcattacttatagagttattaatttataccccaccttaattgcaaagagattcaaagcagtaagccatcactttagaatttaatgttctgttttcctttttatttactcattcagcagctatttcaatgcctgctgtgtgccaggtgctatt

SEQ ID NO: 343 - DNA, 300 bp, Homo sapiens
gctgcacagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatg

SEQ ID NO: 344 - DNA, 300 bp, Homo sapiens
ctgggaaggaataattcaatttgattggcagatatatataatacagtaggagaataatgggagaaagataaattgagactagaataggtagactttaaatgcctgtctggtttaggtatttgaactttcaaggtgtggtaaatgtttgagtaaaggaataatgtgtccaaagattattatggaattgtctctctgcatacctctatcgctgtttgtcacagctgtgttcttatgtgactgattcttcctgaagattagaaactcctcaaagactggttattagagcttattcttcattat

SEQ ID NO: 345 - DNA, 300 bp, Homo sapiens
aaaaagtaaagcttttcatgagcacaaatcccttgcattgtttgatgttactgatattcgtaaaatgaatattttttgttttgttttgttttatttttttgagacaagtcttgctttgttgcccaggctggagtgcaatggcatgatcttggctcactgcaacccctgccttgcgagttcaagtgattcttctgcctcagcctcctgagtagctgggattacaggcgctcaccaccacacccagctaatttctgtatttttagtagacacagggttttaccatgttggccaggctggtct

SEQ ID NO: 346 - DNA, 300 bp, Homo sapiens
agaaatgtagcacaaaatggagaagtcgttcaaccttgaccctgtcagagttcttatttgaaagccacattgctgctagtgttcttattgtgttttggattctgtttcttgccctttttcttattagccaagtagtaacttaaggaagcagataagaacaatgaattttggactaaaggaagtaagaacaatgaaccagaaatcagataggaatgtggtgataattgtgacatggtcacatagtcatagtgggagctcatgtgagtaaaaatagcttgatacatttgttaagaggcttgt

SEQ ID NO: 347 - DNA, 300 bp, Homo sapiens
caaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacg

SEQ ID NO: 348 - DNA, 300 bp, Homo sapiens
actcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgccca

SEQ ID NO: 349 - DNA, 300 bp, Homo sapiens
agaatgctgccacagatgtgagacgggtgtggctttcttcagtggtggatcactttcattcatctttaggcgacaaaggttggggttgtggttacagaaatttccaaatgctactttcatcattattacaaaatgatgcttacgacgattgcttaaaaggtatgttgattccttgcattccaaaaattcaatctatgattgaagatgcatggaaggaaggttttgatcctcagggggcctctcaacttaataacaggttacagggaacaaaggcctggattggagcatgtgaagtatata

SEQ ID NO: 350 - DNA, 300 bp, Homo sapiens
aaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaata

SEQ ID NO: 351 - DNA, 251 bp, Homo sapiens
  misc_feature (1)...(251): n = A,T,C or G
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgnnnnnnnnnnnnnnn

SEQ ID NO: 352 - DNA, 300 bp, Homo sapiens
atccagatgggatacctctaaacacgaaaagaaagaagattccattagtgaatttttaagtttggctagatcaaaagccgagccacctaaacaacagtccagccccttagtaaacaaagaggaagagcatgcaccagaatcatccgcaaatcagacagtcaacaaagatgtggacgcacaggctgaaggagaagggagccgcccatccatggacttattcagggccatctttgccagttcctcagatgaaaagtcctcatcctccgaggatgagcaaggtgacagtgaagatgatcaggc

SEQ ID NO: 353 - DNA, 300 bp, Homo sapiens
tgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctggtgagttcagcttttaccagcctcagtgtggaggctccatcccagcacacaggcc

SEQ ID NO: 354 - DNA, 300 bp, Homo sapiens
cccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaaca

SEQ ID NO: 355 - DNA, 300 bp, Homo sapiens
cttggaaatgcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaa

SEQ ID NO: 356 - DNA, 300 bp, Homo sapiens
ccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcacc

SEQ ID NO: 357 - DNA, 300 bp, Homo sapiens
gacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcct

SEQ ID NO: 358 - DNA, 300 bp, Homo sapiens
atcaccctggcacgttcccctcagctgggctctgcagggcagctaagattgggcactgatgttcctggcttcagtcctacccgggttatgcagctacggcttcatacatacaccagttgcactaacttgggatgaaaattaagttaaaaccagtagaaaatttcatcctatgttttggtggtaaaagaagcaaatgaacaaatgaatagaggctgccaaacagttgtctcaccaactgttccgactagctaacaagattagctaggtcatacctagtcgtaaaagaatactataagaact

SEQ ID NO: 359 - DNA, 300 bp, Homo sapiens
ctcgattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgatcatttcacttgtcacatcaggaaccctatcctcttagttctcccattgagatttcactgctggactaagattattcttgattcgtagtcattggtttctgtttccattcattttcagcactgat

SEQ ID NO: 360 - DNA, 293 bp, Homo sapiens
  misc_feature (1)...(293): n = A,T,C or G
ggagttttttttttcattataattttttcaggaaagacttatggaaaaaaatatctctctcccacctccttttatccccatgagacacagtttcccactgtaatcagggtaatatgcatttgtaagttctgatatgtgattcatttatgtgatggcaaagataagtctgtcttgaatgcaggtactannnnnnngtnnacannttatncnaatntcaancaacnntaattnctactacnnngtnttctgannaagangnnntnntcatttagatntngnnaccntnctgatta

SEQ ID NO: 361 - DNA, 300 bp, Homo sapiens
gtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatctttttattaatgtta

SEQ ID NO: 362 - DNA, 300 bp, Homo sapiens
ccaggtagctctcaaacttcctcctcaatccactcctccttttacattcatggaaagggagggggaaagaagcccagtctccaaggtcagccagttacaccagaagcagtgccaaccagaatatgagccccgccctgggacagggcacagagccctcactagcatgctggagaggggccaccccaggtcctgggtgtccctatacccagctgcttctcttcaagctggtgaagcccctgccactgccaccacctcctcccctaccttgggactttgtgtttaatcctggaagtcacaatt

SEQ ID NO: 363 - DNA, 300 bp, Homo sapiens
  misc_feature (1)...(300): n = A,T,C or G
attacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatggagaagaggannnnngagctcagcaaactcctgcctcg

SEQ ID NO: 364 - DNA, 262 bp, Homo sapiens
cttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgacctt

SEQ ID NO: 365 - DNA, 300 bp, Homo sapiens
agttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatatacagtatcccttgtcctcaagatttttagttt

SEQ ID NO: 366 - DNA, 300 bp, Homo sapiens
gatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggtt

SEQ ID NO: 367 - DNA, 300 bp, Homo sapiens
cagtcctccccacactcagagatctgtggggaagctccgcccagccacactccttgggataatactagccggttctgcctgattccttttccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttct

SEQ ID NO: 368 - DNA, 300 bp, Homo sapiens
attttgctggacactcagacacaatttagagtatttatatataacttgaaaacagtaacatttccaaaaaccgatgaaccccaccctgtcccaaggaatgattggtatgtatgtgaagttcattttctgacaaaaataattacgttccacttaggatgcacaaccatgctgtcctgtagagaagtcacaagttttgtgagaatttttaaactgatgatgtttatttccatggtaacatgagtatacattttaccttctattgtagtgatgaatcacaattagtctttttttataggttgg

SEQ ID NO: 369 - DNA, 294 bp, Homo sapiens
  misc_feature (1)...(294): n = A,T,C or G
atgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaangnctctgacagagggtccaggaccagacct

SEQ ID NO: 370 - DNA, 241 bp, Homo sapiens
cacactccaggctgagaaagagtaattaggaggcctgaggaggggcccgaggaaaggctgttggggtgggctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgtg

SEQ ID NO: 371 - DNA, 297 bp, Homo sapiens
  misc_feature (1)...(297): n = A,T,C or G
ccaagtcgcagggagcttgtggccctttggtgtttattgcagcagctttagttctgcagtggaggtgggctggagcaggggacgaggtcttgggagtctgtgaggccactctggccgagggtgtgggtttgcttcctcagctgaagggatacatggaaacccacctttgcatagttcagtaggggttacggtgtggttcatggaagccatttctgtgggttgnnnnnnnnnnnnnnnnnnnnnnnnnnnnnntnntnntnncncagaatnatgagntcaananannagcntgatatg

SEQ ID NO: 372 - DNA, 300 bp, Homo sapiens
gttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaacttaaaaaaaaattcttattaatatgtcagtcattaattg

SEQ ID NO: 373 - DNA, 300 bp, Homo sapiens
gtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaactta

SEQ ID NO: 374 - DNA, 300 bp, Homo sapiens
gaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtttggccttggggcacagagctgagctgaggccgctgaagctgtaggaagcgccattcttccctgtatctaactggggctgtgatcaagaaggtt

SEQ ID NO: 375 - DNA, 300 bp, Homo sapiens
ggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaatacgatggatgggg

SEQ ID NO: 376 - DNA, 300 bp, Homo sapiens
ggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatgggg

SEQ ID NO: 377 - DNA, 300 bp, Homo sapiens
gatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcattttt

SEQ ID NO: 378 - DNA, 300 bp, Homo sapiens
ataacacacatcacagtatgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttggtaaaagtactcatccctaatattacattgttctggaaggac

SEQ ID NO: 379 - DNA, 300 bp, Homo sapiens
ttagtgtactggatgtcaggtccctcaaagattccttggaccattttcatgtgaatgaagaataaatcaattgtctttcattgaatcacacggacaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcacgtgatgctgtggagtcttcaaaaagcccgaccactctggatta

SEQ ID NO: 380 - DNA, 300 bp, Homo sapiens
ttagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggatta

SEQ ID NO: 381 - DNA, 296 bp, Homo sapiens
  misc_feature (1)...(296): n = A,T,C or G
gaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagcgaccacacaaatattctattacgaaactgttncagaaataaattngcactgtncattcntctggcctcgctggt

SEQ ID NO: 382 - DNA, 300 bp, Homo sapiens
gccaacttcaattcccttttagtcatctacttcctactaacagctgtaactaggatgagtcaaaatcaattgcctatgctcaccagatccctgataaattcccatgaagccacctgaaaggtggtaaaagcaaggtaaaacgtggtgaaagcaaggtaaagaaggtagatttcacaattttgttttttaaaaaggggaatcttccctgaattctttgaggtactaagtacgtggtttaatgcatattttcattcttgttagcagtttaaaaataatgtttcagagactgtattcacgatt

SEQ ID NO: 383 - DNA, 300 bp, Homo sapiens
gataggccacattccagtaagaactcaatttgactcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatattcctttctttattaatgatgccaaaaccaaaagtagctgtgt

SEQ ID NO: 384 - DNA, 300 bp, Homo sapiens
ctttagttcagataaaggaaacatccaaaaatactgagatgagtaaaattttattcaaagtaggttcctgctttgtcttgatctcaatccattctaactcctgatgtcatttaccgtgtgagatcttagtacaatcatgaaaagaatatgagcatttatcaaaactctctgacatctgtatgtttagaaatgaacttacacagcaaaatatgatttccttgcacttatttaatttttctaacttcaatttctacctatgtgtctctgccagtttgacctgattcagacacccagaacttg

SEQ ID NO: 385 - DNA, 300 bp, Homo sapiens
cctttccaagcccactgctcagccttagaggaaagtgtggatttgaaatttcctcatggaattgatggaggtttttaggtagattcatagaatataacgtatctaccaaagattccgttttcaagggatctagaagatgttagtgcacacgcaaaaaccagacaaacgtctctacacggataaaggcacatatacaattatgcacacagggaagggcatacactctattgtgggcacagaatgacatgcaattatggacacacaaaaacacatgcacccaattatggacaccaaaatata

SEQ ID NO: 386 - DNA, 300 bp, Homo sapiens
tgctcttgggtgcttcctgaggtgtggttgcacagggtggttattcctgaatgcaagggcttactatgattttctcttagtgcctctcatttctgatgctttctgtcctatgaggtcagtctacttactagttagtattctatattaataagtatgccaaatgacttaactcctccagaaatgttattcgttaaaagatgagatgtgctgagacaagaggatcgcttgagtccggaaggttgaggctgttgtgtgctataattgggcctgtgaatagccactctgttccagcctgggcaa

SEQ ID NO: 387 - DNA, 300 bp, Homo sapiens
gccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagag

SEQ ID NO: 388 - DNA, 300 bp, Homo sapiens
gagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgag

SEQ ID NO: 389 - DNA, 300 bp, Homo sapiens
ctaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggttagaatgcagatgtgcaaaagacagacaactgaacaaattacaaatgaact

SEQ ID NO: 390 - DNA, 300 bp, Homo sapiens
cctctctgtcataatgtacccaaaatagagtaagaatatcatgcttttcagtaatactccagtgaatgaggctaagagtaccatttttgttcttataaaagaatttttttggacatgaatacaaagatgtcaggttaccaaatcatttgctagtagatcctaacaatatcacctataggaaactgaacgtagcctttaaacattaagtgatgataatggatttggccgggcgcggttgcctataatcccaacactgagaggctgaggtgggtggatcacttgaggccaggacaggaccag

SEQ ID NO: 391 - DNA, 300 bp, Homo sapiens
attccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcact

SEQ ID NO: 392 - DNA, 300 bp, Homo sapiens
gttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagcctacacactcaatggcaaacacagcaccgagtctgctctga

SEQ ID NO: 393 - DNA, 300 bp, Homo sapiens
gcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtc

SEQ ID NO: 394 - DNA, 300 bp, Homo sapiens
ctgcgacccctcggaccagtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctgga

SEQ ID NO: 395 - DNA, 300 bp, Homo sapiens
gtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaat

SEQ ID NO: 396 - DNA, 300 bp, Homo sapiens
ccatcgattcggtgtcactatcctcatagatagagccaaaacatttctatcacaccggcaatttcctatgtgtcccatcccaatcaatcctttcccctttgctggctccaaacaatgactctttcctatcttattagaaagattagaattgcttttctagagttccagtaatggaatcatacagtgtctaagtctgtttgtggtgctgtaacaaaatacctgagactgggtaatttataaattataggaaattatttctcacagttctggatgctgaaaagtctatgatcaaggcactag

SEQ ID NO: 397 - DNA, 300 bp, Homo sapiens
agactactgaactctacgcttaaaaattattaagatggcaaatttcatcttgtttttttttaacttaaaaaaactacatataagatagttttgcctgttttcaggtttcttttcagtgttttaggtattcagtatttaaatcacaaaatttgtgatttgaacatttttttcttccttcatgagattttaagtggattgatacttgctttccattctgtcccgatgtctgacctttgtaatgtaaagaagaacattttgtttaattgagagaagtctgctgtgttcttgttgatagaggac

SEQ ID NO: 398 - DNA, 300 bp, Homo sapiens
aaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttcctgtttgtggcatggtgagaaaacccatgctgaaaagattgtactttgtgatccccctcag

SEQ ID NO: 399 - DNA, 300 bp, Homo sapiens
ggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatg

SEQ ID NO: 400 - DNA, 300 bp, Homo sapiens
gctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctcgtctgggctctcgtcgttggccttgtagatcaagtaggggaagtgagtgat

SEQ ID NO: 401 - DNA, 300 bp, Homo sapiens
tttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgag

SEQ ID NO: 402 - DNA, 300 bp, Homo sapiens
cccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactgttgatgtggtttg

SEQ ID NO: 403 - DNA, 300 bp, Homo sapiens
aggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaag

SEQ ID NO: 404 - DNA, 300 bp, Homo sapiens
gggattacaggcatgacccaccgcgcccagcctgtaatttcttatactttgtattttgtacttgtattatgcttctgatacgctataattatttatgtacatgttttttttcttcaatagactgtgaactcttcgaatgtaggactcctagagctagatactcaattattttttattaaattgaatgacttgaaactacagatcctttatttaaacttcccaaatttctgctttatctaggcaactctttaaattcttttatctcatgtagatttcaaaggctgaaataattgagatttt

SEQ ID NO: 405 - DNA, 300 bp, Homo sapiens
aaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgt

SEQ ID NO: 406 - DNA, 300 bp, Homo sapiens
cgtctcaaaaaaaaaaagtattttacccatccacaggcagcagacaaggaagtaccttctgtgactgtctggcaaggtcaaaggcatcagggaaggtaaaatactgaaactatatttttaaaaataaaagtattcccttttgagtgtgaattaggaatcaatgccccttctcactacttttgtgaaaaaaatcacagttcctgcagcaagtctatgcctgggtaacaaccaacccacaaaatccaagaggaggtccccctctcccgcctctgtgaggcttgaggagcagtatgtatctgg

SEQ ID NO: 407 - DNA, 300 bp, Homo sapiens
ggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagct

SEQ ID NO: 408 - DNA, 300 bp, Homo sapiens
ttttcaagaggtagtaagtctgaaccaaggtgttggcagggagagtagaaaagatttgggtaaggttgcagaagtagaagcacaagatttgacagctcattagatattaaagaagaccaatgaatcaggagatggtaatgccaagatttagacccgctggaacgatgatgagttggtggtggtgagagtaagtagtgagcataatgatatgttgaaatcagtaggaagattgtgtttgaggaaaatataaggtatccgtccattcattctttatttattcctgttaatctttaaaaagct

SEQ ID NO: 409 - DNA, 300 bp, Homo sapiens
gggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagtgaccctccaggactatcgcctcccagacagtgatgacgacgaggatgaggagacagccatccaaagagtcctgcagcagctcactgaagaagctgccctggatga

SEQ ID NO: 410 - DNA, 300 bp, Homo sapiens
ctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaa

SEQ ID NO: 411 - DNA, 300 bp, Homo sapiens
gccccgctccatgagcagtgactccccagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcat

SEQ ID NO: 412 - DNA, 300 bp, Homo sapiens
cagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcatgtggatgatttgaggccacgagtttgag

SEQ ID NO: 413 - DNA, 300 bp, Homo sapiens
cccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccg

SEQ ID NO: 414 - DNA, 300 bp, Homo sapiens
  misc_feature (1)...(300): n = A,T,C or G
accagttntngttaatttanccnacgagggttaacccatcctaacagggaaggtaactgtacgtccatcagtccactagagggcatcacaacttgtttaatgagataatcaaacatatgatgtaattttaaagggtttacatttttaaaaatttaatagggtatcagttaactaattttacttagatggaacttctgtaagcttagtaggtatgcttaaataaagcctgctaataaaatagagattcagactcaatagaatggttttacatatgtaatatatgttttaaacagcataaaa

SEQ ID NO: 415 - DNA, 300 bp, Homo sapiens
cagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatagctgtgcaggaagaagagctgcaggtgcatgctgctgatatggagtctctgaccaggaacatacagattaaagaagatctcataaaggacctgcaaatgcaactggttgatcctga

SEQ ID NO: 416 - DNA, 300 bp, Homo sapiens
ctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacattt

SEQ ID NO: 417 - DNA, 300 bp, Homo sapiens
tcccaggaacacccaggaagccatattttagtgctaaccgggacaaaagccatagtgtttttcccagtgttgactactctgcctggcctctctcttctgtcttaatacttactgtgttaaagagctttggttgagtatagattctcctaggcttaccgtagagttacatcctgataagcccattataagttgaaaatgtttttagccgtggtggctcatgcctgtgttcccagaactttgggaaggtgaggtgggcgatcacttgaggccaggagttcgagaccagcctgggcgacagag

SEQ ID NO: 418 - DNA, 300 bp, Homo sapiens
ccaaatccctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgccagctgggctcagtggtgcactcctgtaatcccagcactttaggaggctgagtggggaggatcacttgaagccacgagttcagggctcagcctgggcaacagagaaagaca

SEQ ID NO: 419 - DNA, 300 bp, Homo sapiens
gagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccga

SEQ ID NO: 420 - DNA, 300 bp, Homo sapiens
ggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgca

SEQ ID NO: 421 - DNA, 295 bp, Homo sapiens
  misc_feature (1)...(295): n = A,T,C or G
accaagagaacgcggtcagaaggaggtggaactggggagtcctctcagggagggacangcaaaagactcaaagtagatggacagaaaaactgctgtgaggaggggaaagaggagcagcagggatgtgcaggggacggtggggaagacagggtagaagagatggttatggaggttggagagatggtgcaggactgggccatgcanagccctgggcagccaggggacctgcccctgaccactggaaagcatggnncccctgganaagaggggctagtncatcactgcagccctggct

SEQ ID NO: 422 - DNA, 300 bp, Homo sapiens
gtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggc

SEQ ID NO: 423 - DNA, 267 bp, Homo sapiens
  misc_feature (1)...(267): n = A,T,C or G
cttatcctggtggatgtgctattttcttnaaggagtatgaagcccttttctanctatcntcccagtggagcggagttctcagtgnncagttactccatagtgcaatccatattaataggcttcttctcttaagtcttcatctcttcttttgcttaattactgaaccgtaaattcccttcagagaaatttaaatgctggtatttggactttatacatgatactttttgtagtttcttttaatttttgaaagatgaactgcttcctttt

SEQ ID NO: 424 - DNA, 300 bp, Homo sapiens
cctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgccagctgggctcagtggtgcactcctgtaatcccagcactttaggaggctgagtggggaggatcacttgaagccacgagttcagggctcagcctgggcaacagagaaagacacttgcct

SEQ ID NO: 425 - DNA, 300 bp, Homo sapiens
gggaattgctcttctctccgaggctctgtttcttgtagctatcaggaagtggcagctctttgaataagtgccttttcctctcccatctgccacctttgtcttccctctggacatatcctgggggttcaggagcttccagctgtgcagttggccacaggactaggggagcccccttcccttccagaccagtgtccacatacccttccctgtgcccacacaccttcccctgtgcccgcactgtcacccaccacaagcctactccagcaggagcaccacagccttctgcggtcacgctgtgca

SEQ ID NO: 426 - DNA, 277 bp, Homo sapiens
  misc_feature (1)...(277): n = A,T,C or G
atttcaggaccagtgagaaatagtcaatttaggatctaattatttgctttgtaggtttatgtattgcccatttggggtagatttaggaaaatattttctaaatccaagagttcaaaaccaggctggacaacatagcaagaccatatctctaccaaaaaaaaaaaaaaaannnnnnnnnnnnnnnnnnnnntngccccngnanccccnanttnntgggngggntgnggnnggnggncnnttggnccnnngggggtnagggntgcagggnccctnggcc

SEQ ID NO: 427 - DNA, 300 bp, Homo sapiens
ctgatctaatgagctttatgatggagttgaagatgcttttggaagttgccttaaagaatagacaagagctgtatgcactacctcctcctccccagttctactcaagccttattgaagagataggaactcttggttgggataattttaaaatatttttcttgctggcagccaccagaaactggaagaggcaaggaatagattctctcctagagcctccagagggagcacatctttgctgacaccttgatttttgcccagtgaacagatgtggaacccctggcctccagaactagagagaat

SEQ ID NO: 428 - DNA, 300 bp, Homo sapiens
tttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttct

SEQ ID NO: 429 - DNA, 300 bp, Homo sapiens
gaatcatcgaaggttgagaccgtgtctagttacatagttataaatacccatctatgtactgatgccttctaaatgtctatctccagtatggtcttttcctttaagctctagatccattgacaccctcaccatctctaaaaggcatttcaaactgaacacatctgatacagaacttttcatttccttcccaactttgcccacgccagcctgctcctccttcacgctttccacttagtatatgatcccactattcactcagtctctgaagcttaaaacctaggattcatccttgactactgt

SEQ ID NO: 430 - DNA, 300 bp, Homo sapiens
caatcagtgataagctatattttgagttttaaaattgtttttacaattacccctgttttgagtatatatcttgtcaaatcattctaataaatatttgctgataactgtgtggaatacataaatggtaggtagaaatttggaagaatcactacatattttcagttatcattctctgtgtaaattcatgctttaaaaatatgagaagttaaagtgccttggatattattttattttctatattttgtcccatattgtattgtctaattttcattgaaaccacataacatgcttgaataggca

SEQ ID NO: 431 - DNA, 300 bp, Homo sapiens
tggctggtattataggtgcacaccaccacacccaactagttttttgtgtttttagtagagatggggtttcatgatgttggccaagctggtctcgagctcctgaccccaggtgatccacccacctcggcctcccagggtgctggaattataggcgtgagccactgcgcacggcctggggaggttttatttcttgacaaaggtatttgatactcgtgcagaccctggagggtctcactggagagacaacatttaggctgagatctgattaacaggaggcagctgcagtgcagaggtcaaaag

SEQ ID NO: 432 - DNA, 300 bp, Homo sapiens
cccaggctgacaggggctctgccgtctttaacatgtgactttctaggtcagtcatctggtcattgcttttccacacagcagataagacaaaggagtggaaatagaggggtagagattttctcttaaacgtgtgaggctggagtggtatgcttcattggcaagaacctggtcctagcctgcctagctgaaaggaggggagtcagggagatgcactttgcagccaaaattctgttgccaagaaggggaaagtagatttggttgattttgatctgtgtttgctgctgtgttactctataattc

SEQ ID NO: 433 - DNA, 300 bp, Homo sapiens
cacctagctttatcatttgtaaaatgagtctctaggtacagccctttctggggttgagacagagtttctgaggagtaaaagccatgtcattgtggaaacaggcagctattctcacagctggcatgagcccactactcccctataatcagtgctgataaactgctctcatttgttggacttcagactttcctgacccactttgaatgggggccactttgaatggaaactttctatgtattgaattaaaagatctccaagataaatggttaaatgaaaaagcacagtgcaaaagggcatatg

SEQ ID NO: 434 - DNA, 300 bp, Homo sapiens
aagataaaagagataaggaagaaaaagaaagcagcagagaaaaaagggagtggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctg

SEQ ID NO: 435 - DNA, 300 bp, Homo sapiens
agagtcaaggaaaagtgcaagatagatctatcccatttcttcctccacctggagattcctgagctatgctcagcctctgtggggcagggaagactggggacatttttagtcaggatgctgagaagtaattcctgctggggccaggcatcttttcagggctgctgtgatgccaacaaagaaggggccccaggcccatccttactcctggtcccaaaaaggatccaagtgggatgggaagctggcagcaccaacccacttgtagattaacaacaacaacaaaacaccaacaaataaaaaaag

SEQ ID NO: 436 - DNA, 300 bp, Homo sapiens
aagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattc

SEQ ID NO: 437 - DNA, 300 bp, Homo sapiens
accaggaataatctagggctcattagagatgtcaaagatctgttctagtttcttaacctaaaacaagagtgttttagttccattttataggcggggagtctgagccaaacatgttatgtcactttccaagtctccatagcacagaagtcttctgtctccccatcctgactttcccagctcatagggactgtcaaaggcagcagctctggccggctgtgatgcctcatgcctgtaatcccagtaatttgggaggctgaggcaggaggatcatttgaacccaggggttcaaaaccagcctga

SEQ ID NO: 438 - DNA, 300 bp, Homo sapiens
gcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaa

SEQ ID NO: 439 - DNA, 300 bp, Homo sapiens
cagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaa

SEQ ID NO: 440 - DNA, 300 bp, Homo sapiens
tcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctggccagcgtaatagttttatttagattttttaaaattctgtagattaaagcaaatgacagttattgaactatcacaaaac

SEQ ID NO: 441 - DNA, 300 bp, Homo sapiens
gtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcgga

SEQ ID NO: 442 - DNA, 300 bp, Homo sapiens
gcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttg

SEQ ID NO: 443 - DNA, 300 bp, Homo sapiens
tttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggtttttttttttagtgtgtgttttccctccaagtgtgatatttcctgctgaattaaattatacttcagttgtt

SEQ ID NO: 444 - DNA, 300 bp, Homo sapiens
ctcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgag

SEQ ID NO: 445 - DNA, 300 bp, Homo sapiens
ggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagaatgtgaccttatttggaaatactg

SEQ ID NO: 446 - DNA, 300 bp, Homo sapiens
  misc_feature (1)...(300): n = A,T,C or G
gnctttnaaaaccatctacttgttctttttgcaggatcccatngangtcgggagaatgctggccacagatggtgctgcccaacaggcccataccactcgttccagtcagaggtgcttggcctttggggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcattt

SEQ ID NO: 447 - DNA, 300 bp, Homo sapiens
  misc_feature (1)...(300): n = A,T,C or G
gccagatcctgcaggagagcgcgatgcagaaggctgcgttcgaggcactccaggtgaggaaagacctgatgcatcggcagatcaggagccagattaagttaatagaaactgagttattgcagctgacacagttggagttaaagatgaagnnnnnnnnnnnngaatgcctanntgagatnatttgacctggtccttntttgnatttgacccggnccanatctacanggtcacttggttcatctnctggacccctgcttnttctgggctgngcnntnaatgcntncgttccttnagagaaca

SEQ ID NO: 448 - DNA, 300 bp, Homo sapiens
  misc_feature (1)...(300): n = A,T,C or G
gttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttccttttttttttttttnnnnnnnnnnnnnnnnnnnttgcnttnncccccaggttga

SEQ ID NO: 449 - DNA, 300 bp, Homo sapiens
gccaagcctcggcctccactgcacctgctgcggagtggcacctttgcctgcaaggccctctaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaa

SEQ ID NO: 450 - DNA, 300 bp, Homo sapiens
gccaagcctcggcctccactgcacctgctgcggagtggcacctttgcctgcaagtcccggtaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcatcagccagaaaaactagaggaatcttatagattccagaactcaggatacctcagggataggtcacagccaagagtacaaa

SEQ ID NO: 451 - DNA, 300 bp, Homo sapiens
ccattgttagcatcgtacacgattgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagta

SEQ ID NO: 452 - DNA, 300 bp, Homo sapiens
gcaggatgtgatgtcaccgagatgcagaggatactcagtcaaccaacatttactgagcatctacttcgtgccgtatgtcttgtcaacggaaaggggtccctatccagaccccaagagagcattcttggatctcttgcaagaaagaatttgaggcgaatccatagagtaagcaaggcaagttacttctatatagaagggtgcacccttacagatcaaacaatgcttagtgatgtgtgtcagacctctgagcccaagcaaagccatcatatcccctgtgacctgcatgtatacatccagatg

SEQ ID NO: 453 - DNA, 300 bp, Homo sapiens
cctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctc

SEQ ID NO: 454 - DNA, 300 bp, Homo sapiens
cacctcctaggttcaagcgattctcctgcctcagcctcccaagtagctgggactataggcatgggccaccactcctggctaactttcgtatttttagtacagatagggattcaccatgttggccaggctggtcttgaactcctgacctcaggtgatctgcccgcttcggcttcccaaagtgctgggattacagttgtgagccactgcacccagccaggaatgacatttcaaattattcaattttgctatcaacaccttaatataaaaccaaagaggtaagcatgctggttactatagaac

SEQ ID NO: 455 - DNA, 221 bp, Homo sapiens
  misc_feature (1)...(221): n = A,T,C or G
ggggcggccattactgaaagcctgcacatgaggagtgggttttctctctctctcctcntcaacattgagttgatgatgatcatgatgtttgagacagtgtctcactctgtcctgcctcagcctcctgaggagctaggaccacaggctcatgcctccacatcctgctacattttttattttttttgtagagttggggtcttgctgnnnnnnnnnnntttata

SEQ ID NO: 456 - DNA, 300 bp, Homo sapiens
gaaggcagttatatggttttttactttttcatcaattccataccatcgggagtaactaaatgaaacatacttcaaagaaagaagtcaaattaaatgactgtcattgcccattaataaaaacaacaatctgagcttaacaaaaaatttaacaaacagggaagacagaaagatggtatatttattgcctgactacactggcataactcactttaacaaaaattatcacatttaataatataacctgttatagctaaatattaaacacatattaattagggccaactttgaaggatttctaat

SEQ ID NO: 457 - DNA, 300 bp, Homo sapiens
aagtagctgggactacaggtgcccaccaccatacctggctaattttttgtatttttagtagagacagggtttatccatgttggccaggctggtctcaaactcctgacctcaagtgatcctcctgcctcggcctcccaaagtgctgggattacaggtgtgagccaccatgcccagccaataatttcctgatataataaaaatgccaatactatacaattaaatagtaaagtgataaaaaataggataacatgataaccactaattaatatatactacataatcatccttttcgtgagttga

SEQ ID NO: 458 - DNA, 300 bp, Homo sapiens
gcagctgtggagagaactgtacgtggtaagggggagatataagatgtcctgcataagtattttccctgtagattgcaaagtcatctatggagaggaaaggtccaaaatagtcactggggagagcaggtgaattagatggccaagcagggtggatggatcatttgaggtttggggtgacagatcaactgagatccacttacacttctgaaaacgcaagaacactttagaacattaacaacacttaaagctttttacatcatttgtaaataactggtggaacttaacaccacaaaataaagt

SEQ ID NO: 459 - DNA, 243 bp, Homo sapiens
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgggaag

SEQ ID NO: 460 - DNA, 260 bp, Homo sapiens
  misc_feature (1)...(260): n = A,T,C or G
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgggaannnnnnnnnnnnnnnntg

SEQ ID NO: 461 - DNA, 300 bp, Homo sapiens
ggcaggtcatgttttcaagagtagccagaagtctggattcttatgcaaagcctgttttgttgtttgtttgtttgtttgtttgaagtttggcagcagatttaacatttttaaagtactgtgcaggccaaacaaaacacgcctgttgactggttgtttgccatcctaaatataaagtggggcccatgtgtggtggctcacacctgtaatcccagcattttgggaggccaaggcaggaagatcacttgagcccaggaggtcgaggctgcagtgagcagtgatcgcaccaccgcactccacctg

SEQ ID NO: 462 - DNA, 300 bp, Homo sapiens
gccaggtgtcattgcacatgcctgcagtcctggctactagggaggctgaggcaggagaattttttgcacccagaagttcaaggctgcagtgagctatgatcacaccatggcactccagcctgggcaatagaatgagacccagtctctaaaaaagtagaagttaaaaaaaaagattaagaatagatgtagggcagcagaatttcgaacttcttttcagcatcacaatactttaaaacagtgattgtcatctgcctcaaacccattgcctctcacataggaaatattttgaaacatattttt

SEQ ID NO: 463 - DNA, 268 bp, Homo sapiens
  misc_feature (1)...(268): n = A,T,C or G
gctgcactntggcctgcatgcactctggcctgcatggcagaacaagaccctgtggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgt

SEQ ID NO: 464 - DNA, 300 bp, Homo sapiens
catgagttaaaggatattttcagtcctgttatcttcaattgcagtctttaaaaaaacccaccctattgttctacttgttatatgtctattcatacagtaaattcatttcaaggtttatgccagtgggtattattggtgctttttgaagttgaggtgaaccatccaggaaggtcttgttaatgttatgttcatctataatggcataggggaaatatatatatttttaatattgtaaacatttgtactgaataacctttttttccccccctccgcaagcaaaactggttgaacagcggatga

SEQ ID NO: 465 - DNA, 300 bp, Homo sapiens
attagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaa

SEQ ID NO: 466 - DNA, 300 bp, Homo sapiens
gaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgt

SEQ ID NO: 467 - DNA, 300 bp, Homo sapiens
agtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtcttttttttgtttgttttagacggagtttcactcttgttgcccaggctggagtgaagtggcgtgacct

SEQ ID NO: 468 - DNA, 300 bp, Homo sapiens
ctggaaatgaaattattattttcacccatagtagcaataaaaagaatactcagtaatacgtatggaatactacttagtcataaaaaggaatgaaataatggcatttgcagcaacctggatggaactggagaccattattctaagtgaagtaactcaggaatggaaaaccaaacgtcgtgtgttctcactcttaagtgggagctaagctgtgaggacgcaaaggcctaagaatgatacaatggactttggagactcaggggaaagggtgggagggcggtgagggataaaacagtgcacact

SEQ ID NO: 469 - DNA, 300 bp, Homo sapiens
  misc_feature (1)...(300): n = A,T,C or G
gacagtacctttcccccccctttcatggcccattttattgtctgcctttcagtactaagtatgaccgttcctatctcagatcttaataaagagaaaaaaaaannnnnnnnnnnnnnaatnnggccttanttgantatactngttagcaagcgtgngngacagagagtggggaaagctncatcattgaanatttngataaactttaccgacttgagtntggtncatntntccctttncctaaattaactagcactgnctgnaagncatttnnctgtctgacgnntntcccttccattctgc

SEQ ID NO: 470 - DNA, 300 bp, Homo sapiens
actgcctccttccacacgagtgcccctttggccaaagaagattattatcagatattaggagtgcctcgaaatgccagccagaaagagatcaagaaagcctattatcagctgctctgctcagttagtttttattcccggggtaccaagcagctgcacagtcggtgcctgggaggcacgtagaggcccctggctcaggcagagggagatggttagactcttgcagggctaaaactctaatttggaattgaatattgtggatatcttagttaaaggccatgcttacagcttagaaatgaagcc

SEQ ID NO: 471 - DNA, 300 bp, Homo sapiens
ttttttaagagataaggtcttgctatgttatctaggctggcctaaacttctgggctgaagtgatcctcctgtgtagctgggactacaagcatgtgccaccaatgcctggcttctcacactgttttgtaacatagatatgtgaagatgtgtattatagaattgtttgtaatactgtagtgttgtaggcaatgtgactgtctatagggaagtggacaggttatttgtggtaaatactcatggaaaacggtcaagcagttaaaagcaatcaattatggtcacccagcaatgcagataaatctt

SEQ ID NO: 472 - DNA, 300 bp, Homo sapiens
agaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtga

SEQ ID NO: 473 - DNA, 300 bp, Homo sapiens
atttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgc

SEQ ID NO: 474 - DNA, 300 bp, Homo sapiens
aacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagtt

SEQ ID NO: 475 - DNA, 300 bp, Homo sapiens
ttacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgta

SEQ ID NO: 476 - DNA, 293 bp, Homo sapiens
  misc_feature (1)...(293): n = A,T,C or G
tcatattagtgttgccangagcaaaaggtggggnaggtgttgactttnanagcacagnagnaanttttcntgttgttgttcgnttatctngattgtgttagtgcccacangnctgtatgcatttttcataattcncananntgtatnctaatnagggtgcacttcactgnacataaatgaatctcaacagacaaaaggttaaatcatttgttcattcctttaacaagtatgtgtcgagtgcctactatgtgctgggcactgtaggttcaatggtaagaaaagcagatacaggc

SEQ ID NO: 477 - DNA, 300 bp, Homo sapiens
gatgagttcttttctttctttccacctcctgcaaattatgtgatttgcataatttgtacatagttaggttcatttgttagtttgtattccttttggcttcccccatatcctcgttgactttttctttcttttgtaacttacatatgttatgaaatttatatgaggatatataattttcataaatgtttatggtttacatgtattagttgttattattaagatcaccctgggattgactggccaagcatttggtggaagatagcaataaataatacatcataaaagactttaatgtaaaaa

SEQ ID NO: 478 - DNA, 300 bp, Homo sapiens
aagccaggagcgaggggactaacagcgcaccccctccaccagtgccgacggaaaccccgttttaaattaaaaaataagccagtatacatcgtagaaaatttctcttaaaaatctcacaatttgtaaatgtatattttttctttaacataaaagtttacaatataccgtaaaacaaaaggctcaggaaaataatttccaaaaaaaaggaagaaaaagaaacctgaagttttgaattaaagctgaagacatttttttaaaccctgttgttgaaccagtgacttttttttattgtgctgatgg

SEQ ID NO: 479 - DNA, 231 bp, Homo sapiens
cctcccaggttcacgccattctcctgcctcagcctcctgagtagctgggactgcaggtgcccgccaccacacccggcttattttttgtatttttagtagaggtggggtttcactgttagccaggatggtctcgatctcttaacctcgtggtccacccgcctcggcctcccaaggtgctgggattacaggcgtgagccactgcgcctggccttgggttgttatactggggtc

SEQ ID NO: 480 - DNA, 300 bp, Homo sapiens
gttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactgctgttgtcactccactctcctaggcgctgtcctgggctggctgatgactccccgagtgcct

SEQ ID NO: 481 - DNA, 300 bp, Homo sapiens
  misc_feature (1)...(300): n = A,T,C or G
gtgatcacaagggtcctttgctgtggaatagtgaggtggttgagtcagaggcagagtgatgcaatgactgaaagacttttccagccatctccggctttgnatncggaagtcggtcatgagccagggnntgcaggcaggctntgggagctgnaaaaagcaaganaatggnttctcccctggagcctccagaagggatgcggtcctgccaaccccttgtcagtgagccntttcagatttctgacttccaggactgtaaganaatnancttggcttgtcgaacggnttcaganttcaancact

SEQ ID NO: 482 - DNA, 300 bp, Homo sapiens
cctacttattggatgttggctctttggtgtcatggagatggctttactgtaggtttgttgtgttgcattacttttcattgggattgaactgagaaataacaaacaagctttaagtgggaaattaaaaaaaagaagtaacctatgtagatccaaacttaaaatgtgagaaattattgaaatttcattttctacaaacttgaaattagcctgctaattgtaaagttgttttaataatgctgacaaatgtcagttacgtttgcaaaggagtgtatggttctaggtatttgcctactgttaacc

SEQ ID NO: 483 - DNA, 300 bp, Homo sapiens
gggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcttctatttcatatatttctatgacattatatcttagatgtgtaa

SEQ ID NO: 484 - DNA, 300 bp, Homo sapiens
caaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctccta

SEQ ID NO: 485 - DNA, 300 bp, Homo sapiens
gtgaggctctcttaaaaaatttaaaaatactgaagaaacaaagggaggagtttgtagaatctggagtggaggaaacttctgtgtcaccaaacacagaaaccatcaaagaaaatctttcacttccaaaattagtctatagaaaaaaaaaagaaaatcttaacccaaataagagactgaggcaagagcttcaatcaatcgaggtttactgagccagagttggagcgtgcccaggaaagcaacacaagtcaaagaaacgtctgtggcctgtgctctcccaagaagttttcaggaggctcaata

SEQ ID NO: 486 - DNA, 300 bp, Homo sapiens
cattaaatacacacaagacttcaattgctgggtcctccattgattaatgaaaaaatgattgtttttggaatttgagtgaaacacttcttaatggctgagtagggtggcttacgcctgtaatcccaccactttgggatcacttgaggccgggactttgagaccagcttggccaacatgaggaaagcacgtctttactaaaaatacaaaaattagctgggcctggtggctcatgcctgtaatcccagctacttgggagtctgaggcgagaggatcgcttgagcttgggaggtggaggttgca

SEQ ID NO: 487 - DNA, 300 bp, Homo sapiens
gtctagtataatcttgatgctcaaaccagataaggacaatacaagaaaggaagagtataggctaattctacccaataactaaatgaagtattagcaaaccagattcatcaataatcttttaaaaatcaagaattaattggatttaggaatataacactgtgtataacaagtttaagagaaatatatgagaatgataagactgcaattgaaagtagaggctttctctggagggaaaggtgaggaggatgtgatttggaagaacagcatggggaggcatcagttgtattgtaatgtttattt

SEQ ID NO: 488 - DNA, 271 bp, Homo sapiens
  misc_feature (1)...(271): n = A,T,C or G
aancnangtnatnncaagggtnattggntgnggaatagngaggtggatgagtcagaggcagagtnatgcnnnnnntgaaagacttaaccagccatcaccggctttgaatacggaagacggtcatgagccagggaatgcaggcaggctctgggagctgaaaaaagcaagaaaatggattctcccctggagcctccagaagggatgcggtcctgccaaccccttgtcagtgagccatttcagatttctgacttccaggactgtaagaaaataa

SEQ ID NO: 489 - DNA, 300 bp, Homo sapiens
aagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcatcttcaaagactagtacttacacagtttagaagatttcaaggtactgctgacagtagtttattatgtcagtatacatacgtgtagag

SEQ ID NO: 490 - DNA, 275 bp, Homo sapiens
  misc_feature (1)...(275): n = A,T,C or G
gcactgtggcgctcacctgtaatcccaccattttgggaggctgaggcggaggaccacctgaggcaaggaattcagaaccactctgggcaacataatgacactaacaaagactatctctaatcaaggctagaaccaagggaaggctaataattgcccagtactgtgcatctactgaaagccctacccaaggccaccannnnnnnnnnncntctntnntatgncnantcngaaanaacngnaacnttcacnttnttgactgacgactgtcnacncat

SEQ ID NO: 491 - DNA, 300 bp, Homo sapiens
tgatgccttagtcacttggccacacagttttgtggtttacgagtcatgggaattgcttgtcttactctgactgctaaagttctgtcctattgtcttttcatgtaatagcaacatgactctgatgacaaagcccaactaattacacaacttaatttaatagtttaaagcgcaaagggcattccctgagcagtaaaatcttttgtttggaaattttaaaacaaattatattttactttatgttttatatttacgtaataagtatttacaagaacacaattttctcaagatttaaactgctca

SEQ ID NO: 492 - DNA, 300 bp, Homo sapiens
gtcaactctccttggtgagtgcctcagaacttaggaaaagagaacagcgcatgtctctctcatgaagatgacagaggacaaaagcaagcagaaatatacaaggatttgcgtactctattatgaatttctctttgagaaataatacctgtgagaatgctgctccttcaattaggttcaggattggaggaaaaatcatataaaataggttcctgcaataatattgccccttgagtatgggtgggcttgtgacctgctcagtgctaaggaaatgcagtggaaatgatgctgtgtaacttctga

SEQ ID NO: 493 - DNA, 300 bp, Homo sapiens
ctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcc

SEQ ID NO: 494 - DNA, 300 bp, Homo sapiens
gtcactctgtcacccaggctggagtgcagtggtgtgatcatagctcactgcagcctctacctcctgacacaagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtattta

SEQ ID NO: 495 - DNA, 300 bp, Homo sapiens
gaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcac

SEQ ID NO: 496 - DNA, 300 bp, Homo sapiens
gttatgaaaaattattcccaggtcctaagttccactctaggaacttctaacattgccaccttgatttcagaattatgtgcaccaataactatgttgttcctctcattttttccacttttgagcaagaaggtcacatggcagttaccctctgcctgtcctaccattgtcttttgggtatgtgttgggcaggtaatttgtctcttaagttccagaaacgagattgagagaagcaatatatattcaaggagcagcatttaaggaactacctacacccaggaaatttcatctgtacctgcacct

SEQ ID NO: 497 - DNA, 300 bp, Homo sapiens
gtcacatcttaaatggatggtggcagacaaaaagagagagcttatttagggaaactctgtttttaaaaccatcagatctcatgcaacttattcaccatcacaagaacagcagggcacagacccatccccatgattcaatcatttcctactgggtttcttccacagcatgtaggaattatgggagctacaagatgagatttgggtggagacacagagccaaaacacatcagatgccatggaaatacaatgaggaaaagacagtctttccaataaactgtgctgggaaacctggctatccat

SEQ ID NO: 498 - DNA, 300 bp, Homo sapiens
gcaaccttcgcctcctgggttcaagtgattctcctccctcagcatcccaagtagctgggactacaggcacgtgccaccacacccagctaatttttgcatttttagtagaggcagggtttcatcatgttggccaggctggtctcaaactcctgatctcaagtaatctgcccactttggcctcccaaagtgctggcattacaggaatggagccaccgcgcccagcctgatttctttttttaggtcttgtcaggaaagatattgattcttttgattcgtgaacatggtttttggtcgtcttta

SEQ ID NO: 499 - DNA, 300 bp, Homo sapiens
cttaacagagaaggtacctgaggctcaaaaaggatgactgacagtcctagtggcagaatggaggtgggatctggaacccacaacttgattcctaggactctttttttttaattcccacattggctgggtgtggtggctcacgcctgtaatcccagcactttgggaggctgaggtgggtggatcacctaaggtcaggagttccagaccagcctgaccaacatggtgaaaccccgtctgtactaaaaatacaaaaattagccaggcatggtggcccatttcctgtaatcccagctactcagg

SEQ ID NO: 500 - DNA, 300 bp, Homo sapiens
gggctgaccttaagataaggagatgatcctggattatctgggtggacccaatgtaatcacaagggtccttaactgtggaatagtgaggtggctgagtcagaggcagagtgatgcaatgactgaaagacttaaccagccatcaccggctttgaatacggaagacggtcatgagccagggaatgcaggcaggctctgggagctgaaaaaagcaagaaaatggattctcccctggagcctccagaagggatgcggtcctgccaaccccttgtcagtgagccatttcagatttctgacttccag

SEQ ID NO: 501 - DNA, 300 bp, Homo sapiens
ctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgtgtgcacccacacgtgtttataaaggtagcagttgtaggaatgaatgagattgggggtgagggggtgcatatgtatgtctatgaaagcctaatcatttctgggcaatgatgtaaaggttttacgac

SEQ ID NO: 502 - DNA, 260 bp, Homo sapiens
  misc_feature (1)...(260): n = A,T,C or G
caccatcgaatatttttatttattttgagagacagactctgtcacccaggctagtcttaaactgttggtgaatcttaagtgattctcccacctcagcctcccaaagtgctgggattacaggcatgagccactacccttggctgtgatcaagtatttagtnnnnnnnnnnnnnnnnnntaaatagtctgaagtagagaaaatagcacccaatctaanataaggtgaggtctanncacttatttaannctncnttnntnnct

SEQ ID NO: 503 - DNA, 294 bp, Homo sapiens
  misc_feature (1)...(294): n = A,T,C or G
gctatgctaaacagcctttacatgtatggtctggttaaagttcctttgttccttttgttttaataaaatgtgtcactgattttttagctcaaaatcatcactgttaatttccagtcaccccaaatatggttaaaagatttttttttttaatcatgaagagaaaattagtagcatttctttctctccccattatttattggttttcctcactaatctttttttttttannnnnnnnnccaaaaatattnatctnggtttnacntttnaattnccntncttaatnggaattttttt

SEQ ID NO: 504 - DNA, 300 bp, Homo sapiens
cagaacttcacagcagcctgtcctcatcagcaacccaaccaccttcatcagcaacccaaccaccttcatcagcaacccaaccacctcgtcagcaacccaaccacctcgtcagcaacccagccaccttcatcagcaacccaaccacctcatcagcaacccagccaccttcatcagcaacccaaccacctcatcagcaaaccaaccactttcatctgcaacccaaccactttcatcagcaactcaacaccttcatctgcgcccaaccaccttcatcagcaaaccaaccaccttcttcagcaa

SEQ ID NO: 505 - DNA, 300 bp, Homo sapiens
gcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgcagccagggactaggc

SEQ ID NO: 506 - DNA, 276 bp, Homo sapiens
  misc_feature (1)...(276): n = A,T,C or G
ccaagtntncancanccaccaaanggnttnnccgnatgtggtccttatacacaatanagtgntantcatccatacnaaaagaatgagatcctatcatttgcaataacatggatgaaactaaaagtcattgtgntatgngaaatnagncaggcncagaangtcanaatatcacgtgttgtctcctcntctntaggannnnnnnnnnnnaagccatctgaactgacagagatggagaatggaaggatggttaccagaagttggtggggaagggggaag

SEQ ID NO: 507 - DNA, 300 bp, Homo sapiens
aaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatc

SEQ ID NO: 508 - DNA, 300 bp, Homo sapiens
tgaagccaggaaagggggtgggctagggggtgctgttttaggtagagtgatgggaacagccccactgagcaaactttagccacatgagtagctggaagaaaagccttctaggaccagggaacagcaagtgcaacagccctgagacaggatgggcttgtcagtttgaggagcagtgggaggcctgaaccaggttacatggggcccagccagtatggccacgactttgtgttttatccagagtacaaaggagcctcactgagggacaagggaagtggcatgatgtgacccgcatattaagag

SEQ ID NO: 509 - DNA, 300 bp, Homo sapiens
gcctgggaaagcgtggcgcccatgaatatccgcaggagcacgcatgacctgggggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcctcccacatg

SEQ ID NO: 510 - DNA, 300 bp, Homo sapiens
tgcaacatcactgatatcagcatcctttaaaatattatctgcttcttgttctaagagcaacaaagctgggaattccttatagagttattcacaatgcctccataatgaatgctgtaggctgctgtggtttacagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttg

SEQ ID NO: 511 - DNA, 300 bp, Homo sapiens
gtatcacctgagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacatttt

SEQ ID NO: 512 - DNA, 300 bp, Homo sapiens
gggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttact

SEQ ID NO: 513 - DNA, 300 bp, Homo sapiens
cgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaagggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcga

SEQ ID NO: 514 - DNA, 290 bp, Homo sapiens
  misc_feature (1)...(290): n = A,T,C or G
agtatgagaagggaggatgggggagaatctgattaaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgttgggtttttctttcttttttttttttttnnnnnnnnnctnccnaaaaaancncccggg

SEQ ID NO: 515 - DNA, 300 bp, Homo sapiens
  misc_feature (1)...(300): n = A,T,C or G
anaaggcgcangaagcagaagcgcagagcgaggacgacgacgaggatacagaagaggaacagggggaagaaaaggaaaagggagcgcaggagaaaaggagggggaagagagtccgttttgcataagatgaagaatagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaaca

SEQ ID NO: 516 - DNA, 300 bp, Homo sapiens
gctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttcca

SEQ ID NO: 517 - DNA, 300 bp, Homo sapiens
ggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcct

SEQ ID NO: 518 - DNA, 214 bp, Homo sapiens
ctcagacaaagaaaccattgaaattatagacctagcaaaaagagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaa

SEQ ID NO: 519 - DNA, 300 bp, Homo sapiens
agcaattccactcctagctccacccacaggaattgaaagcaaagacgcaaacagatgcctgtgcaccaaagttcacggcagcatccttcgccatagtggcagcatccgtcgtcacagcggcatcatccttcatcatagcggcagcatccgtcgtcacagcggcagcatccttcgccacagcggcagcatctgtcgtcacagcggcagcatccttcgccaaagcggcagcatccttcgtcatagcggcagcatcctttgccatagcggcaaggtggaaaccctgtccatccactgaggcgt

SEQ ID NO: 520 - DNA, 300 bp, Homo sapiens
caccgccaggccagctgtcaggaaacaggggctctaggcccagcttcaccacttaggagctatggctttgttcagaaacattgtgactctcttacccacacattcctctgctggaaggggagattgacaaaccagcatcatctctaatttactacaaaagccctcactggaaattattcttaacttagcagctggtaggatccattaaaaaaaaaagtaagttagactgtgttactctgctgctcaaagccctgcagtgcctcctcattttacctagcgtaaaacctaaagtcctttcca

SEQ ID NO: 521 - DNA, 270 bp, Homo sapiens
  misc_feature (1)...(270): n = A,T,C or G
cacagttctgcatggctggggaggcctcacaatcatggtggaaggcaaggaggtgcaaaagcatgtctcacatagtggcaaggcaggagagagcatgtgcaggggagctcccatttataaaaccatcagatctcatgagacttagtcactaccacgagaacagtatggggggaaccatccccatgattcagttatctgcacctggccccacccttgacacntgggaattattccaatgcnnggtganatttgnntngnnanntttncnna

SEQ ID NO: 522 - DNA, 300 bp, Homo sapiens
attgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatg

SEQ ID NO: 523 - DNA, 300 bp, Homo sapiens
tgaagaatggcgtgggttggttcctttcaaatgcacttgagcagcggtctccaaccacagggccacagagctggaggtgagcagcaggcgagtgaagggaaacttcatctgtatttctagcccctcccatcgcttgcatgaccacctgagctccatgtcctgtcagatcagcagcagcattagattctcacaggagcacaaactctgttgtgaagtgtgcatgcgagggatctaggttgtgtactccttatgagaatctaatgcctgatattctgttactgtctcccatcaccccagatg

SEQ ID NO: 524 - DNA, 300 bp, Homo sapiens
caagaagagttttctgttcagtttggaacaagattttgagaagacatttaggatgtactagtttgagtttttaaatgtatatttgagatattttctcaactttctctttgggtctgtagctaaaatatgcagtataatgttatatttatttattttttaagagatggggtctagctattttgcccaggcagactcaaattcctgggctcaagtgatcctctgccttggcctcctgagtagctgggacttacagacatgtgccaccaaacctagtggctatataatttttaaaaatattct

SEQ ID NO: 525 - DNA, 300 bp, Homo sapiens
gccacacgggcccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctgg

SEQ ID NO: 526 - DNA, 300 bp, Homo sapiens
ttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagtt

SEQ ID NO: 527 - DNA, 300 bp, Homo sapiens
atccagagaaatgatgtgccttgtgtaaagttgtggttaggaagggacagagccaggactctaaattctgtcctccggccataattccaaaactttctccaatgttaggtatgtaggctaaaatgtgctaacagcacttgtgtttttgtttccttttgttttactttttattatggcaaatttcaaacatatacagatacagaatagtttaatgaactcccatgttctcatcatgccagttcaaacatgaatacatggtcaaccttgtatcacttaaactcttgcacacaagccctgccc

SEQ ID NO: 528 - DNA, 296 bp, Homo sapiens
  misc_feature (1)...(296): n = A,T,C or G
gtaagttatttgttaagttagaaccctcagtgcatggtctagggatctctggaggtccccaggaccctttcagagaagccatgaggtcaaaactgttttcataagcagaaccaaaacattatttgactttttcaatgcattggcatttgcattgatggtacaaaagcaaggatgagtaaaatggnnnnntncttagcgngatcaagatggnaanaantgcacnaganaacnntgtntncttnnctgcanngngcnttttaagactnccnattcnaantaaganancannnacggcc

SEQ ID NO: 529 - DNA, 300 bp, Homo sapiens
aaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttg

SEQ ID NO: 530 - DNA, 300 bp, Homo sapiens
aacaggaatatggaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcagg

SEQ ID NO: 531 - DNA, 300 bp, Homo sapiens
cttagattctacctgtaacattttataaaacttgctttataacacagatatctatcaatctcatctttaaatttaattttttttttgcaacagagcaaaacccagtctccaaaaaaaagaaaaaggaaaaagaaatgtatttaaattatccatgcttttagctatttacttatgagcctttataacagattcttcatagtctgccttctatactcccagggtgatggtctggggaagggggagctaggacctgtctttcctttggtcttatcaccacctcttccaggggctgctccttcc

SEQ ID NO: 532 - DNA, 300 bp, Homo sapiens
aatagtagaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatacacatgcacacacacatacacacactggcccctgtttttctgtggtgtcactgggtg

SEQ ID NO: 533 - DNA, 300 bp, Homo sapiens
gattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttgg

SEQ ID NO: 534 - DNA, 300 bp, Homo sapiens
gcctggcctaaatgaagtaccacatgaccgaccgaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacagtgagctgtgatcgtgccactgcactccatcctgggtggcagagtgaggccctgtctcaaaataaataatccagtcccccccaagaaaggaatgaagtgctataatgagaaaaatccta

SEQ ID NO: 535 - DNA, 300 bp, Homo sapiens
tggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggca

SEQ ID NO: 536 - DNA, 300 bp, Homo sapiens
agtgcacgcagcccgagcccacgggcgactgacagctctgcaggagagatttcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataa

SEQ ID NO: 537 - DNA, 267 bp, Homo sapiens
tttacattttgtttgaatcaggatccaaataaggtttaaatattgcaatttgattaatacattaagattcttttaatctataagttcctgctccatctgtcattttatttttatcccttgaaatttatttattgaagaaactatatcctttgctttgtaaaattttccacagtgtggctggctttggctgattgctagcgtcatttgctatttatttttgtcctgtatcttggatctggcgccttgatcagatttaagttgattttt

SEQ ID NO: 538 - DNA, 300 bp, Homo sapiens
ggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggttggggctctcgtcgttggccttgtagatcaagtaggggaagtgagtgatgttcagtcacgctgctgggacacttggatttccag

SEQ ID NO: 539 - DNA, 300 bp, Homo sapiens
accagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttccctctttctaatgtttaaatcccataaagctaagtttcccgttaaagggaagtgctttgaagatgtgtacccatttttgtaagttaatcatgattatcctggaaaaagaagaaaagagcttcttctttgcagaga

SEQ ID NO: 540 - DNA, 297 bp, Homo sapiens
  misc_feature (1)...(297): n = A,T,C or G
gnnctatagaatacaagctacttgttctttttgcnggancccatcgantcggaattatagtattgacgtgaatcccactgtggtatagattccataatatgcttgaatatnatgatatggccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattg

SEQ ID NO: 541 - DNA, 300 bp, Homo sapiens
aatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcccttgaagatacagtttttgaggcttcttcaga

SEQ ID NO: 542 - DNA, 300 bp, Homo sapiens
gactgtgtgtgctggtgtgtgtgtgagttctacgtttctaccatatgtgatcagtttaatagtaactttatttatttaaaaaaaagaaacacaattagttactgttaaactgataaagggtgtttatttttaccttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgctta

SEQ ID NO: 543 - DNA, 300 bp, Homo sapiens
ccagagctggcagaagaaaacagtaaagcttagagtagaaataaatgaaataaagaacagagaaatatagaaaatcaaaaataccaaaagttggctctttgaaaagatcaacaaaattgccaacccttttaagtagacaagaaagaatgaattgttggtggtgcagtggtgagcatagctgcttttcaagaacaaaaaagactcaaatgactaaaatcaagaatgatcaagaatgagagagtagacattactacagatcttacagaaatgaaaggattattaatgagtactgtgaacagt

SEQ ID NO: 544 - DNA, 300 bp, Homo sapiens
gtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagca

SEQ ID NO: 545 - DNA, 300 bp, Homo sapiens
taagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattca

SEQ ID NO: 546 - DNA, 298 bp, Homo sapiens
  misc_feature (1)...(298): n = A,T,C or G
gaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattacaaaacttacactaaagcgacagaggaaacttgttcctttgagtaacgaaggtggagcgtagannnnnnnnganganangaaaaggccttnttagctg

SEQ ID NO: 547 - DNA, 300 bp, Homo sapiens
agtaaatgataattgtgccactgcattctcacctgggtgggtgacaaagcaagaccctgtctccaaatatatgtatgtatgtgtatatatatatatgcacacacacacacatatacacacatatatatattctgaatatatatattcgtgactccccgaaataaattcagtttatatatatgtaaataaattctgaagactctacatgtgtgtgtatatatacacatatatttttgtattaacgttaatagtaatattaacatgagttcagggtattagccagttctgtctttcgggatg

SEQ ID NO: 548 - DNA, 300 bp, Homo sapiens
atcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaag

SEQ ID NO: 549 - DNA, 300 bp, Homo sapiens
tctccttgcctttctcctgaaaggtatgagactacttgccttactgtcatattattgagggaatcagcgcaaagcctgaggaaatgaacagtagctgtgggtcaaagccatgtctccaggttcacggctcactcccccaggacaagcctagttaggtagtggctgcatctggtatccctgggacagaaatgcaggtgagagggggtatcaagaatgcctcgagcctctagaactatagtgagtcgtattacgtagatccagacatgataagatacattgatgagtttggacaaaccacaa

SEQ ID NO: 550 - DNA, 300 bp, Homo sapiens
gaaccaagaaaatatttaaaaatctaagcagtcctttgctcattaaaggataaatcagtagttaacactttttctacaaagaaatggtgtgcctggatggtcgtgtaggtgagttttaccaaggattatggtaacaaatgagtgagacctctatggagaaaatattgaaggacattaaagaagacctcataaatggagagagatatatcattaatggataggaagcctcaatggcataagtatgtcagtttctttcaaaactcacctatggattcaatgtgattccaaaccaaatcccaa

SEQ ID NO: 551 - DNA, 300 bp, Homo sapiens
gctacttgttctttttgcaggatcccatcgattcgaattcggcacgaggtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagag

SEQ ID NO: 552 - DNA, 300 bp, Homo sapiens
  misc_feature (1)...(300): n = A,T,C or G
cgcaaactggctaatctctgntananaactatgatntncgccatnatgttgatannagggnccttagggggnanatngnaaaaaacctntgaccnangcncnnatgantcaangnnttgntactccacgtgtaatgcntcncaaacnttgncntatngctctgaanacnctncgcgaccangaanaatananaagannctgnanannatgctananttttggccnananaatgaacgaggctaaagagattcncctggancnaannnntgaatagantcatactttcctntctgctagct

SEQ ID NO: 553 - DNA, 297 bp, Homo sapiens
  misc_feature (1)...(297): n = A,T,C or G
aggaagttgaagctgcaatgggctatgatcgtgccactgcaccccagcttgggccacagagcaagagcctgtctcaggaaaannnnnnnnnaaaantccaaaantanttngnangttccaaattgcnngccnttctganaaangnaatacgancnaatcttccaccntcntactccntcccacctaanatgngaaccctntttgnccannggntccaaacngnatnngctacttgngngttagnaatcaaccanngatancagggnancttttaacgnaggagtgctttnntgggta

SEQ ID NO: 554 - DNA, 300 bp, Homo sapiens
ttattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttatccagatgaaaacacataa

SEQ ID NO: 555 - DNA, 273 bp, Homo sapiens
  misc_feature (1)...(273): n = A,T,C or G
ctctatcttgtttattgttgatgccatcttagaggaaaaaatgtaaaggtaagtaattaagcatatgacagcaacaaataagatacttataacctaatgggactttattttgtagttttatgtattacaaaaaatccacctttctctaagggaagtttgtaccccattgattcttggtgcctttgggatcgactgggttttaatggcctagttatttgaggattttgctgngntgtnnncatggnctntnngatnnccttnganganannnnc

SEQ ID NO: 556 - DNA, 300 bp, Homo sapiens
gtgccatcttgctatgtttcccaggctggttttgaactcccagcctcaagcaatcctccctttccgcctcagcctcccaagtggctggggttatgggcctgagccactacacagctaagagtgtcttgtatgtgctaatgagatggctggtgtctgagagcccctagagagcttcaagatgggggctagtctttagaaagtccaagcaatggctaggtatggtggccactgcctgtaatcccaggagtttgggaggccaaggtggacagatcacctaggagtttgagaccagcctggcca

SEQ ID NO: 557 - DNA, 300 bp, Homo sapiens
ttctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggg

SEQ ID NO: 558 - DNA, 300 bp, Homo sapiens
gtactccaggttgtgtttgtgaatcaagatgaacagcccgttcaaggccaagaggctgagggcccccccgaggtcgcaggcgcgggtgaggaagtcgatcatgagcgtgggctgcgccagctgcggcaggatggcgtcatgcacaatcagcagcaccttcttgtagaggctgaggggcagcttgtgcttgaggaagctgagccacatggcctggaaaaccctcctgtgctccttcaggtgagcaacctctcgtgccgaattcgaatcgatgggatcctgcaaaaagaacaagtagcttgt

SEQ ID NO: 559 - DNA, 300 bp, Homo sapiens
gaaaacatctaactaagatggtttcactggtgaattcaatcaaatatttaaggaacacataataccaaaaccataacacatacaaatatatggcccttcagattttgtacttctttttgtgtcagtgttaataatacgtatctttcaaagaatatccccctttttttttggtagagatagggttttgccatgttgttggtagcaagccctaaccctgtcataaacaggccttaaataaactggccataaacaggatttctgcagcaatgggacatgctcatgatggctgtcatgcacact

SEQ ID NO: 560 - DNA, 300 bp, Homo sapiens
acactgtcccactccatcacccaggctggagtccagtggtgtgatcatagctcgctgcatcctccagttcctgggttcaagccatccctcctgcctcagcctccccagtagctggaactacaggtgtgtgccatcacacctggctttacatttttctgtggggtcttactatgttgcccaggccggtctcaaactcctgagctcaagtgatcctctgcctcagcctccagagtatctgggattacatatgtcggctaccgtgtctggccgttcacatctttggccactatttgcttgtga

SEQ ID NO: 561 - DNA, 300 bp, Homo sapiens
aatgagaaagaaggaggaatctgaagccttgggtaaggatttggggcacagtaccaggaggggggcttggtgccagacctcatgaggaagaaggattttcctatgtacagagaaggggaccctgtcctgttgggaggtgctgtgcaaacctaaccaagttactaacccctctgttttatgtgctacacaaaggggataaatacaagcttccctctctagccaattctatttggttcctgagtttggaaaagtgatagatactgattttctatgattttatgaggacttaaataagctcct

SEQ ID NO: 562 - DNA, 300 bp, Homo sapiens
ggaggacgaggaggaggacgacgaagaggaggaggaggaaaaggaggtggaggagcagcagcagcagctgcagcagctaatatgttgtacttattctgtgctgggcaaaattctggatatttttcatgtactatttaagcctcacaaaaatcttatgatataggaaatgcttgtttccatttggcacatgaagaaactgaagaacagagaaatgatgaaacttgcgcagggtagtctgtccagagtctgtattttaactactgctgtgttgcctcccattgcatagtgacttcacgtgta

SEQ ID NO: 563 - DNA, 300 bp, Homo sapiens
gcctattcagttcctggtaagggctgtcttcctggcttgcagttgaactacttcttgctgtgtcttcacaagcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtcagccacatttaccactcaataaaatcttc

SEQ ID NO: 564 - DNA, 299 bp, Homo sapiens
  misc_feature (1)...(299): n = A,T,C or G
gagaagccaagggagaggaggaggaggaaactaacgattccctgcccacccccacacccagcaccaccaacaggtgggcaagcttgccgagaaaacgcagagggcatcctgtgagcagcaaacactctgagnnnnnnnaagacgcagagaagtaaagatcaaagcgctactncangatcccgtaccagactcaagccatggctggtcccttctccgtctgctgtccgcccgcccggactcagcttctggttttggccgagcgggtcttacccgtgggtttctgctccgacggaacctgt

SEQ ID NO: 565 - DNA, 300 bp, Homo sapiens
cttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcag

SEQ ID NO: 566 - DNA, 300 bp, Homo sapiens
attttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatata

SEQ ID NO: 567 - DNA, 300 bp, Homo sapiens
tcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttttccagatgaaaacacataaataa

SEQ ID NO: 568 - DNA, 300 bp, Homo sapiens
  misc_feature (1)...(300): n = A,T,C or G
gctcttgttctttntgcaggatccntcgattcgtttaaggaaaaccagcaaataacaagaaaaccatttaatgtaaagatttgtaaataatcacttcaaaagaagtgccttgttgctgtcacatttagtccatcttcatataattcttatctgggccagtttcttgggcatgggacatgtgcagttacacaagcctgtgctcttaagagggtcttacccatagtttaatgttctgctgttgtagtcttgaaattcttaatgatttaacaaggggtcctccattttcattttgcactgggc

SEQ ID NO: 569 - DNA, 300 bp, Homo sapiens
aagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttc

SEQ ID NO: 570 - DNA, 300 bp, Homo sapiens
cccaggatgaactggttgcagtggctgctgctgctgcgggggcgctgagaggacacgagctctatgcctttccggctgctcatcccgctcggcctcctgtgtgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaatt

SEQ ID NO: 571 - DNA, 300 bp, Homo sapiens
gttgctttcaaaagacacatatcaccatagtacatgtaataacacacataggctcaaagtaaaggggtggcgaaagatctgttatgcagatggaaaaaaagatcaggggtcactattcttgtatcagataaaacagactttttaaatcaacaacagtagaaaaaggactagggcattacataatgaagaagggttcaattcaacaagatttatcctatacacacccaagattggagcactcagatttctaaaactattatttctagacctaggaaaagaattaaacggccacataataat

SEQ ID NO: 572 - DNA, 300 bp, Homo sapiens
gaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggaga

SEQ ID NO: 573 - DNA, 300 bp, Homo sapiens
  misc_feature (1)...(300): n = A,T,C or G
ggctgcgaggttttcggctttggctcctgatatgcagcgacagaattttcggcccccaactcctccttaccctggtccgggtggaggaggttggggtagcggaagcagcttccggggaaccccgggcgggggcggaccactgccgacctctnnnnnnnnnnggnacggnantacnaataacncnccaccgtacgcgccctnatcnnggncntaccgtnccaggtgctnnnnaagntncaccaggccctaaccggggttctggcngancncaatggccctgaangacgccgncnagcaccg

SEQ ID NO: 574 - DNA, 300 bp, Homo sapiens
agattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacatag

SEQ ID NO: 575 - DNA, 300 bp, Homo sapiens
gtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgt

SEQ ID NO: 576 - DNA, 300 bp, Homo sapiens
aagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgt

SEQ ID NO: 577 - DNA, 300 bp, Homo sapiens
  misc_feature (1)...(300): n = A,T,C or G
actcgagacgctgaggcaggagaatcgcttgaacccgggaggcggaggttgtagtgagctgagatcgtgccactgcaccccagcttgggcaacagagcaaaactctgtctttaaaaaaaaannnnnnnnnnnnnnaacaaacaancaaaaaaaaccttatatggnctgggctgggcgtggngccttatgcccacaatcccagcnttttggnaggccaggatgggaggatnacttgancccanaantttganaccagcctgggctacanagtanggccccntntntacaaaaaaaccttaa

SEQ ID NO: 578 - DNA, 300 bp, Homo sapiens
ggtagactggctagggatcctggacccagggttccacgtagcaacacctgctgagttctctgggttttcttcctgcctcatgtagcccagacttggagctgaagaagctggaaacatggaaacaccaacagctacagaccaaaaaaagtcccaacaaaggcctgtcagtctgccagcctgttctgtggatttccaactcaagattgcagcatcaactcacacctgaagttctggcttccctacaaactttgaacttgccagtccccacaatggcataagccaattccttaaaatgaatgt

SEQ ID NO: 579 - DNA, 300 bp, Homo sapiens
  misc_feature (1)...(300): n = A,T,C or G
ggcagaccatccacatcagtttcagagaaaaacaataatcttgtttgtgccgtgatgaagaggactgacagctagcagcagaaacaatagtcacggaggttgagaacaggctggttaacatggtgaaatgccatctctattaagaatacaaaaattagctaggtatggtcgcagacacctgtaatcccagctccttgggaggctgaggtgnnnnnnnnnnttgaacccnngaggnggnagctgctgtnnncnngactcgnnatatnactgcacctgggngactgcagtgaanctttatct

SEQ ID NO: 580 - DNA, 300 bp, Homo sapiens
atacactgcatttgctggtgctgtttttatatagtgaagcaacagctgtacagcaaaataataaaatactcacttcttcgttaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccaaaaggctccgcctcc

SEQ ID NO: 581 - DNA, 283 bp, Homo sapiens
  misc_feature (1)...(283): n = A,T,C or G
gtcctaaagccgctgaagcaaaaaccatgataaaacattctgctttcttttcttttacaaccccacgaacgcaaaaaaaaaaaaaaccaaaaccaaaccaaaaaaaaaaannnnnnnnnnnnnnnnnnntnttngnngnaaaaangggttttgnncnnggnannaaccantnnaantnnaaanntnncaaanaggggtnanctttntnnctnancttttnaaaangttnatnnnaatnnccngnnaaanccancnnggtntngccntnnaaaggtnacctaaa

SEQ ID NO: 582 - DNA, 283 bp, Homo sapiens
  misc_feature (1)...(283): n = A,T,C or G
cccaacnatagccntttcnannnttaaaggtttttgnantnctgggccntncngacgtnanncctnancnnttttttaagcnggtttgccnngggnncnggtggnnnntnnggggtnnttggtnnctgggggcnanancnacttncctnccccgggccatncntnnnnnnnnntgtaggaaagttcttcacttttttctctgagggctgggggttgggggagtcagcatgattatattttaatgtagaaaatgtgacatctggatataaaatgaaaataaatg

SEQ ID NO: 583 - DNA, 300 bp, Homo sapiens
gtcgtctttaatttgtctcatcagtgcctccatgtgtttttgatgcctttgaactggtatttttaaaatttcaatttctaattgttcattatagaaacacaattgggttttatatattggcattgtattttgcaactttcctaaactcactagtaattctagtagctttttttggtagattcttaaggattttctgtgtaaatagtcatgtcatttgtgaataaagccatttttttttccttttcaaattttgtgccttttatttcttattcttaccatatcacattggcaaagacctcc

SEQ ID NO: 584 - DNA, 300 bp, Homo sapiens
aaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatgaaaaaaaggtaagac

SEQ ID NO: 585 - DNA, 300 bp, Homo sapiens
  misc_feature (1)...(300): n = A,T,C or G
gtccagaaatactctgatactagctatggtcagcaacatttaatgaaaacccttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgaccgcctaggcctcccagagtgctgagattacaggcgtgagtcactgtgcccggcctcnnnatgttaggaa

SEQ ID NO: 586 - DNA, 300 bp, Homo sapiens
caagggcctctggatggaatgtgccacacacagcacaggcatcacccagtgtgacatctatagcacccttctgggcctgcccgctgacatccaggctgcccaggccatgatggtgacatccagtgcaatctcctccctggcctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatggaggac

SEQ ID NO: 587 - DNA, 300 bp, Homo sapiens
ggactaacttacagaggagctgtgtatcctgaagattcagcgactggcaaggaatttccttgggagcaatgtgtgagggaggccatctgaggagatctgtggctttcttttgttgtgggaatctggcttatggatgaatctacgacacaggattgtgaaattacagctctttgggaacaaaaggaaggcagtattgcatgacttagtttcccagcttcactttccctttggcatggtgagtttggggtcttgagagtctattttctttcacacccatcagcactgttaagtaagcaggaa

SEQ ID NO: 588 - DNA, 300 bp, Homo sapiens
aaaaacctgggtatgtatctagaagtggaaaaacaaaaaaaggaaataagttatgaaaataaaaaccatgtcttgagctgggtgcgctggtgtgtgcctatatccctagattctcaagaggttgagacaggaggatcacttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcact

SEQ ID NO: 589 - DNA, 300 bp, Homo sapiens
cctcctactcccaaacaaatctttggggaaaaaaaaactaccaactgtcagccatgggcctgacggcgctaagctctggggctccgtgcactgacgtggggccagccacagggaggcggggatcaagtagcggaggccaggattttggccacctcccgggcaagttgcagggcagtggcgccgggagcaaaagcagcatgatgcagctcatgcacctggagtccttttatgaaaaaacctcctcctgggcttatcaaggaagatgacactaagccagaagactgcataccagatgtacca

SEQ ID NO: 590 - DNA, 300 bp, Homo sapiens
ggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtg

SEQ ID NO: 591 - DNA, 300 bp, Homo sapiens
gagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcat

SEQ ID NO: 592 - DNA, 275 bp, Homo sapiens
  misc_feature (1)...(275): n = A,T,C or G
gaaatgtgtatttcagtgacaatttcgtggtctttttagaggnnnnnnnnnnnatatccttggctttntaggcnatatgctcanagtgcgacagcggnaccntgccctcanatncttacnnaagctttgantaggnccatnnnnngctacntccctgaantcctnccnnccctcactggctgccctnacangccanctgacgantgnccttaaaggcattaacncgcntcnnttgtggngtcctcnggcttanggagnnaagaggtggctcttga

SEQ ID NO: 593 - DNA, 300 bp, Homo sapiens
tgacattgtcagtgtgaaatttaacagactttggttttaggagttaggtttaggttgcagacctaaagttgcagttgacatgtccttgttttataggaggatatacatcctgaaagttttagggactggcaaagaatttactgctgagcaatttgtgattgcagtcacctggagattcatgaggctttttgcctttttgtggggatctggttaatgcataatattttgacacaaggttgcaaggtaacaggtatccatttgggaaaagaatgacagttttggagaacattagttctgcag

SEQ ID NO: 594 - DNA, 300 bp, Homo sapiens
  misc_feature (1)...(300): n = A,T,C or G
acctaagactgctttgaaacataaagtaataatnaaanaaatgggctgggtgtggtggnttatgcttataatcctagcnctttgggaggctgaggcgggaggatcntttgagctcaggagtttnagaccngtttgggcggtcccagttatcaggaggctgaggtgagagggattacttgtgcccaggaggtcaaggctgcagtgagctgtgattgtgccactgtactccagccctggcaacagagagagaaccctgtctcaaaagaaagggggggggaggaacggaggaagggaaggagg

SEQ ID NO: 595 - DNA, 300 bp, Homo sapiens
attatggtggaaggggaagcaaatgccctacttcacatggtggcaggaaggagaagaatgagaaccaaatgagggagaagccccttataaaaccatcagatcttgtgagaacttactatcatgagaatagcatgggggaaactgccctgtgattcaattacttcccactaggtcactcccaccatacatggagattataggaactacaatttaggatgagatttgggtgggaacacagccaaaccatatcaagtattaacagcagaattaaccaagctgaggaaagactctcagagctca

SEQ ID NO: 596 - DNA, 300 bp, Homo sapiens
gcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttc

SEQ ID NO: 597 - DNA, 300 bp, Homo sapiens
agacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaa

SEQ ID NO: 598 - DNA, 300 bp, Homo sapiens
ggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtga

SEQ ID NO: 599 - DNA, 300 bp, Homo sapiens
agaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctg

SEQ ID NO: 600 - DNA, 300 bp, Homo sapiens
tttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctg

SEQ ID NO: 601 - DNA, 300 bp, Homo sapiens
ggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgt

SEQ ID NO: 602 - DNA, 300 bp, Homo sapiens
gccttttgtggggtctcatacataactcagtttccacaaagctgtgccccagctcagccctatggatagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggc

SEQ ID NO: 603 - DNA, 300 bp, Homo sapiens
  misc_feature (1)...(300): n = A,T,C or G
ttaatatgggaacnccngtttctaactgtcatcncccccnccccaacacccccaanncagcagttttnttcacccgctgcagccgttccgtnccaaacanagggccncncanannccccncgntntatataaggaggaaaacgggaaagaatataaagttaaaaaaaagcctccggnttccnctactgngtanactcctgntttttcaagcncctgcagattttgatttttttgntgntgttgttntccnccnttgctgntgntgcaggggtactattgtttaaaaacaggaaaaaaaat

SEQ ID NO: 604 - DNA, 300 bp, Homo sapiens
cttactttgatcctcgtgaggcatacccagatggaagtagcaaagaaaagagaagagcagcagttgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctc

SEQ ID NO: 605 - DNA, 300 bp, Homo sapiens
  misc_feature (1)...(300): n = A,T,C or G
gaacattcggactcgagataatcgtcgccttggggagtgggacttgcctgaggctgtgcagctgactggtggagctaccgaacacgagggtcccatatgcccgaagaaaatttctggccctttgtacatacatgacgccaaccactgcgagtgccatcagctctctcttgttgnnnnnnncccccgnnatgntgacgntgnngannncttanaccnttttnnnnctnngaaaggaggnntgattgcngntnccctgagatntggcttcccaagagcacttattgacccttcctcaggcct

SEQ ID NO: 606 - DNA, 298 bp, Homo sapiens
  misc_feature (1)...(298): n = A,T,C or G
cccccggantaaggntgnnntatnntnnccanaaaaaanngggncnatnatgngntcgngaaggntnnggaacaacaaggactgcntnattggaagnggncncaggnttgaanccaaagntaaangagtgaatnaggtgntnntggggaatgaccngctcatggagatntgagttctgagcaagtcagactccttccttttggcctccaaagccacagatgttgcccggcccacctgtttaactctgtatttatttcccaataaagaagggcttccaaaggcatgctggagacttgtg

SEQ ID NO: 607 - DNA, 300 bp, Homo sapiens
atggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttatt

SEQ ID NO: 608 - DNA, 296 bp, Homo sapiens
  misc_feature (1)...(296): n = A,T,C or G
atccaggtgtttctgatgcacagtgaaattggggtaccactggtattaggttgggtatggcaactttttcatcacttgttttatgtagttgtctgatcaattgtgaaaacataatgaatgttggaaatggaacagtaaaataacgaaagccaacttttttttttttttttttnnnnnnnnnnnnnnnnnttnncccccngncngnanngcaggggcccaanntnggntnnntgnanccnccnccnccgggntnnncccctttntcnngcctaacccncccnagnacnnggaactac

SEQ ID NO: 609 - DNA, 300 bp, Homo sapiens
cgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctca

SEQ ID NO: 610 - DNA, 300 bp, Homo sapiens
agaataactaccagacaacatttgttaaaactcaggacagtatgtattttaaataagcaagtgcatgtgtgaaaatggctcattcagtttataaaatattacattaaatttgaggtttctgttttttttcttttgtgacagtcttgctctgttccccatgctgtattgcagtggctccagttcacctcactgtaacttccacatcctggtttcaagcaatttgtgcctcagcctcccaagtagctgggattacagtcatgccaccatgtccagataatttttatatttttttgtatagat

SEQ ID NO: 611 - DNA, 300 bp, Homo sapiens
agatgggttaaaacttaaatgtcacatctgaaacagtaaaaatcctagaagaaatcctaggaaaaactcttctggacattggcctaggcaaagaatttatgatgaagacctcaaaagcaaacataacaaaaccaaaaatagacaaatgagatttaattagaaaaacttctgcacagtaaaagtaataatcaacagttaatagacaacctatagaatgggagaaaatatatgtaaattatacatctgacaaagaactaatatccagaatctacaaagaactcaacaagaaaaaaaccaacc

SEQ ID NO: 612 - DNA, 300 bp, Homo sapiens
tcctggctgttaggatttgttcgtgtttgggagacctttagagcgtggttaaacccatatgttgggatttatgctgcttttatggtagcaataccctatattaagatttgaagtagacccggaaagttagtggccggttagctcagttggttagagcgtggtgctaataacgccaaggtcgcgggttcgaaccccgtacgggccagtgggtggcttttttttgtgtgtgttttgttttctgaccctctgctgttatccggaagtttctacccggagccagttgccttctggtaacagaat

SEQ ID NO: 613 - DNA, 300 bp, Homo sapiens
aaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttc

SEQ ID NO: 614 - DNA, 300 bp, Homo sapiens
agacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaat

SEQ ID NO: 615 - DNA, 300 bp, Homo sapiens
tgggacatgctcatgatggctgtcatgcacactgcgaaaagttgttggtttactggagcagggcaaggaacacctggccccgcccggagcaaaaaactgctcaaaccacaaacgatagcaggaaaggcctgtgccttggcagcatgtttttgctgcagataatcagccagagcctgtttctctgctcctcgctgagattgctttgtttcccataaagattgcttttagctaatctacaatctatagaagcaatgcttatcactggctttctgtcaataaatgtgtgggtcaagctctgtt

SEQ ID NO: 616 - DNA, 300 bp, Homo sapiens
  misc_feature (1)...(300): n = A,T,C or G
gctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccaatnggggccacttcgtggccgagc

SEQ ID NO: 617 - DNA, 300 bp, Homo sapiens
  misc_feature (1)...(300): n = A,T,C or G
ngnnattgagcccnttgaatcnagctacttgttctttttgcaggatcccatcgagtccatctcatatgagtgagaaagcttaccagtgcagcgaatgtgggaaagccttccgagggcactcggacgttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatc

SEQ ID NO: 618 - DNA, 300 bp, Homo sapiens
ccccaacctgcactctacccacccccatcacctactccagctcccaacttttgtggactgagcggccgcagagactgggtcgccttggattccctctgcctccgaggaccccaaaagacacccccaaccccaggccagccggccctgctctggcgcgtccaaaatactacctagcacaggcctctgctcgaggcacccccaaactacctatgtatccagccccagagggcctccattcccaggaagtccctatgtatcccaacactggcagacacccagcaccaccctcccagacccgca

SEQ ID NO: 619 - DNA, 300 bp, Homo sapiens
aattccgttgctgtcgaattgttcctgtcctgccccaactgatcaatcgaccttgtgacattcttcttctggacaatgaatcttatgatctccccaccatggaccctgtgaccccctcctctgctgacaatagataaccacctctaactgtaacattccactgcctacctcagtcctataaagctgcccctctcctatctaccttcgctgactctcttttcgtactcagcccacttgcacccaagtgaataaacagccctgttgctcacaaaaaaaaaaaaaaaaaaaaaaaaaaaaaaa

SEQ ID NO: 620 - DNA, 300 bp, Homo sapiens
agaatacaagctacttgttctttttgcaggatcccatcgattcgaattccgttgctgtcgaattgttcctgtcctgccccaactgatcaatcgaccttgtgacattcttcttctggacaatgaatcttatgatctccccaccatggaccctgtgaccccctcctctgctgacaatagataaccacctctaactgtaacattccactgcctacctcagtcctataaagctgcccctctcctatctaccttcgctgactctcttttcgtactcagcccacttgcacccaaggaataaacagc

SEQ ID NO: 621 - DNA, 300 bp, Homo sapiens
actatagaatacaagctacttgttctttttgcaggatcccatcgattcgaattccgttgctgtcgaattgttcctgtcctgccccaactgatcaatcgaccttgtgacattcttcttctggacaatgaatcttatgatctccccaccatggaccctgtgaccccctcctctgctgacaatagataaccacctctaactgtaacattccactgcctacctcagtcctataaagctgcccctctcctatctaccttcgctgactctcttttcgtactcagcccacttgcacccaagtgaata

SEQ ID NO: 622 - DNA, 300 bp, Homo sapiens
gtgggagggggtagggggaggaagtctgtggtgagcaaagtttgccttattacactgataaagtgtaattacactaataaagctggatcacctgaggttaggagtttgagagcagcctggccaacatggcaaaaccctgtctctactataaatacaaaaattagccaggtgtggtggcagggcacttgtgatcctatctactcgggaggctgaggcaggagaatcgcttgaacccaggctgtaaaggttgcagtgagccaagatcatgccactgcactccagtctgggtgtcagaatgag

SEQ ID NO: 623 - DNA, 300 bp, Homo sapiens
caatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaatta

SEQ ID NO: 624 - DNA, 261 bp, Homo sapiens
  misc_feature (1)...(261): n = A,T,C or G
gtgaaagagttcatgacctccttgcgccgggcctggtgctctgcgatcaagggctgcagaacctgtatgagtgccttcttgagctcaccggtgagcatggctccgctggtgtaatccttcctgatctgctcgagcttgtnnnnnacctggaggnntanggtatnnnncatnnttnanangcncgnatnatnctgnanctacncngtctgnnacggtattnangncnantnctatnatgnaannnannntnngngnctntnc

SEQ ID NO: 625 - DNA, 298 bp, Homo sapiens
  misc_feature (1)...(298): n = A,T,C or G
tttttttgagacggagtcttgttctgttgccaggctggagtgcggtggtgcaatctcagctcactgcaatctccacctcctgggttcaagaggttctcctgcctcagcctcctgagtagccggggagctacaagcatgcaccaccacacccagctaatttttttttttttnnnnnnnnnnnnnnnntgtcncccaggcttgagtgcaggggcncnatctnggntnantgnaanntntgtctccngggttnatgccnttctcctgnttnancntcccnantantcccaggantagctgg

SEQ ID NO: 626 - DNA, 300 bp, Homo sapiens
ggtaaggatttggggcacagtaccaggaggggggcttggtgccagacctcatgaggaagaaggattttcctatgtacagagaaggggaccctgtcctgttgggaggtgctgtgcaaacctaaccaagttactaacccctctgttttctgtgctacacaaaggggataaatacaagcttccctctctagccaattctatttggttcctgagtttggaaagtgatagatactgattttctatgattttatgaggacttaaataagctcctatggaaagtgttttgtgcagtgccgtgcccat

SEQ ID NO: 627 - DNA, 300 bp, Homo sapiens
gcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagcgccgtaattgacacatctcttatttgagaagtgtctgttgccctcattaggtttaattacaaaatttgatcacgatcatattgtagtctctcaaagtgctctagaaattgtcagtggtttac

SEQ ID NO: 628 - DNA, 300 bp, Homo sapiens
ggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcg

SEQ ID NO: 629 - DNA, 295 bp, Homo sapiens
  misc_feature (1)...(295): n = A,T,C or G
ggtggtntnagtggnanaaggatcgcagtggagacnngtgcnaatagggngatcctggtaaggtgctnatgtcatgctgcaatgtccancagcagnaggnntttgatgtnangngcnggagnngagtggaccaggggtgctgtgtnatnanttgattcagnggcttatggcatcactgccttctgttnccgggggagcatggatctagatgtcctcgcctctgaaaaccaagtgtcagagccccttccccttgtttttattttactgttataataattattaacttccttgtaat

SEQ ID NO: 630 - DNA, 300 bp, Homo sapiens
tggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcg

SEQ ID NO: 631 - DNA, 290 bp, Homo sapiens
  misc_feature (1)...(290): n = A,T,C or G
gcctagggccccctagcaccccactcgatcaccgagggtaccagtccctgtcagacagccccccgggggcccgagtcttcactgagtcagagaagaggccactcagcatccaagacagcttcgtggaggtatnnnnnnnnnnnnnnnggccnctggttcatgatntggntnntanatgcaanaggctgtggctnctnaagtcctaaggattnctcantgatcanngatccagggccgttcatgaaccactgggctggatttgactgttgantgtggnagnaaatgcccgt

SEQ ID NO: 632 - DNA, 300 bp, Homo sapiens
gtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtttgcagtcactcattgaaaaacattttcctgctccagacaggaaaaaactttatagtttactaggaatcgatttgacagctccaagt

SEQ ID NO: 633 - DNA, 300 bp, Homo sapiens
cacagtccttctggaagccagacccgaagccacagtagcagtgccagctcagcagagagtcaggacagcaggaagaagaagaagaagaaggaaaagaaaaaacacacagaaacatataaagcataagaagcataagaaacatgcaggcactgaagtggaattggaaagacgccatctacacgaccacaggaaccagaagaggacctacactcagattagagcgtgaggaagtgagttcttggagacgtgctgatgacaggaaagatgaccgggtggaagagcgggaccctcctcgtcgag

SEQ ID NO: 634 - DNA, 300 bp, Homo sapiens
cccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtg

SEQ ID NO: 635 - DNA, 300 bp, Homo sapiens
ccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttggtcctaaccttacagaaaaatcctt

SEQ ID NO: 636 - DNA, 300 bp, Homo sapiens
  misc_feature (1)...(300): n = A,T,C or G
gctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaatagggaatgaagctgtcagaaatccccttgactctgcattctgtttcagagctggtgcggctctgcttgcncagatctgatgt

SEQ ID NO: 637 - DNA, 300 bp, Homo sapiens
  misc_feature (1)...(300): n = A,T,C or G
ctttgcagctccccttccactgagagccacttccaccatttaataaaatcgtccacatccatcaactttcaaaccattcatgcaacctgattcttcctggatgctgaacaagaacctgggtaccaacagggcagggtgtaaaaggctgccaccctgactctccttgagtgggtnnnnnnnnnnctgtccnggatggcaactgctaaaagagcntgaattgtaacacatccctaaatgcgctgttgggctggagcccaaaagtgctcatcgaagccctggcacccgcttgcctgcgtgctc

SEQ ID NO: 638 - DNA, 300 bp, Homo sapiens
  misc_feature (1)...(300): n = A,T,C or G
aacctatctgcatggacctctgtggaccacagcgtacctgcccctttctgccctcctgctccagccccacttctgaaagtatcagctactgatccagccactggatattttatatcctcccttttccttaagcacagtgtcagaccaaattgcttgtttctnnnnnnngnactacannnatatgnatnctggtncgctgggcaagttcactgngcccatgctgaaagaggcctgccgggcttangggctgaagagtggtctgaanaancangaactgctggaanccctcaccaagcactt

SEQ ID NO: 639 - DNA, 300 bp, Homo sapiens
agttttcctgtgattagtgtttttggtgttgttttattttttttcttacaggaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatctattctct

SEQ ID NO: 640 - DNA, 299 bp, Homo sapiens
  misc_feature (1)...(299): n = A,T,C or G
gttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggacactgnnnnnnnnnnnnnnngcttccaaggaagaactgaagtggttag

SEQ ID NO: 641 - DNA, 300 bp, Homo sapiens
cagagacctgacagtggcaatgtatggccacgttactgaatctacatgttgcaagagaaaaactagcagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatggga

SEQ ID NO: 642 - DNA, 300 bp, Homo sapiens
gagagcttgggatgtggtaatgccagccacactcctgggagccgtggccagatctcggcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcaca

SEQ ID NO: 643 - DNA, 300 bp, Homo sapiens
gcctgccagaatggaagcatacagatctgggaccgaaatttgactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggc

SEQ ID NO: 644 - DNA, 300 bp, Homo sapiens
  misc_feature (1)...(300): n = A,T,C or G
ccggagagaagcagcaggagggcggcggcgccgtgcgctgcgacacacctgccaactgcacctatcttgacctgctgggcacctgggtcttccaggtgggctccagcgggtcccagcgcgatgttnnnnnnnnnnnnntggcaattaacaacatcttaaaactgactcagctcacccagtcttccatgtattcacttcctaatgcaccctctctggcagacctggaggacgatacacatgaagcctgtgatgatcagccagagaagcctcactttgactctcgcagtgtgatttttgagc

SEQ ID NO: 645 - DNA, 300 bp, Homo sapiens
actgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagg

SEQ ID NO: 646 - DNA, 300 bp, Homo sapiens
gcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggcca

SEQ ID NO: 647 - DNA, 278 bp, Homo sapiens
  misc_feature (1)...(278): n = A,T,C or G
ggtgactgccatcctggagccctacccctgcatccacttccctctggccacatatgcccctattatctctgctgaaaaagcctaccatgaacagctttctgtagcagagataaccattgctatgctttnnnnnnnnnnacctgatgntaananntgaacctcnntgcggttnttncannntttnnntntcnantcnnnnacgtcttgnttnntncttnntnntttctcgcannantttnnnatntcntnncctttgnttttncntcttcttnnntaat

SEQ ID NO: 648 - DNA, 150 bp, Homo sapiens
ccccggtcgtgtagcggtggtatactacggtcaatgctctgaaatctgtggagcaaaccacagtttcatgcccatcgtcctagaattaattcccctaaaaatctttgaaataagggcccgtatttaccctatagcaccccctctagaggg

SEQ ID NO: 649 - DNA, 277 bp, Homo sapiens
  misc_feature (1)...(277): n = A,T,C or G
gaagaangcctatncnnnctattagctananatagtcnntnnnaatanganaganangtnacnnanaangcnananngnnnnagagatagctcnacntaaagacngganaangatcttcgccttaatacttttttattttgttttattttgaatgatgagccttcgtgcccccccttcccccttttttgtcccccaacttgagatgtatgaaggcttttggtctccctgggagtgggcggaggcagccaggggttacctgccacaaacggggaccag

SEQ ID NO: 650 - DNA, 300 bp, Homo sapiens
gaggtagtgacacaggctgtgggagggggtagggggaggaagtctgtggtgagcaaagtttgccttattacactgataaagtgtaattacactaataaagctggatcacctgaggttaggagtttgagaacagcctggccaacatggcaaaaccctgtctctactataaatacaaaaattagccaggtgtagtggcagggcacttgtgatcctatctgctcgggaggctgaggcaggagaatcgcttgaacccaggctgtaaaggttgcggtgagccaagatcatgccactgcactccag

SEQ ID NO: 651 - DNA, 300 bp, Homo sapiens
ggcacagtaccaggaggggggcttggtgccagacctcatgaggaagaaggattttcctatgtacagagaaggggaccctgtcctgttgggaggtgctgtgcaaacctaaccaagttactaacccctctgttttctgtgctacacaaaggggataaatacaagcttccctcactagccaattctatttggttcctgagtttggaaagtgatagatactgattttctatgattttatgaggacttaaataagctcctatggaaagtgttttgtgcagtgccgtgcccataaagaagagctca

SEQ ID NO: 652 - DNA, 300 bp, Homo sapiens
acgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacggga

SEQ ID NO: 653 - DNA, 300 bp, Homo sapiens
tgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccg

SEQ ID NO: 654 - DNA, 294 bp, Homo sapiens
  misc_feature (1)...(294): n = A,T,C or G
ccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccgggganaggggcagctngggctggagaagcacagcc

SEQ ID NO: 655 - DNA, 300 bp, Homo sapiens
acagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactg

SEQ ID NO: 656 - DNA, 300 bp, Homo sapiens
tcaagtttgtttgaagacacgtgtgcctttgtacccattataagatggtcataagacccaagaactgataagctttggtttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttatttttt

SEQ ID NO: 657 - DNA, 300 bp, Homo sapiens
aaatgtttttgaatcaagtttgtttgaagacacgtgtgcctttgtacccattataagatggtcataagacccaagaactgataagctttggtttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaagcagatatgttcagaaac

SEQ ID NO: 658 - DNA, 300 bp, Homo sapiens
ctatgatcaggactgactaggtagttggcatggcccatagagaacaaggaaagatgggctggtggattggcccacctgggagccacatggggcaaggggagccctcaccctcagccagccagacgagtgggatttcccccagcacagcatacccccttcacaaagggacaactaaagtgcttcattaagcaagtcctggatcctgtgccccccaactgggtgagacaccccaatgggtcaccagacaccttatacaagagcatttctactggcatcaggtgggtgcccctcaaggacaga

SEQ ID NO: 659 - DNA, 300 bp, Homo sapiens
gttttggctgggcatgatggttagcgcctgcagttccagctacctgggagggtaagcccagttcaaggctgcaattaactatgatggtgcccctgcatttcagcctgggtgacaaaattaaatcctggcccaaaaaaaaaaagtagccaggcatggtggcgggagcctgttgtcccagctgttccgtaggctgaggcacgacattcacttgaacctgggaggtggaggttgctgtgagctgacaccacgccactgcactccagcctgggtgacagtgagactctgtctcaataaataaaa

SEQ ID NO: 660 - DNA, 280 bp, Homo sapiens
  misc_feature (1)...(280): n = A,T,C or G
attcgaacatatgcagttattccactaaatgatgaatgtgggattattgaatgggtgaacaacactgctggtttgagacctattctgaccaaactatataaagaaaagggagtggatatgacannaaaagaactttnccagtgctnctacctcngnctncngntttatctgaanagntggnagtntcncnngatangncctgntttgcatcntnntanngnnntnnannngccctttncntnntgnttgncggnnnngcnttgncnnnagtcanccgctg

SEQ ID NO: 661 - DNA, 294 bp, Homo sapiens
  misc_feature (1)...(294): n = A,T,C or G
aataggannnctaanaggctangtgagnaatatcaancnccgcnctgtttttnggtggttaangnngtatanngggcntnnatgggnaggaatncanatggtagttggganaggggaggatacaggtggatgggactggaggttgtataaggtgttcttggaaggaaggggcaggagttggaattagttggtccctactgtcccccatgaggttgtgaacccctcccccaacttttcatgtttcttaaaggcattttggttttttaaaatctgtacagcaagagcaactttttc

SEQ ID NO: 662 - DNA, 279 bp, Homo sapiens
  misc_feature (1)...(279): n = A,T,C or G
gaaaanggnangactgntttatgggggcnccaannnncngnnncanttncannnnggccccnanaatggccaatgctcgtttagggaaccgccattctgcctggggacgtcggagcaagcttgatttaggtgacactatagaatacaagctacttgttctttttgcaggatcccatcgattcgcaggaatcgatctcgtgaagcccgcaaggaccgaacacccccaccccgatttagacctgcaggtgctgccccacgtcccccaccaaagcccatgta

SEQ ID NO: 663 - DNA, 300 bp, Homo sapiens
gctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccct

SEQ ID NO: 664 - DNA, 300 bp, Homo sapiens
tcgtttagggaaccgccattctgcctggggacgtcggagcaagcttgatttaggtgacactatagaatacaagctacttgttctttttgcaggatcccatcgattcgaattcggcacgagcatggtaatcctgctcagtacgagaggaaccgcaggttcagacatttggtgtatgtgcttggctgaggagccaatggggcgaagctaccatctgtgggaggaaggaggcaggctgtggtgggactgggtagggtatagtatcactcctgagttccactgctctagaatctaaccagaaat

SEQ ID NO: 665 - DNA, 298 bp, Homo sapiens
  misc_feature (1)...(298): n = A,T,C or G
cccgaggagcggagcagaggcacccaggcagcctgcgcggagaaattggatcggcggggacggcctgcagctcccgcgcgcggggaaagggaagaagtcctcccctacaaagcaaattcacaaacttggaagaagcaatttacacaggatgtgcagatctcaatggaaggacacgggaaacgtgaaaaagcaaggaagtgggacgcctccaaaggnnnnnnntaattctccagcancagatccccatccaaaaganattcaagaantgtcatatagagaattgtggaaactgatttta

SEQ ID NO: 666 - DNA, 272 bp, Homo sapiens
  misc_feature (1)...(272): n = A,T,C or G
gacagccccaatccgggagcaggagggcctcctgccttggcatatagacccctgggcgcctccctgggatgcccaccaggcccagggatccacctaggtgggtttggctatcctggtgatggnnnnnnnnnnnnntnaacctntctttntntacnncnntacnnctcatntattntcctctanngntaantntgnnnnnntnnncttntnccaantagnnnntttngnnnncnntcnnntnaatntanattnntntnnntntttnnntnatt

SEQ ID NO: 667 - DNA, 300 bp, Homo sapiens
ggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtggaatctggtgaacagtaacaaactttggtgaaatttcaggaaccatagccattgaagtggatgagggaacctatatacatgcactcaacaatggtctttttaccctgggagctccacacaaagaagaatcg

SEQ ID NO: 668 - DNA, 300 bp, Homo sapiens
attaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaaga

SEQ ID NO: 669 - DNA, 300 bp, Homo sapiens
agaggaccctgcagttagggggtgttactttgtcgcccaggatggcctggacccccaggttcagggattctcccgccgctgcttcctgagtagctgggacctcaggcttccgcctcgtgcccgcatccctgctgtgtttaggcagcaggtggtgacctcactcctccctggcctgagctctccgtcccgcatcccaggcggaggccctagggaacactttgaagctgagcacggggtggaccctccctcctgagtgaatggagaatagaaagggagaggatttctgttctgttctgtggg

SEQ ID NO: 670 - DNA, 300 bp, Homo sapiens
acccgaggctcggtgtactaggtgcgaatgccgccttctgtggtgaccactgtcttctcatcctttgcacctataggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccat

SEQ ID NO: 671 - DNA, 300 bp, Homo sapiens
  misc_feature (1)...(300): n = A,T,C or G
ataatttggngcatttccnnacantgtcttnncaagantaaaatgtgngcgccaaaatttngnattntantnggaganttnttatccaaantaangctgccntaggaagtctaaggaattagtagngttcccatcncttgtttggagtgngctattctnaaagaataagcaatgctcgtttagggaaccgccattctgcctggggacgtcggagaaagcttgatttaggtgacactatagaatacaagctacttgttctttttgcaggatcccatcgattcgaattcggcacgagcagga

SEQ ID NO: 672 - DNA, 300 bp, Homo sapiens
ggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcga

SEQ ID NO: 673 - DNA, 285 bp, Homo sapiens
  misc_feature (1)...(285): n = A,T,C or G
gtgagacaggttagttttaccctactgatgatgtgttgttgccatggtaatcctgctcagtacgagaggaaccgcaggttcagacatttggtgtatgtgctacgtcgccctggacttcgagcaagagatggccacggctgcttccagctcctccctggagaagagctacgagctgcctgacggccaggtcatcaccattggcaatgagccggttacgctgccctgaggcnnnnnnnnngccttnnttactggcatgntgttctgttnntncngnngagtacattc

SEQ ID NO: 674 - DNA, 292 bp, Homo sapiens
gtcaatggtgtacaagcaatgctcgtttagggaaccgccattctgcctggggacgtcggagcaagcttgatttaggtgacactatagaatacaagctacttgttctttttgcaggatcccatcgattcgaattcggcacgagggggattcataattccagacaggtagagaacggttttatttatgtagagacagagtctcgctctgtcgccaggctgaggcgggagaatcacttgaacctgggaggtggaggttgcgctgagctgagatcattacactgcactccagcctg

SEQ ID NO: 675 - DNA, 271 bp, Homo sapiens
  misc_feature (1)...(271): n = A,T,C or G
canaccnattctcnnttggcaacnangatcganggggnacctagnnnannnnnnnnnnaatgacgcaaatgggcgttccattgacgtaaatgggcggtaggcgtgcctaatgggaggtctatataagcaatgctcgtttagggaaccgccattctgcctggggacgtcggagcaagcttgatttaggtgacactatagaatacaagcttactttgttctttttgcaggatcccatcgattcgaattccgcacatgaatctcccctcctcac

SEQ ID NO: 676 - DNA, 300 bp, Homo sapiens
aaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaaggtaactgatgttaagaataaaaa

SEQ ID NO: 677 - DNA, 289 bp, Homo sapiens
  misc_feature (1)...(289): n = A,T,C or G
gcgagccaggattcccgatccagagacaatggccccgatgggatggagcccgaaggcgtcatcgagagtaactggaatgagattgttgacagctttgatgacatgaacctctcggagtcccttnnnnnnnncttntangcctatggttttgangaactnttnngttttatttttntgttnantnttngtngnctgntntgntnntgtnggatngagangaanantttctttntgngccatgtgctgatggangnntnntnttntcnnatttntnnnttttnatgttttt

SEQ ID NO: 678 - DNA, 300 bp, Homo sapiens
ggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttg

SEQ ID NO: 679 - DNA, 300 bp, Homo sapiens
ttcaccaatgacatgatcttatagcgattctataaaaacagaataattaacaaattcagcaaagttgtcaaatacaaaatcaacacacagaaatcagttgcatttctatatagtactagcagtgaacacttcatgaaggaaattagcagtttcatttaaatagcatcacatagaataaaatacataggaattaaccaaggaggtgaaagacttgtacacagaaaactacaaaatattgttgaaagaaattaaagaagacataattaaatggaaagacatcctgtgttcaattatatccat

SEQ ID NO: 680 - DNA, 300 bp, Homo sapiens
tcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacaccc

SEQ ID NO: 681 - DNA, 300 bp, Homo sapiens
gggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatg

SEQ ID NO: 682 - DNA, 300 bp, Homo sapiens
gatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcctctggtattctgggttctgaagtctggtattctggtattctgggttcaaaagtatgacttgagagtgttgctctggtattctgagagttgctctgtattctgggttctgaagattatttgaaaaataactcctac

SEQ ID NO: 683 - DNA, 300 bp, Homo sapiens
ggtacaccaaagaagaaagctgttgtccaggctaagttgacaaccactggcccggtgacttctccagtgaaaggcgcctcatttgtcaccagtaccaatccccggaaattttctggcttttcagccaagcccagagtggatttgggcatagtaatcagcaaaagctacggaataattctaagaattagatgtttccatatcattaaaaccaaggatccatgaggggcagaagggaggattcaaagattttaaaaaaatcaaattttagaccttggttaaatattaactggaatgggatct

SEQ ID NO: 684 - DNA, 300 bp, Homo sapiens
agactccctttcccggtctgctcagtaacgggtgccttcccagacactggcgttaccgcttgaccaaggggccctcaagcggcccttatgcgggcatgacagaaggctcccctcttgccttctattcacttctcacaatgtcccttcagcacctgaccctatacctgccggttattcctaggttatattattaatgcaacagagtaatattaaaagctaatgattaataatgtttataataatgatggataattgttcatgatcatcgctgtatctaatttgtattatgactattcttat

SEQ ID NO: 685 - DNA, 300 bp, Homo sapiens
ggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctat

SEQ ID NO: 686 - DNA, 300 bp, Homo sapiens
gggccgctcagtttttacgtaaaatggcagatccacagtccatccaggaatcgcagaatctgtccatgttcctggccaatcataacaagatcacacagtctctgcagcagcagctcgaagtgatttctggctacgaagagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaa

SEQ ID NO: 687 - DNA, 300 bp, Homo sapiens
gtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccgtaaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgg

SEQ ID NO: 688 - DNA, 300 bp, Homo sapiens
  misc_feature (1)...(300): n = A,T,C or G
gagagagagagagagagagagagagagagagagagagagagagagagagagagagagagagagagagagagagagagagagagagagagagagagagagagagagagagagagagagagagagagagagagagagagagagagnnnnnnnnnnnnnnnnncncacnctcttntntcncgnnnnnnntctctctntgtntcnctctnngtgtnnganatntntctctcttatatntntntntnttttntctctcnanannctctctctctctntntgtgtctctntcacnnccctctctct

SEQ ID NO: 689 - DNA, 286 bp, Homo sapiens
  misc_feature (1)...(286): n = A,T,C or G
gtggtctctccccctgtacctagaaagctatttgagctggatccgtccctctgatcgtgacgccttccttgaagaatttcggacatctctgccaaagtcttgtgacctgtanctgccncgttttgaagagcttganctggttnccctntggnnnntcgntntgtntntctcntnntgtncnntcnanantnntnanttnnnatngntgnatnnntaangcntnatnnttnctnnatnntntnngagnctnttnnnnttttnnnntnatncttngtnatgntcatta

SEQ ID NO: 690 - DNA, 272 bp, Homo sapiens
  misc_feature (1)...(272): n = A,T,C or G
aaannnaanaagnnnnaagnaancnnttaagagangaangatngangnnagnntntnaatngnaaggntnnatnncnacanntgntantctcggatntaatgtannccnatgaagnaagaaaaccttggaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaag

SEQ ID NO: 691 - DNA, 300 bp, Homo sapiens
ggcacgaggcactaagcaggctagtgctctcagcttcccggcctccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccacc

SEQ ID NO: 692 - DNA, 300 bp, Homo sapiens
aaaatgccttcattttcctttttactttatcatgagacataagatttattggcttcatatcaacccttaagtattgttaactttatgtaatagcatttgggttggggattggtgtgttttcggttgtacatagcatagttgaattatgttaggcataattatgaccttattattgtctttatttgaaaattatatatgatctcaggaaatgtgtatgagttcaagttgacaaggagtggatttgggatggttgatactgagtgtcaacttgattggattgaagcatgcagagtaataatc

SEQ ID NO: 693 - DNA, 300 bp, Homo sapiens
  misc_feature (1)...(300): n = A,T,C or G
ggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgnnnnnnnnnnnnnntattcagcttatcctaaacctgaaagaagagtgagtagactttaaggatcaagataatctggggcttcccagttgtgtcggccaaggacctgagacctgaagggttgactttacccatttgactgggagtgttgagcatctgtc

SEQ ID NO: 694 - DNA, 300 bp, Homo sapiens
ccccggtgtccccgcgaggggcccggggcggggtccgccggccctgcgggccgccggtgaaataccactactctgatcgttttttcaattgaccgtggaggcccccatgcccaagctagccacgcagtccaacgagatcaccatcccagtcaccttcgagtcgcgggcccagcttgggggcccagaagctgcaaaatccgatgagactgccgccaagtaaaccccttagcccggatgcccacccctgctgccgccactggctgtgcctcccccgccacctgtgtgttcttttgatacatt

SEQ ID NO: 695 - DNA, 281 bp, Homo sapiens
  misc_feature (1)...(281): n = A,T,C or G
caggcgtactgacaggtggaccaacggactgatttagaagagaacaagcatgcgctccctacattccagccacatatcacaaacgactacggtctggacaactttgacacacagttnaccagngagcccgtgcanntgaccccanacgatnangatgccatatagaggatngaccagtcnnagttcgaaggntntgantatatccatccattattgctgancncnnanganncnntnntcatntacntntagtcnntnttttngctntctcccnnccactc

SEQ ID NO: 696 - DNA, 300 bp, Homo sapiens
tttcggccaactagaggagtctgaaggaccagacaattgctcagaaacagaaggctgtttagaattttctaaattcattaagggcaattctggtacttttctggaaattggctttaagagctcatcctgcatttttaaaatctctccaactggatcaaattttttatatactcgtttgataggtttttttaaaacacatgactcttcaggactacaagcagtattagtctggtttcctacagaagcctgtcctgaggaagaatttggactagctggtctggaacttaagttagaacccac

SEQ ID NO: 697 - DNA, 262 bp, Homo sapiens
  misc_feature (1)...(262): n = A,T,C or G
gtcagggctggactgtgagcctgtgcttgggtcctggaggaggtgagggaggtatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgnnnnnnnnnnnnnnnnnnnnannntnnnntanngnntnatg

SEQ ID NO: 698 - DNA, 295 bp, Homo sapiens
  misc_feature (1)...(295): n = A,T,C or G
gggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgannggaagaatgggtncctcacttgntattgaaanctctgaagaaga

SEQ ID NO: 699 - DNA, 300 bp, Homo sapiens
agaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtct

SEQ ID NO: 700 - DNA, 300 bp, Homo sapiens
aagtagaggaggaagttcagacaatttcataagtgtctaaaaagagacagttatgcgaccattgacgaggagtaaaagtcgtctattgagcatcttattcactacaaatagaagaaagaaataccagtttcctgacaagccccaccccatgcttggccagttcctgagtacacttaatatattttagaggaaaagatgctagaaccacaggagaatggcgtgattgacctaccagattatgagcatgtagaagatgaaacttttcctcctttcccacctccagcctctccagagagacaa

SEQ ID NO: 701 - DNA, 300 bp, Homo sapiens
gtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccacccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgccgtct

SEQ ID NO: 702 - DNA, 300 bp, Homo sapiens
ggcgtgcctaatgggaggtctatataagcaatgctcgtttagggaaccgccattctgcctggggacgtcggagcaagcttgatttaggtgacactatagaatacaagctacttgttctttttgcaggatcccatcgattcgaattcggcacgaggaaggaggacctaggcacacacatatggtggccacacccaggagggtagtggggagttagatttcagagtccaggccctaggttgggacccactccaaataatctcctcggtgtgggtggtggttctatagagggataaagaataa

SEQ ID NO: 703 - DNA, 300 bp, Homo sapiens
ccaaggcgcagcccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccattgatgtgcggaagctggacttccccagtgcttcttttgatgtggtgctcgaga

SEQ ID NO: 704 - DNA, 300 bp, Homo sapiens
gagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgca

SEQ ID NO: 705 - DNA, 300 bp, Homo sapiens
  misc_feature (1)...(300): n = A,T,C or G
agtccacattaaaaagaaaacaaaacaaaccctaactaacttccaaatgggtctcctggtgcgggggcgtgagtggccgtgccctgggtgtgctgcctgtctgagcaagcttccctagctgaggaaccccgggccccctgctgcgggctctgccttggtgtcatgcctgctgcacccccgtttacactgatgtgccannnnnnnnnntggnggtttggagcnnacatgctactggtcnannnacacangtnccggggcatcatgagaaaggntngntcttggnaccttgtcctccccagt

SEQ ID NO: 706 - DNA, 300 bp, Homo sapiens
ccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcagg

SEQ ID NO: 707 - DNA, 300 bp, Homo sapiens
tggaggtctcctttcgccccagcccaggtggccaagcccatcctggcctcagaacatgctgagcacattttgtagggtggcacctttttatccaagttactagctacacatcagtgtttaaagagaaaaaagtgacctttcatttttttttcttgaaacttgaggaaacaagatacatactactgattttttttttcttaaaactaaatgcatgactgcagagcggtagaggtgtatatttttcatactgtggggcaaagtatttgtgctgctttttggagatggactggaacgtctggt

SEQ ID NO: 708 - DNA, 300 bp, Homo sapiens
aaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgac

SEQ ID NO: 709 - DNA, 285 bp, Homo sapiens
  misc_feature (1)...(285): n = A,T,C or G
gagagagagagagagagagagagagagagagagagagagagagagagagagagagagagagagagagagagagagagagagagagagagagagagagagagagagagagagagagagagagagagagagagagagagagagagagagagagagagagagagannnnnnnnnggtcttctcntgcntgatgcctcttntcactgcctgganccctgntnnangccctcgnatctcccntgctnccgngcctttnnttngancctggtggtctcctctcccattgct

SEQ ID NO: 710 - DNA, 275 bp, Homo sapiens
  misc_feature (1)...(275): n = A,T,C or G
gagagagagagagagagagagagagagagagagagagagagagagagagagagagagagagagagagagagagagagagagagagagagagagagagagagagagagagagagagagagagagagagagagagagagagagagagagagagagagagagagagnnnnnnnnnngngngcnctcccgcgcgcnngnctnncncncntntnntctctctctctcgngcncccccnccncccccnncacacnnnnncagagngnnnctctctctntnt

SEQ ID NO: 711 - DNA, 266 bp, Homo sapiens
  misc_feature (1)...(266): n = A,T,C or G
ataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcatcgactgaaggactgcttttggcttctggatgccctnnnnnnnnnnnnntngtgtggngtgnnnnnntanctnnnnnnntttnngnncctnnnntgnnnttntnnnnnnct

SEQ ID NO: 712 - DNA, 300 bp, Homo sapiens
gtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccaggtaatggttgtgatgactcctacctgggaggacgccgtgattgggctgagctaccttgattgagtgagggggcaatctgcaatttgcagggaaatcctgagttcaggctgcactgcagagcgttccttgagccaccca

SEQ ID NO: 713 - DNA, 300 bp, Homo sapiens
tgtggagaagccttctttttctatgggaaatcacttctggagttggcaagaatggagaatggtgtgttgggaaacgccttggaaggtgtgcatgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttga

SEQ ID NO: 714 - DNA, 291 bp, Homo sapiens
gttttgctcgtttagggaaccgccattctgcctggggacgtcggagcaagcttgatttaggtgacactatagaatacaagctacttgttctttttgcaggatcccatcgattcgaattcggcacgaggttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctat

SEQ ID NO: 715 - DNA, 294 bp, Homo sapiens
  misc_feature (1)...(294): n = A,T,C or G
tcctccanggccgtggttgtgaaaaaggtcgaggcccctgatgggaagctggtgtctgagtcctctgacgtcctgccccagtgcacaagttcggcagcccctcccagccttcccctcctgcgctgccccagagcctgggaaggaggccgctttgcagggtagcactgggaacagggaacccccctgaggctccgccctagcccttagcccgcctggggagtttacttcctggggaccccccttgcccatgcctccagctacaacaccattccattgcttttttttttggtccag

SEQ ID NO: 716 - DNA, 289 bp, Homo sapiens
  misc_feature (1)...(289): n = A,T,C or G
ggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgctaatatatagagcacctggaagcagtaacatgcaaatgtcagcaagaatatncgntnaangganctgtnnatgctanttnananataatcnnagctgganagggagctttttaagcttaannnaatgtt

SEQ ID NO: 717 - DNA, 300 bp, Homo sapiens
cgacggcaaggtggtgctgtcccggcagtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgctt

SEQ ID NO: 718 - DNA, 300 bp, Homo sapiens
ggggggattccactcctgttttgtgagtaggcgacccatgggctgcccagccttaaagccagaacaagggtgtcccctgacctcgttccactgccctcctcccgttcccatctttcccccctaccttccccttaggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcaggg

SEQ ID NO: 719 - DNA, 300 bp, Homo sapiens
gtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgaca

SEQ ID NO: 720 - DNA, 300 bp, Homo sapiens
  misc_feature (1)...(300): n = A,T,C or G
gtggctatccatcaacataagtaaaaaaaaaaaacacttcaactccctcccccatttannnnnnnnnttaacatattttaaaaatcanatgagttntataaataatttaaanaagngagagtatttatttttggcatgtttggcccaccacacanactntgngtgtgtatgtgtgngtttatatgtgtatgtgngtgacanaaaaatntgtaaanaanaggcncatntatggntactgntcaaatncttaaagataanttnattttcacacagtccacaaggggtatatcttgtagtttt

SEQ ID NO: 721 - DNA, 300 bp, Homo sapiens
gtttgtgcatcacttggtcaccattgggcttatctccttctcctacatcaacaatatggttcgagtgggaactctgatcatgtgtctacatgatgtctcagatttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgct

SEQ ID NO: 722 - DNA, 300 bp, Homo sapiens
acaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcagccccagctaaggttgaagccaaggaagagtcggaggagtcggacgaggatatgggatttggtctctttgactaatcaccaaaaagcaaccaacttagccagttttatttgcaaaacaaggaaataaa

SEQ ID NO: 723 - DNA, 300 bp, Homo sapiens
gcaaggcgccgggggacacgttggctgcgttttcggcggactggccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctcccc

SEQ ID NO: 724 - DNA, 300 bp, Homo sapiens
agaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgactcaaagggg

SEQ ID NO: 725 - DNA, 300 bp, Homo sapiens
tgtagaggaggtgaggaaatactttaatgtgttggaaaccatgggtttgaacagaagatacgcatatggagtggggaatggaaagaaaactttgtgctacatttactgtaaattatatcttattgattcagtaaattcaggtggaatacggaagttcaaatttaaagattacccatggactcctgacctcaggtgatccacccgcctcagcctcccagtgggctgggattacaggtgtgagccaccatgcccagcctcatcattcttattaactggtttaatcctttcaataatcctatt

SEQ ID NO: 726 - DNA, 300 bp, Homo sapiens
tcggcacgagggcaagggacttcctgtaacaatgcatctcatatttggaatgacccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttg

SEQ ID NO: 727 - DNA, 300 bp, Homo sapiens
cgtccgctctcattggctctgctggtccagaaagcagcccaggcctttaactccgggctgctgtgtgtggcatgtggttcataccgacggggaaaggcgacctgtggtgatgtcgacgtgctcatcactcacccagatggctggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggac

SEQ ID NO: 728 - DNA, 300 bp, Homo sapiens
atagtcagaaaacaacctggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacaca

SEQ ID NO: 729 - DNA, 300 bp, Homo sapiens
gtccaggcttccttctgatggccaacccacctttaatgctggccagtctatctcacacaaagttctaagttttccaggtgtcatagtaactccatagtctcccttaaatccctttttgaaatttttcaacatagttcctagtgggatgggcttactttgtgcctgacccatgttttctcaagacaaaacaccatggcaggaacagccacttgcatctggtcccggtgccacactgcggtgcttggtgtggttgtggagcctgtccctgcgcgccttgctcccgttgagccacgctgtctg

SEQ ID NO: 730 - DNA, 300 bp, Homo sapiens
gataaatacctcagcccctcgccttcctcaacccacctggcaagtcttcttaggatctgatcccagttttctggaagcaatcctaccccagcccaagcttcccagagtcgagccttaatccttctcacttctcagtgtcagagcagaaatgaatcctggggttgactgtgtccattcgggttattagcagctaagaagcccagacgagtagtgtgagctgccttgggagcctcagtgagggcactgggactggcctcactctcttgcccccagcctagtgggctttctcctctgtctctc

SEQ ID NO: 731 - DNA, 300 bp, Homo sapiens
gtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcagcaaggtgacatatttgtttttgacctggagacc

SEQ ID NO: 732 - DNA, 300 bp, Homo sapiens
cactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaa

SEQ ID NO: 733 - DNA, 300 bp, Homo sapiens
  misc_feature (1)...(300): n = A,T,C or G
ggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcancaagctggag

SEQ ID NO: 734 - DNA, 300 bp, Homo sapiens
ggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggag

SEQ ID NO: 735 - DNA, 300 bp, Homo sapiens
ggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgatgagcgggtccacgaggagctctgaggggcagggagcctggccaggcctgagacacagaggccca

SEQ ID NO: 736 - DNA, 300 bp, Homo sapiens
  misc_feature (1)...(300): n = A,T,C or G
ttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccgnnnnnnnnntgacccctgccttcacacccccctcctgccgctatgccgtttaactggcgactccggtattgagctctgcccttgtcctgcct

SEQ ID NO: 737 - DNA, 300 bp, Homo sapiens
agaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtgggg

SEQ ID NO: 738 - DNA, 300 bp, Homo sapiens
gaatgacattcatgccagttcttccctgaatggcagaagcactgaagaagtaaggcccattgatgaaaacttggggcaaactggaaaatctgctgtttgcattcaccaagatataaatgatgatcatgttgaatatgttacaggaattcagcatttgacaagcgattcagacagtgaagtttattgtgattctatggaacaatttggacaagaagagtctttagacagctttacgtccaacaatggaccatttcagtattacttgggtggtcattccagtcaacccatggaaaattctgg

SEQ ID NO: 739 - DNA, 300 bp, Homo sapiens
cgggactggtaccaccgcatcgaccccaccgtgctgctgggcgcgctgcgcgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggc

SEQ ID NO: 740 - DNA, 300 bp, Homo sapiens
gtacgagagtctgttgaacaacaggctgatagtttcaaagcaacacgttttaaccttgaaactgaatggaagaataaactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatat

SEQ ID NO: 741 - DNA, 300 bp, Homo sapiens
cagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaa

SEQ ID NO: 742 - DNA, 300 bp, Homo sapiens
ggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccac

SEQ ID NO: 743 - DNA, 300 bp, Homo sapiens
ggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctc

SEQ ID NO: 744 - DNA, 300 bp, Homo sapiens
agaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgaca

SEQ ID NO: 745 - DNA, 300 bp, Homo sapiens
attcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgt

SEQ ID NO: 746 - DNA, 300 bp, Homo sapiens
  misc_feature (1)...(300): n = A,T,C or G
ganancncagatcncnttgaaatgcctctcttttaataaacgtttcctttgttcactattgcctgctagttcatcttgtaaatccttggctttaagctccaacttagtcctctgcttaatctgctcttgtctttcagcactaagctgttctttttcttctttcatagctgaaatttttgttttcaattctctaacttggcgttcgatatcctccattttatctcttgcatcctgctgagcatctcttaattgtctggatttttctccactagtctctcgcttagcagaaagctcatcaag

SEQ ID NO: 747 - DNA, 300 bp, Homo sapiens
ccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctg

SEQ ID NO: 748 - DNA, 300 bp, Homo sapiens
attctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaacca

SEQ ID NO: 749 - DNA, 300 bp, Homo sapiens
tttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttat

SEQ ID NO: 750 - DNA, 300 bp, Homo sapiens
gacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgatgctgacatgggaactgcagattctttgcgctacatatatccaaaacttaagacagatgtgctggtgctgagctgtgatctgataacagacgttgccttacatga

SEQ ID NO: 751 - DNA, 300 bp, Homo sapiens
gttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccag

SEQ ID NO: 752 - DNA, 300 bp, Homo sapiens
aaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggacca

SEQ ID NO: 753 - DNA, 300 bp, Homo sapiens
gacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaattta

SEQ ID NO: 754 - DNA, 300 bp, Homo sapiens
cagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaa

SEQ ID NO: 755 - DNA, 300 bp, Homo sapiens
cagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcc

SEQ ID NO: 756 - DNA, 191 bp, Homo sapiens
  misc_feature (1)...(191): n = A,T,C or G
cccagctccttgggaggctgaggcgggagaattgcttgaacccggggacggaggttgcagtgagccgagatcgcactgctgtacccagcctgggccacagtgcaagactccatctcaaaaaaaaaaaannaaaaaaaaanccctgttaannncannggtntaagngaatngttnangnctttaaannaggt

SEQ ID NO: 757 - DNA, 179 bp, Homo sapiens
  misc_feature (1)...(179): n = A,T,C or G
caaataagttaaatgtatatggcattggattggaattggaggtatcagtgtgaactcatggttttgggttttttgttttttgccttttttgttttgtttttgttttttgaggcagggtgtcactctgttgcccaggctggagtgcattagncaccatnacagntnagcacannctatgc

SEQ ID NO: 758 - DNA, 300 bp, Homo sapiens
  misc_feature (1)...(300): n = A,T,C or G
caacagtcccaaccagtcgaattagacccatttggtgctgctccatttccttctaaacagtagatacttctgatggattctcggcattaactcctgtttcataaaagtgtgaacagttttatgaatttgaaagaaaatttggtagctctttatagcattcattcttaaagatcagtcctaataggtgatntntaaatnnnccanntanaagaatgaagcntctctacngggtagtaacttgatncctcttnagganaanagggngctaaatngcaagctctnactaatggttctgctact

SEQ ID NO: 759 - DNA, 62 bp, Homo sapiens
ggggtatcagttactggatctaagcatgtccactctacacgctttttttttttttttttttt

SEQ ID NO: 760 - DNA, 300 bp, Homo sapiens
cacaaggtcaggagttggagaccagcctggccaacgtggtgaaaccccgtctctactaaaaatacaaaaattagccgggcgtggtggcacatgcctgcagtcccagctactgagaaggctgaggcaggagaatcgtttgaatctgggaggtggaggctgcagtgagccaagattgcgccactacacttcagcctgggcaacagagtgagactctgtctaaaaaaaaacactaagcatgtagtttctatataactagaagcataggatattctgatctgcaatccatcaatcagtgccaat

SEQ ID NO: 761 - DNA, 300 bp, Homo sapiens
tttgaatatggactatagttagataatagtcttaggtaatagttaaatgtcctgggtttgattattgtggttatatgggggaatgtccttgtactcagaagacatatgctgaagtacagtatttagagataaaagtgtcatgtttgcaactaactttcaaatagttcagaaaaaaaaatatgtatatatgtgtctgtgcctgtatatgaaagagagaacacaaatgtggcaaaatattaacaattggtgggccaggtatggtgggtggctcatgcctgtaatcccagccctctgggaggc

SEQ ID NO: 762 - DNA, 284 bp, Homo sapiens
  misc_feature (1)...(284): n = A,T,C or G
cctttaaaaggcagctgcaaatgacccatttttgtgataaaactaactcagagtacaggtgcaaccccactgatgtaaacagcttttgaggctttgaggttttagatgacagtcatctaaaacaccagcttctcaaatacatcagcttcaggcctgggctgagcctgaggagcctcctaggaagttagagatttttgagctcaaagggctcaggagaggcccaatagttttcatgcttcattaacccgaaggcttcccgacaatcgnccaagggttnctaaaag

SEQ ID NO: 763 - DNA, 289 bp, Homo sapiens
caaagatactggatactagaaggcagtggaggaaggtcttccaagtgaggatgaaacattttaaacctaggatccattaaatccgaaggctaaagaaagtcaccacacatcaggactaaaatgttgacttcccataaacactattttattttatttttattttattattttattttattgtatttttcttagactgagtcttgctctgttgccaggctcaagttgcagtgagccaagatcacgccactgcattccagcctgggcgacagagcaagattccatcttaaaa

SEQ ID NO: 764 - DNA, 295 bp, Homo sapiens
  misc_feature (1)...(295): n = A,T,C or G
ccagcctggccaacatggcaaaacactgtgtacactacaaatagaaaaattggccgggcatcatggtgtgtgcccgtagtcccacctactcaggaggctgaggcaggagaatcgcttgagcctggagggcggaggttgcagtgagacgataccgtaccactgcactccagcctgggcaacagcaagactccgtctccaaaaaaaaaaatttaaaangatttttnttatggnggtttcanaaatggttgtgnggcaggctggntgnantggcacangcctgnantnccagcacttt

SEQ ID NO: 765 - DNA, 297 bp, Homo sapiens
  misc_feature (1)...(297): n = A,T,C or G
cagtgaatnngtaagttcaatctgtngcnnatngaggtaaaatatttatagnataaanctgngcagcttanccanttttgaatatgcaattcagtggattaagtacattntcantgttgtanagccatcgccatcatccatctccagaagttgtgcatcttaccaaattctgtgcccagtgaacaataactccccacctccccttcccctagcaacagccaccccttttgtctctatcatcaacttcactactcatatttctcatgtaagtggaatcatacagtatttgtccttttg

SEQ ID NO: 766 - DNA, 300 bp, Homo sapiens
ctctcatggagctccagagtgacatccagcattgttagcatgcgatcaacatcatagaccatcagtgtgcaacacgagttaccaagaggggctttcttagtggaaagagagtgataaattggtaacatggaagctacttcctgtgttctttttctgagaactagaagaaggaatacaagttggccccatgctaatgtgtatataccttttttacataccaatcactagtgtgtttagaaattaggaaaggtcagtaagtctccagtatatataaacatctatagtgtatggaaaggtctt

SEQ ID NO: 767 - DNA, 290 bp, Homo sapiens
  misc_feature (1)...(290): n = A,T,C or G
cgagtttttttttttttttttttaatanatncggcantttnatttcaatcgcccaancnaanttancnngnngnaancttaaangaaccaanttnaaccnaaanagttccggnaaaaatancaaaaancngaaanttntaaaagggaagnccccctaaaancnngaaaattcaccnttcnttagggttncntnttcantttngatngncnctngaggctngcaanttttnaancaanctttnaaatcnngangnctnttntgaaaanatttcanccccancnctaaaatt

SEQ ID NO: 768 - DNA, 300 bp, Homo sapiens
agggacaaggctataaatatcattaataccaggttcaggagtttgcactgcactaaaaatcaactcagctatttgagcaccttttatagagtggaaatggggttgggcagtagagaagagcacttttagagaggcttttctgcagtagtcaggggttacacctgttaaccagccataattttttttttaagcggctgtgctgaggatgagccccatgtagttggtgcaggtggggacacactgcctgtgtaactagaaaaactaggcatggccgggcacggtggctcacacctgtaatcc

SEQ ID NO: 769 - DNA, 300 bp, Homo sapiens
ctgcaatttctccaaagcttgccactttccagcctgtttccccaattcctctgtgctctcctagagctctgtctgaatcctcgcagccacacctaggtctgagaactcaggctttgagttactgatcttccttggattaggagaacaggtgttcctcctcccctctcctagcagccctaatgtctgacctagcctatcaagccttaggcgctggaagaacccttctcagacacgcaggacccaggtaaagtcaaagctttgcccttttgcccactgtctgctaccagggctcacccactg

SEQ ID NO: 770 - DNA, 300 bp, Homo sapiens
aggggccttacattactttcttgcagcactgatggcttttgtttgaggctgcacaaattcctgcatttcccttgggttgaatggtagggatgcgggcagttggtgactgggtgaaccacctgacttgagcagggctacgactctctctgcaaacgaaacccagagacatgaacagtgctgagatttctcagtggtttcccatgtaggctgctttccaagggcagcaagcatggcttcatcactcacccagtgcttctgattcagcactgtgatgctcggttaagttttaatgaggtttta

SEQ ID NO: 771 - DNA, 300 bp, Homo sapiens
caagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggc

SEQ ID NO: 772 - DNA, 300 bp, Homo sapiens
gagtatttgctggtgcattggagagtttcacgtaattcttgtgcagattcagcaagagagtttgccggcatgctttgcacagcccctggtacccagtaaggcgattattagcattggtgcttgctggaatcagatattccagaatattctgtcacagctcatcgttgccctcttcttttctgtgggtaaactgaggcagaaactcaggctgggtggaactctgcagcctcagctggagacctcgtctggccaaggactgtggggacacaggccctctaggctgccacctcatggtcccag

SEQ ID NO: 773 - DNA, 300 bp, Homo sapiens
cccacctcggcttcccaaagtactgggattacagacgtgagccaccgcacctggcctaaatttcaccatcgtttctattcataacttacctgcaaagtgattatctgactagtactactgcaacaaagataataaagtgcctgatgtttatatcaaataggatatggcatgtttctgagtgtttctaaagaaaaatactgaatgaacccctcgcctaacctagtgcctgtggtaacaataactgacatgcattgagcgcttactgtgtgccaggtgcttgttcgaggtactttaccggta

SEQ ID NO: 774 - DNA, 300 bp, Homo sapiens
ccaggcttgaagttatctctaatttagaggttagggacagtgacacaggaaagaggctctgagctttatatctggagatgtgggatcataaaaacgtctttttaatctgatgatcattaaaacacccggagatgaggcacagctgctaatcggaatacatttccatttctgcggggattgagcatgtcttcggaaccctctgcaatagctttagaaacaaacgttccttttatcaggtgagaaaactaccctatggcatgcctccggatatgtagttcttcctaggctacaaaatatcag

SEQ ID NO: 775 - DNA, 300 bp, Homo sapiens
ttttcagccacctccactgactcctacctccaaagtttatactatcagaccttattttcctaaggatgaggttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtac

SEQ ID NO: 776 - DNA, 288 bp, Homo sapiens
gttttctcctgttacatcatgctgaatcctttcccttagccattagcttttattatgtggtcttcataggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagg

SEQ ID NO: 777 - DNA, 300 bp, Homo sapiens
tgaaactttgtaatttggaccccctaattttgtacatgttgatgataggaataagggcttcgtttattttcactgcatgctctctatggaaagaggatgtgctaagcaaacaagcattgtaaacaatatttcagaggcaaggttttggcctgctttaaaaaaataaaatgtttgcaagtacaattaaaaaccagtataagggacaggggtgggatgaaaacctgtctctaagattacgaagcctgcgttatttcccctaaatccccttcgaggaagatttgaatccctcatcaacaaatt

SEQ ID NO: 778 - DNA, 300 bp, Homo sapiens
  misc_feature (1)...(300): n = A,T,C or G
gcctctgtcctgaactttttaacccggtgccacaacccgagggtctccataggggcaggtaaacggggattttaatcattttaagtgtcttagaatgatattttgggaaaaagcactccttttcctaaggactgcgactcggtgaacagaaaggaggctatgcggtgtggccagccaactcaaggaggacgaagcagcctttgcctctaaactgcctggaaccanangcgtattnttctganccntcnnaggnagtgctgagtactgatgcagtctgtagggantaactnccttcccctg

SEQ ID NO: 779 - DNA, 300 bp, Homo sapiens
gttaagagcactgaagcgggggtcagaggcctggctttgtctataactcaccgagtggcactgggcttccctctgccttcacgtttcatctctgacctgaggggcctggctagatggctcttctggctttgacacatttctactggggcccaggctcaagtctcggtggccctgggtggtcactggagactgttcctgtggaggccacttcaaggctgccccggaggtcgcccaacctgcttctacagcaccctggggtcgccccttccctaacgaggagctcccaagatgtagttttgt

SEQ ID NO: 780 - DNA, 294 bp, Homo sapiens
  misc_feature (1)...(294): n = A,T,C or G
ctagagtgcaatgttgcagtgcaatgctgcaatctgggctcactgcgacctccacctcctgaggcaggagaatggcgtgaaaccaggaggaggagcttgcagtgagccgagatcgtgccactgcactccagcctgggtgacagagcgagactccgtctcaaaaaaaaaaaatntaattatcaaatgcntcccattgngatagtcctacnttatgngacattaacctatattcctgggtccttttaattcccaactactgctnttanaggtcttanccttttatgttaattttta

SEQ ID NO: 781 - DNA, 300 bp, Homo sapiens
agtttaaaaatacttctttgtaaaagttattgcacaaagaaaagacatgaatgtgtccctgttatgtactcacaaggataatgatggggttgttgctcattaatactgtttcttgtgcaataacttttacaaagaagtatttttaaactgatcattaattttatgaccacagaaatgagatgcaaaatttatgctattgtcagtggcacaggctcacagcaccactgacattttgtgtgattgtaatagaatggctgccaactaatgattctgtagacatttcatttgagtgtgcttttc

SEQ ID NO: 782 - DNA, 300 bp, Homo sapiens
atggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgt

SEQ ID NO: 783 - DNA, 300 bp, Homo sapiens
gctgtgttgcccagactggtcttcacctcctgggctcaagtgatcctcctccctcagcctccccaagtgctgggattatagatgtgagcccctgcaccagacaattatatttatttttaaaaacgcccctcatgaagtctgggtaattctctccagatttctccttatcaacaaatttataagagttaggaaaaaaatgatgtaaataaagcacttaaattgcgacagtggttctattcttaacatcataatgcttatgactaaggagcattcttttttttataaattaaatgtattctg

SEQ ID NO: 784 - DNA, 300 bp, Homo sapiens
cccaggtgtctatccacttgctagaaaccatcatgagagttagataccagttttctgctggaaatacagaacatttcctgaaaccgtgtggttgaggtgaaacaggcattttgcagtcttatattttgagtaaggccaaacctgcctagtgttataaaactagacaaaaaacccaggtacccggtcttgcaggatagaaatgtgtgactaaaatgaagcatcgatctgagaagactacaaattagcgggaacctttggacaggagcatgctatacattacttagattaatgttgatattt

SEQ ID NO: 785 - DNA, 300 bp, Homo sapiens
  misc_feature (1)...(300): n = A,T,C or G
agacaatcccaaatatttggagattgtcttaactggtttagtgtagctataaaagaatacatgaagctggataatttatgaagaaaagaggtttatttggctcacagttctataggctatacgagatgcatcatgccaccattttcctggagcccttcaggaagcttccactcatggcagaaggtgaagggcagccagcatgttcagtgatcacgtggtgagagggaaggcaagagagagaagagggaggggtcaggctctatttaacaaccagcttttgtnccgtnncatgaggtgaga

SEQ ID NO: 786 - DNA, 300 bp, Homo sapiens
cctatctgtctactggttggtcttttacactacaggtgcacagcaggagaagatgggttgacctcgtgagtgctgaatagcacgaggaaataaacaggggaaggaagtttgggtgaatagccaaaaggagtgtatttttccagtgatactctcatatcaccttttctaaccttcacagcatagatgtggacataggattggtgcctccatattgagagttgaagcatctgtggcaaaatactgtgtcatgcttggtgctaccacttgaaacagtgctggaacttagattgccctcgtgct

SEQ ID NO: 787 - DNA, 300 bp, Homo sapiens
gggttctttaacctgtgcttcctctgtcctacttcccatcctgcacagttcatagagtcactttctgactatcctatagacacagtaattggacctgtgtttttttctaatctttatatgacagcacatttcctaattcagggaccatcccctatcccaaattccatcctgtgagatgtgaaacctgtgagttcatgtgaatgagtggttgaagggcttgacgccatgtagtctcttaggaaggcttcagggtgctcttatgttgttgctttgccattatcaaatggcattgattgatcc

SEQ ID NO: 788 - DNA, 300 bp, Homo sapiens
gccaagctcagtttttcgccttgaatatgaagatgctagaaagagctctgcatttaagcagagccttgtgcaattcccggaccaaatgctgaaactgcaagagtgccctttaaaagaccttcttaggcatgtgacttgttctctaccagaacctttgggcaacatgaaggaagtcaaaggcatttactggcttgctgttgctgcctgcacagcacctgaccctcaaccagcgtgtttgctcctgcttcagtcaactttatatgctttggtcctgtcagataatctcggctcaatgagcat

SEQ ID NO: 789 - DNA, 300 bp, Homo sapiens
agtcattacaagttaggatcctgggtaaatggcaacctccacctcccaggttcaagcagttctcctgcctcagtcccccacatagctgggactacaggggcacaccagctaatttttgtattttcagtagagttggggttttaccatgttgaccaagctggtctcaaactcctggcctcaagtgatccgcccaccttgacctctcaaagtgctgggattacaggcatgagccatcacgcccggccagctgttggttcttaatgacacagcttaactttattgtgaaaagattgcagcaac

SEQ ID NO: 790 - DNA, 300 bp, Homo sapiens
ctcattttattttgcatatattaaattgagtaggttcagctctaacataccttaggaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacagtctgacttgctttcagtattcacaagttctttccagtttccaagtcttttcctagcagtaatttaggggagacagag

SEQ ID NO: 791 - DNA, 300 bp, Homo sapiens
atgcctgccagctgagaggcagttggaagaccaacaagctgagcaggcatttcagcagattcagcagtcagagtgcaccaagaagggtgctttagtttggagtttcaaaaggccatactgtaatagtgaaccagaaatcaagcagccctcagaaagactgaaacgcatctacggatcatctcaatctgattgcataaaggtggttcaagatttattagtgctttttactcgcctctccaatttttcatatataatgtccagcaccacatcaaaaataacccagcatagatggagataaga

SEQ ID NO: 792 - DNA, 300 bp, Homo sapiens
attttcatcccgaggcattgtctaatgatgtcccactgcgaaggataaagatgtagttttctttgactctgccacctcccactactcagctcactcatacttcctgccatctttcatcttcccaataagtatatcattttcattacattagtatcagactttacattattatgaccatgtaaatgctatttctaactgagccatgtagtatactctgattacttttcctttcttgcacaactttttcttttctatggattgctacttattttttattggttatttgctaagctttctgga

SEQ ID NO: 793 - DNA, 300 bp, Homo sapiens
ctcatgaggacatcagttctattgggtcagggtcccacccttatgacttcatttaaccttaattacctctttaaaggacctatctccaaatagtcacattgtgggttagggcttcaacatatgaataatggagggatacagttcggtccataacatacactaactgtctttgtatactaatcctcattttgacagattgtcatttaagaaaaaattattcttaagtagaatcattgacttggacccaattggaagcattgttgtcacctctcttttggtgcttcctttttacctttggat

SEQ ID NO: 794 - DNA, 300 bp, Homo sapiens
caaagatggtcgtattactaaaggtgaataaccagcgcggggggcacgtggagtcactggaacatttgtgcaatgctggtgggaatgtcaacccgtgcggccctctggaataagcctggcagctcctccaagagttaccgtgtgacccagcaattccactcctagctccacccacaggaattgaaagcaaagacgcaaacagatgcctgtgcaccaaagttcacggcagcatccttcgccatagtggcagcatccgtcgtcacagcggcatcatccttcatcatagcggcagcatccgtc

SEQ ID NO: 795 - DNA, 300 bp, Homo sapiens
ctgccatgactgtcatcttcttcatcgttagtcagtttatggaccccttgaattctatccaaggacacccaagaggaccccaagtttggagcctctagagccctgttgttggctctgccactggggagtgttagcgttgctagctctgctgaggttgaaatgaacgtggaaaaaataaactgatacacatatatgtctttgtaagttctgttcaccacatctgctttgacctacaacactgctgtgtttatatcaggttgtttataaaaccttggaaacttcgctttccactccatttgc

SEQ ID NO: 796 - DNA, 300 bp, Homo sapiens
aggaagcattcacatatcctagaatagatgacttggctatcaaccccttgccggctgtagctccccatttgttgtagtctgtatgtgctatacccaacctagagcagggcgccatgcctggctaattttttttttttactttttacagagatggggtctcactatgttgcccaggctggtcttgaactcctggcttcaagtgatactcctgcctgagcctcccaaagtgctgggattatagacatgagcaattgtacttggctcaaatttttgttttaattgggctttttgtcagaagaa

SEQ ID NO: 797 - DNA, 300 bp, Homo sapiens
ctgcaaaatggactgtgattcaggacctcctccttacctacgagcaccctgggagggactgactaatggcccagggacacacagtcatcctctgcaggcaacagtcaggcttctacttgctgaagccgtcaagggcttgactgtcacactcagtgttctggaaaacaaatcagtaaagcaatttagaggatcttttgcaaatcagagaaaaagaatcaatacaaggcgaaagaattctgatcagcactttaaaacgtgcttatcagaaacttttcttctctcttttaagctttggttcta

SEQ ID NO: 798 - DNA, 300 bp, Homo sapiens
gagccacctgaatatttgccacttagcatgtctgatatctatccttgtttcttgtcacaagtatcatccacattacagaccccgttgtacaaaactgaaattctgactgtaacgccatcatgggatagttctgacctgcttgctagttgatatgtgaaagcctgaattttgcttcaaaaaagccattcaggattaacagtgtattgtgtaataaagtggactttgtgtgaaagttggagatcccttgtagataattcagaactactggaagtttcacagtacacttgtaaatgatgaaag

SEQ ID NO: 799 - DNA, 300 bp, Homo sapiens
gataatcagaaccagactttaaaatgtcctgcacgtgtaccctgcttcttttcagcttccctgccatgtatatccgaggctttgggcctaggggccttatcagtgtgaaattagtccccagtgcaaagcagccagtctcccaagagaccttggcagagctgggagttctgtgtgctttgccttttgaagactcattcagctctgccatgtctcctctacactgttttgtacaaccttactgcacacttaacactcgcatggggatgcagcagtgccccggcataaggattggaggactgt

SEQ ID NO: 800 - DNA, 300 bp, Homo sapiens
ctggatgaagactaagcatttaaatactaagttgagggcatagtagctggcatgtgcctataatcccagtgttttgggaggcctaggcgggaggatgccttgagcccaggagattgaagctgcagtgaattatgagccaatgcactccagcctgggtgagagtgagaccctatctcaaaacagcaacaacaacaagatacaaattgagaaactgttacttgatttgcgatatgtattctgtccagcagtgatagaataacaaggactgggtttaccttgctattttaagcaacaatatat

SEQ ID NO: 801 - DNA, 300 bp, Homo sapiens
acctcttcttcattgttaaaatggaaataataatactacctagctcgtgggattgttgtgagacaacaacaaatgagacaacagagatctgaaactctgcctggcccctggtatataccaagtccacagttaaattagcctttgttactaaatcattgtttgggtagaaatcctcagattttggatttctcaagtgctccttttctactgtccaaaaggcagaatgttatttttgctcgattccattatgtaatatcctatgaatttgaaatttcggaggaggcacagcatggggctgtg

SEQ ID NO: 802 - DNA, 300 bp, Homo sapiens
gtgtggaaacaactttgcatttgtaaacagtttcccctgcgtgcgaagagcctagaaactactctctctcttgagatctgatgtccccagtcccctcattgttgaatgtgaatagaataggaaccaccgttttgcactgttcatggctatgttgagttatgtgggggagaagggcatatggtagtaaactgaattctcctgtctgcctacagctgcatttctcacttgtttctcttctctttagtgctgtgtacatacctctgtcagcactaataacgtgtaattattttatctatttac

SEQ ID NO: 803 - DNA, 300 bp, Homo sapiens
gctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtggg

SEQ ID NO: 804 - DNA, 300 bp, Homo sapiens
cagagaggcagggataccagatatggggaaatctgtaattacatgcaggcattaaatatttaaatatatattttcttcttttaattgtggtaaaacacatataacataaaatttatcgtcttaaccatttttaagtgtactgttttgtagtgctgagtgtattacattattatacaaccaatttccagcaccttttcatcttgcaaaactaaaactctttacctattaaacaactactccctgtttctccctcctcccagtccatgagaagcaccattttactatcttttctgtgagttt

SEQ ID NO: 805 - DNA, 290 bp, Homo sapiens
atgaggtatgaagccatttaatacgaagaagagctaaaagaatgagaacgtgattgcatgaaatgtttagccagaaatcttgggatataggagaagagggggagacttgattgattaggttgtaaatatttgtcctatggaccacggtaacgtggattagcattcagagtagtaaccagtagtgggagttggagtcatagagtattgggtctctttatcccaggagatttccaatggggtcagtttctactgaccttttagagagaccatgctatgctgtcttttttttt

SEQ ID NO: 806 - DNA, 300 bp, Homo sapiens
ctctagcatgtgccataaattacagtgacctttaaaatctcgcttggtcactgctgaatgggtgagaataggcttggttccagtttttaaggtcacactgtcctaatttgcaatgcatcacaccatgtactaagttggtaacaaccgcttagaggaaagctttcgttatgcaagggagaacatcaaaaagggcacttatcccaaatgaatgcagcaatttaaaccaaagatgtttacgcagggcaagaacaaagtaaggcaggagtttggggtcaactaggctgatgtctttgaacaccc

SEQ ID NO: 807 - DNA, 300 bp, Homo sapiens
atcgagaccatcctggctaacacggtgaaaccccatctctactaaaaatacaaaaaattagctgggcatagtggcaggtgcctgtagtcccagctactcgggaggctgaggcaggagaatggcgtgaacccgggaggcggagcttgcagtgagctgaaattgcaacactgcactccagcctgggcgacagagtgagactccgtctcaaaataaaaaaataaaatgggaatatcaatagggcctatttagtagggtggaagtatagctctaatgagatggtccatactggtcccccagcac

SEQ ID NO: 808 - DNA, 300 bp, Homo sapiens
aaatattttcattggttatacaactgctgtgtcttttctgagaaactcagccccaatgtgtaacaccctggattccacggggcagcaaattccacacactgcacccatgttgtgagcggagattttcgggctgaccaaaacttgaggcgaactgagtctccatcttaacactcaaacacacttcatggcggcctggaaacaaggcaatcattatgaagcttcagcccagttcttctgaaaccaacgtattgggcctgcttcattgtctctctaggggctaatcacaaacatgtgggaagg

SEQ ID NO: 809 - DNA, 300 bp, Homo sapiens
gtggtggctcacgcctgtaatcccaaagtgcatggattacaggtgtgagtgagccaccgcggccggcctctatcattttctgactcagcagctccaccaaaattgacatcctagcaaacactgtgaaggaattaacctaagtgcttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgt

SEQ ID NO: 810 - DNA, 300 bp, Homo sapiens
ttatgacctatctttgttaattttcctccttttccaggcctgattcctctttttggatagaggaatatttttgaattctggttttgaaatatgagggaaggccaagtctcttaggaaagttttacataaacatctacttagcatagccgaatagttcctgactacaccagaaaagaagtttgagcttccagtctttttaattgtagacaggaaggtaggcaggagagcaataggaaggctcgacaggaaagcagtttcctagtcggtagcaaagggaaggtttaggtccagtttgtgcag

SEQ ID NO: 811 - DNA, 300 bp, Homo sapiens
cagctatagcactaggcagccttgcatcctgggtgttgaaagtgcaggccattatcctcccctctgacctccaagatgttaggtggcctttctgtgcctcagttttatcatctgtaaattgggtatgattgtactagtgcctagtacataaggagtgctgcaaagattacatgagtgtctttaaagtccttacaacagtatctcacacatagtaagcatggcatgtggtagttactatcattagtccctcttggagcaatgtatattaaaattttaaagacagctgtctggtcaggattg

SEQ ID NO: 812 - DNA, 300 bp, Homo sapiens
  misc_feature (1)...(300): n = A,T,C or G
ggcacagtcagggagttagttagtggtagactcagcaggagttggttgctattcagatgtgttggggaaagtgacaggcatagctgactcggggtcattcactaagccaggagcccaggaagacacacagatgcaagcagagatcgtgccattacactccagcctgggctacagagtgagactctgtgtcaaaaaaaaaannaannaaangggccttgngtggtaccaggtanaaaattgaatntcngttgncatnagnnacctgtnctgtatgatcncttcccattccccagntgacgg

SEQ ID NO: 813 - DNA, 300 bp, Homo sapiens
ccctccttgcccagagcaggcattgctcatccactaggcacttcttcctgccaaggcacctcttcctgccaagtcagtgtctcacgatccctttcaacacagccacgaggaagccatgatacatcaactggcactggcaaataaaatcaaacctatttgcctatccagtcttatcccactttgttgttttctctaagtagttggaaaacaacatgtccagagaaaaataccagaacttattctgagtatgttcttcagagcaaacctttagaatcttaatgatgtttagacactcaggaa

SEQ ID NO: 814 - DNA, 162 bp, Homo sapiens
  misc_feature (1)...(162): n = A,T,C or G
ctcggagccaccccggaagaccatgcgcagaggggtgctgatgaccctgctgcagcagtcggtacatgaccctgcccctgtggatcgctaagcctggtgactagctannacctatntggggctcntctttgtttnnganactacataggacgatcgtggata

SEQ ID NO: 815 - DNA, 300 bp, Homo sapiens
ggcaacaagaccaaaactctgtctcaaacaaacaaacaaacaaacaaaaaacaatcacattcaaagcttagccaggagaaaaggcgctaggagataccccactgggatccttgaagaatcataacctaaaaatagatgtgaacctgaagtagacaagcgatacaaaatctcagtgagctcagtctgggattggtttagcttgatcactcccattcagctgcctaccagaggactgggcgaacgatcactgaagaaagatgggagtctctacctttctcataagttgtttcaatgaaaaat

SEQ ID NO: 816 - DNA, 300 bp, Homo sapiens
ttgacggcgcgggctctggactcgctgcttggtaaaaaccttcctcttcctccagtgcgggacgcactctctggtatctcttttgacctcccggaggctttcctttgtcggtcgcggcgccactgtactatggcatacctcgttttattacgcttcgcagatagggcattctgaaaacaaatggagggtttgtggcagccctgagtccagcaattgtatcagcgccatttttccaacagcatgtgctcacttggtgtctctgtgttacattttggtaattctcaaaatatttaaaacttt

SEQ ID NO: 817 - DNA, 300 bp, Homo sapiens
cagagcttagacatccaaaactaatcaatgctgaggtggctaaatacctagccttttacatgtaaacctgtctgcaaaattagcttttttaaaaaaaaaaaaaattgggggggttaatttatcattcaaaaatcttgcattttcaaaaattcagtgcaagcgccaggcgatttgtgtctaaggatacgattttgaaccatatgggcagtgtacaaaatatgaaacaactgtttccacacttgcacctgatcaaaagcagtgcttctccatttgttttgcaaaaaaatgtttttcatttcc

SEQ ID NO: 818 - DNA, 300 bp, Homo sapiens
gagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgcaaggtcatcgtcatcggcatgggaagggcattaattaccaaagtggagacacagtcactgtctccaagagcatttggaatcacttcacagagttctcaaggaggggaaggctatctgtcagctcctggcgggactgctgccccat

SEQ ID NO: 819 - DNA, 300 bp, Homo sapiens
agtgtgatctgcagggagagaaccaattacagtatgcttggagagggtgacatttattctgctgaacctcttctctgcttcacataacgttggccacttcacctttcctgagatgtctctgaggatgggcatattttaaagacttgagcttacatcatcgcatcttgaaagaaccgagtataattgagttgctgatacaagtgggtacttgcaccaggtccgggtcacccacatctctatggaaacacatgtttgctttaaagcccagcaatcagaagcagatccttataggagccagca

SEQ ID NO: 820 - DNA, 300 bp, Homo sapiens
attaaagttgaagcctttctaatttttgaaggttgagcactttggttattcatggttttatatgacgatcatcttttatccatcgctgcagttttctattttgacttgaattggaggcagagctccaccaccccagtgtgtcgtctgatttcccagactagagtccagcctttcctgtgcttgcctggcttccctccatgttgcttcctaccccaccatctatacccttcacatccaaaatccaaaacctcacactcatacgagaatccctgttagggtcggtttatatttacacactaa

SEQ ID NO: 821 - DNA, 272 bp, Homo sapiens
  misc_feature (1)...(272): n = A,T,C or G
cctcattatccaccacgcacagatggtacagctggggctgaacaaccacatgtggaaccagagagggtcccaggcgcccgaggacaagacgcatgaatgcagaatgaccgcgtgtncttgnctgatcacctggggatnacccctgnacccntgtnttgntcaggacntcttatagntnctnnngttntctttttntnantgttgtnntgatnntttnttnntttnntgnngcttnaaggtntnatgtntntngtggtnattttanntgattt

SEQ ID NO: 822 - DNA, 300 bp, Homo sapiens
cagatacagcctagtgtccctcagttacacaatagtgtgtcccccagtggtaggacagtctactactgagtcctcctggcatgagtcgagctgagattaggatagggtaatgacccttcagttttggggaagggaccagagctcggccagtgagaagcttccagctccgtctggccatatccaggctgctgagggtcctgggctctgtccttaaacctcatcactgacatgacccagcaaacctcctcaagaggaaaaagtccccttgggtcaaacacagcttgtgcagttctcggggac

SEQ ID NO: 823 - DNA, 300 bp, Homo sapiens
ctttgccattgtggctgtgcgagctcagcctcctggaaacccgccctgagcttggttaacagcattcactccaggtttagcccagctccaggttatcgcaggcaggactcccgagaacaggttcatgtttgctttttgggaggtgctgcgctaaagtggaaaaccaccctgggccgagtgggacctccccagctgggcggctgttaaccagccaggatgtctgaccctgagaagtcaccgtgcactcttgggactcattcttctcatcagcaggatggggtgatggagcgggccttactg

SEQ ID NO: 824 - DNA, 300 bp, Homo sapiens
ggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataag

SEQ ID NO: 825 - DNA, 269 bp, Homo sapiens
  misc_feature (1)...(269): n = A,T,C or G
gaacaagctcagcctcatcaacttcaggtgagtgttgggctagaggtagactaggccttgaggtcacagcctgctctccacacagtgagctccagactcgagattttctctcattccattttggttctcagggaaagagtgaggcaggcagcactcccctgactcacactggcttctgcatagggtgctctggggaagcttggccttatgccataaggcatctgggcagggccactgnagctgnctgatgtagcctgcctatttagnat

SEQ ID NO: 826 - DNA, 300 bp, Homo sapiens
cacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactat

SEQ ID NO: 827 - DNA, 179 bp, Homo sapiens
  misc_feature (1)...(179): n = A,T,C or G
gagctgctcagagctgccttgaaggacggccactcaggcgtgcccctgtgctgtgccaccctgcagtggctccttgctgagaatgctgctgtggacgtcgtgagggcccgagcactatcttccatccagggagtggnccctgatggcgccaacgttcacctcatngtncganaggatgg

SEQ ID NO: 828 - DNA, 300 bp, Homo sapiens
gcttgaagtctccttggaatctttccttgtggtgcacatgttcttttgattttattccacctttgattgtcccatagcaaaacaaagaacccacttaatggaagaacttgacattctcccatgtttgtttcaaagccacataggcatgtgtctacgagatgctgctttgataatgagttggttatactcctgcatcctactcaattgcataaacattctctaattcctaatggaaaggctgaagaaccttaagcctactcacttggacctgctgttgatgagtgcctgggatgctgagtt

SEQ ID NO: 829 - DNA, 300 bp, Homo sapiens
ggtaagtaacctgtgcagagcacagaactaggattcagacctacagacccacaagtcagcctctaaggcccacttataactgctcttctgcttgcaaggccctatggatgaaatccagttataacctccttttgctataactagacacagagggaggcgtttctccctaatctgtatttatccagacaagctgtccagcaagatttctgagtgaggggctttaaggaagcaatctgcgggtgtgtagccttttctccctcagcaaatacagaaggagcttatagcccgggctcaccctgc

SEQ ID NO: 830 - DNA, 296 bp, Homo sapiens
  misc_feature (1)...(296): n = A,T,C or G
ctggtcannggnggctgnnccctncccnggccnaccggccngccncatgggtttgccttncccgggcncnccnngggntncngggntgggngctnnaccntncccccctcagggntatntttncctntncccttncctncccgncnananntttnccnggggngggcnaaaaaaaaagtnaaaagaaaagaaaaaaaaaaaagaaacaaaccacctctacatattatggaaagaaaatatttttgtcgattcttattcttttataattatgcgggaagaagtagacacattaaacg

SEQ ID NO: 831 - DNA, 300 bp, Homo sapiens
gtgggctctcccttaaagacacatggccacagacacctccttcggatatgtaatatgccttcccctgcggccttccgtggtcacagcaacagggactgctcaccccctccagctggggcttttctaacaagcacagtcagaaatgcgcaggcctggggttggggatgaacagaagttgattagtgggcacagaaatacagttagatagaaggaatagttccagcattcgatattacagtagggagactgcatttaacaataattgattgtatatttgaaaacagctagaagaataagaat

SEQ ID NO: 832 - DNA, 300 bp, Homo sapiens
ggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgt

SEQ ID NO: 833 - DNA, 300 bp, Homo sapiens; identical to SEQ ID NO: 59

SEQ ID NO: 834 - DNA, 300 bp, Homo sapiens
cagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgt

SEQ ID NO: 835 - DNA, 300 bp, Homo sapiens
agaccatttaactctaccccacactttcagtggtgggatgtgaggaagaaagcccatgccaagctaactgaaagcttatttggctccaattcggctgatgttccctcactgcagaatgtcctggaaaccaagggtttgcagctcctaaacctattgcattaggcacacccaagaagaaatcctgttcgatgcacatgctccagtttcaatcagcaacaaggtcaaaagtttccccccactttctgttccacagtgcgttccccttgcagccagacattaggcacagattcatccctattg

SEQ ID NO: 836 - DNA, 300 bp, Homo sapiens
ctcaccaattagcactgccaccgcaggtctgtgaattgcatgtgaaaatagaatttgtccagaagtgctcatgcaaattgtgcaacacaaatgtggcctccatgtcaagtcctttcacgtgttctgacagactcatgtctttccagatttctctgatcggcgccccccacccccttgacagttaccagagctcataagccaaaggaaatagttcctgttgccatgagtactgtgtctgtggtgaggtttatgagctgctcttagggctgggtttttgcctgagaaaacaatcagatttcg

SEQ ID NO: 837 - DNA, 300 bp, Homo sapiens
  misc_feature (1)...(300): n = A,T,C or G
ccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaattttttttttttttttnggnacanagtctnnttnngtcantgcantccanccngggnaacaaatcganantcccntttnaaaaaaaaaa

SEQ ID NO: 838 - DNA, 300 bp, Homo sapiens
ctaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatga

SEQ ID NO: 839 - DNA, 270 bp, Homo sapiens
  misc_feature (1)...(270): n = A,T,C or G
atnncnntcgnnaannatncnagaaattnnnaagtnttnancanananaanaaatnancncgcnangnnaaaannnnngnnnnncgaccccaccagctctgtataggcctcaaaggggctgggagtgggctgcccctcgggtaggtgagcttggcaacgtgtcttcaggttggagagagtggataggcaaatgccataaagcacatttccagttcctgtgaaactcctctctccgcaaaaagtggagaacaatttgaggactgaaataag

SEQ ID NO: 840 - DNA, 300 bp, Homo sapiens
gccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccagg

SEQ ID NO: 841 - DNA, 277 bp, Homo sapiens
  misc_feature (1)...(277): n = A,T,C or G
gttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggaggatgagggaggtttcnttncctttcctgcnntggnctnctanaaagntcanagnacccantgnaagananctttaangnncagcatttagtg

SEQ ID NO: 842 - DNA, 300 bp, Homo sapiens
  misc_feature (1)...(300): n = A,T,C or G
gagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgcaaggtcatcgtcatcggcatgggaagggcattaattaccaaagtggagacacaggcactgtctccaanagcattncnaatccttcacagagtncncaaggngggggaagcctatcnnncagctccncgcgggaccggctgcccca

SEQ ID NO: 843 - DNA, 300 bp, Homo sapiens
cgaggccagttccaggcccactttttgccctgtgagccccctgcatttctggtttctccttttccaggcagctactcggtggagcttctctatttaacatctagttgtgtattcatgtcttttgttgtttctttcagtgatgttgcttatttccccaatgacactgttgggagcttcttaagaacaggctgtctagggacaaggatgtgaagtggtacaagggaaaagtaggccgtttaggacctgtgggtgtgtcatgactgtgcttgtatctcttgttagctttgtggccttaggttc

SEQ ID NO: 844 - DNA, 300 bp, Homo sapiens
actgaatgggctgtatctggggaatcaaggtattagggttgagcaaaagcaagaggaagtagagcatttgatctcttttcctttgattaggttgaggacaataaagtctcattctctcccttcttcccatgggcagccttatatatgattgaagaacattagtgcaaagattcctcatccagaaataaactcttgtacttctatactaattaaagattcatgtaaattactaagttcttggaaaactatggagaactctgtgggggctgtcattcacactttagtatgaattggtttaat

SEQ ID NO: 845 - DNA, 291 bp, Homo sapiens
actgagtctgggggcactgagtcagagccagctccgcctgcccaccatgactgggtggctcttatacacatgtactcttcccatctccaggtcccagatgtcgaggcctgtccactctccttttcccctaggcagggatggaggggcgtgtcagtcctgtataatttggagtgactggaggggtgggggtattgatgcatggtattccagtaaacttctctgcttgtgtcctaaaaaaaaaaaaaaaaaaaaaaaaaaaaaaaaaaaaaaaaaaaaaaaaaaaaaaaaaaa

SEQ ID NO: 846 - DNA, 300 bp, Homo sapiens
attgaaaaagagagttcatgtaaagccgattattatttaatctaaagttatgttcacataggaagcactagtgtagagaaatagggtctgagggacaaggagcctgtgtgcccgtgtcggcagccgagtaactgccaagggtcccctgcttggcactctgctgtcccacttgcttcctgccctctctggattctaacacttgtgccattgtgcatccgtctcaggtcatggtgctgttacttggtgagaaagcattatttaaataccccagatgaggagttaggcactttctccagtttt

SEQ ID NO: 847 - DNA, 300 bp, Homo sapiens
cacctaacattaggtggcacttaatagtgatgataatcacttatggagtctactaagatgtttgtgaatcccttctcccattcaaaaatcttgacaaccctgtgagacagatatgctcaccttactgatgagtacgggggcttggcaaagtaggtatgttgttcatattacacagctagtaagtggaagagtcaatatcatatactcccagattcagaactttaaataaccccatgctaccttctagggaaagcttctgctatgtgtttggagggttaggtgagagaaaggtgaatttta

SEQ ID NO: 848 - DNA, 181 bp, Homo sapiens
  misc_feature (1)...(181): n = A,T,C or G
ccggagcagagagcgcaggagccgcggtaccccggcttcgtgctggggctggatgtgggcagttntgngatccgctgncacntctatgaccgggcggcgcgggtctgcngctncagcgtgcannatggncanaatanttnnccttatctttnntgnctngaanntnnntctgnngtnctnt

SEQ ID NO: 849 - DNA, 300 bp, Homo sapiens
ctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaa

SEQ ID NO: 850 - DNA, 300 bp, Homo sapiens
cagagatgagtcagaacagtctcctcaatcctgaaattcaacaaggcatcagaagggctggctgtggtcaagcccagctgctgtcatgtgaggagatgctcactgtggtcttgttgagctgatggccttggttgagctgatggacaagtgaaggaggccatggggctgtgctgtccttcctgccgtacgtgccattccactctcttcagctctcccctcaacagcatgcgagcccataccttctgcatttttccaggcctgtgagggatataggcctccccttggagcactgagtccgga

SEQ ID NO: 851 - DNA, 300 bp, Homo sapiens
acggtgtctggtggagaagagctgagcttccctggccccttctgaaatggggtcaggaaggggatcaggagggggattaccctgatgcctgctgcctgctcccatttgatccacccacacagcctctcgaggtaggggcttggcaccccgttgtccagctgtgtgtggcctttctgaatgacgtggttcttgggcatctgagccagtcgccagccatgtgccctgccccacaggccctgggagttcctggtaggatcccacagctgttggcaagtctgaggtttgcctttgcagatggaa

SEQ ID NO: 852 - DNA, 300 bp, Homo sapiens
gcctccctggaggattctggatgattctgggagcaggtcctggactctacgtgcttcagtgggaatctggacacgtttcttatcctttgggcctcagtttcctcatctgtagaatgggaatgacaacagtacctacctcatggggttaaggctcaggccagttaacaccctaaggagcgatgccttggatgtcgtaaatgctagaaaagcatgagttgttatgaataggtcctggtgccccccaccttccttccacaaaccaagacaaccaaggagccacacctgccacctggctttgct

SEQ ID NO: 853 - DNA, 300 bp, Homo sapiens
acaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaa

SEQ ID NO: 854 - DNA, 300 bp, Homo sapiens
aatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaa

SEQ ID NO: 855 - DNA, 300 bp, Homo sapiens
cttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccggagagagtgccagggtgccctggtctgagctggcatccccatgtcttctgtgtccgagggcagcatg

SEQ ID NO: 856 - DNA, 300 bp, Homo sapiens
ctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcaggtgagtcaccatgaacacaacaggacttgagggccagctgactaggacaagacatgtatccttgctgccccggggcctccatgccgagactccatgccctgactccaacaggagcatcaccaaactacacctgg

SEQ ID NO: 857 - DNA, 300 bp, Homo sapiens
ggagggcaggagagtgaccaagcagctagaagagagggtgcagcaccccaaggagaggactgggggagtgggtgttccaggaagggctctggcatgtaaagctgcacagaagtcaaatcagataaagcctgagagggatccatgggatttcttggcaaagggattgttggtgataccaggaagagcagcttcagtggctcatggggagagaagccagattacaggagatcagcaactgagagagtgagtggagagcatcttttaagaatgtcttgagtgcgggccggctgcggtggctca

SEQ ID NO: 858 - DNA, 300 bp, Homo sapiens
ggagtggggagagggcccacacatattggaaatgcagtgtctgtctcctcccctgaacttctggaaggatcaaatctgatacacacaggcaggtgtgttcaaagtgtcctgggggtgctgatggaagaaagtgggagtgtctgccatgggctgggtcagttaacacccggggtcggcaggctgatgggtcaggagagactgagtctacctcccctttgggagggatcagaaaaatcagagaaggggagctgaaggctccacagcagggggctgtggactcaggctgaaggacctctgagt

SEQ ID NO: 859 - DNA, 300 bp, Homo sapiens
cacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactc

SEQ ID NO: 860 - DNA, 300 bp, Homo sapiens
tttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgc

SEQ ID NO: 861 - DNA, 300 bp, Homo sapiens
ctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatgagctgacagtgcagatctcccaggagacgactgcagatgccatcgcccggaagctgaggccttatggagctccagggtacccagc

SEQ ID NO: 862 - DNA, 300 bp, Homo sapiens
ataacctcggctgtttacagtgaggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtctta

SEQ ID NO: 863 - DNA, 300 bp, Homo sapiens
ctccaacctgcaggtgcctcctccagagccagctctgatactcattttaaaaaccatcccagccaaccaaccgtaggagaacctcgaaggcatcttggaggtccctgtctctgccaggcactccctccctgtcttctcagcaccctgctggcatcacaaggaaatgtgggccaaagaccctcatcccacactaagaatggtccaacagaaaccagcctggtcccaggtggggctcaggctcaggccacgtgccaccaagtcatctatgtgaatatagtgataaaaatgcccaacgttgac

SEQ ID NO: 864 - DNA, 300 bp, Homo sapiens
ataacgcccgtggtgccccatccctataggagctggtgagattgcagcctgctgcctcccctccatcagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacc

SEQ ID NO: 865 - DNA, 300 bp, Homo sapiens
actccatctcaaaaaaaaagaaagaaaatgaaaaatggttgagaaagttaagtaacgtcctgaggctggaggggccccgctcctcctcaccttggggagaaggacagcgtgaggctagcctgccctacactgggtggccccttcccctggcctgaagttgcagcacctgcaggctaaaccagcacatgcatgagggctgctgggccggggctttgggagcagccgatgctcctaaaaccctgctctgggtggactcttgggatgcagtttgggtctgtgtctggggctggcagacaagcc

SEQ ID NO: 866 - DNA, 300 bp, Homo sapiens
ctatggcataaatgaggaacaatgccagagacccatccagggcgacggtcagaatttccacagacacaatggttggatcaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcaga

SEQ ID NO: 867 - DNA, 300 bp, Homo sapiens
gggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagc

SEQ ID NO: 868 - DNA, 300 bp, Homo sapiens
cggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacat

SEQ ID NO: 869 - DNA, 300 bp, Homo sapiens
agtgagtggtcttaccaaaaatccagtatccttgccatccttgccaaatcccactaaaccaaacaggcgttccttctgtgcccagtcctagtattcaaaggaaccctactgccagtgctgcaccattgggaacaacacttgctgtgcaggctgttccaacagcacactctattgtacaagccacaaggacttctttacccacagagggcccatcaggactctatagtccatcaactaatcgaggtcctatacagatgaaaattccaatttctgcatttagtacttcgtctgctgcagaac

SEQ ID NO: 870 - DNA, 300 bp, Homo sapiens
gccaggagggcctccaggggttccttgtggaggctcacccagacaatgcctgcagccccattgccccaccacccccagccccggtcaatgggtcagtctttattgcgctgcttcgaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccaac

SEQ ID NO: 871 - DNA, 292 bp, Homo sapiens
  misc_feature (1)...(292): n = A,T,C or G
gcctgatccgccagcagcgcttgctccgtctctgtgaggggacgctcttccgcatgatcagcagccggcggcgccaggataagctgtggttctgctgcctganccccanccanaagctnntncagtncgganacntggaggagggcnccagcccttctaccctgnagagtttntccnagcancttnnctgtggccgacttgaggnntccttntgncnngnttangattgctnccatnttngggagnatgncttttnntagctttttnnggtnctttntnatttnnncttttt

SEQ ID NO: 872 - DNA, 300 bp, Homo sapiens
gtcattcccatacaatgcaacatccggaatgaggaggaggagaataatttggtcaaatctaccttagatacttttggtaagatcaatttcttggagaacaatggaggaggccagtttctttcccctgctgaacacatcagttctaagggatggcacgctgagcttgagaccaacctgacgggtaccttctacatgtgcaaagcagtttacagctcctggatgaaagagcatggaggatctatcgtcaatatcattgtccctactaaagctggatttccattagctgtgcattctggagct

SEQ ID NO: 873 - DNA, 300 bp, Homo sapiens
cccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcagagctgcctgcaagcc

SEQ ID NO: 874 - DNA, 300 bp, Homo sapiens
atttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgggagaaagcaagacaacaggagaaatgaaggcatctccaggagtggaccagagagcagccaagccatagagaagcatcaggtgtgagaatggaaaacgcagaagagacgtacaacttctgaaagatctcaga

SEQ ID NO: 875 - DNA, 300 bp, Homo sapiens
cttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccat

SEQ ID NO: 876 - DNA, 300 bp, Homo sapiens
cttagttccacaaataattattgatttgtttaagcgtgatgtatgtgcttgctcaaggaattagaagatgagtatgacaaagctcattccctcagggagttgagtgtttcagagggatgaagtaaaagaagattttaaaactacaagtagagtgtaagaagtatcacgagaaacatcaacaaagggctgaggatagaaggtgataagtctcaagtatctcaagatattcagcagtgaatcttaacataaatttgcttttaggggaagaatttcaagcatattgataggtcttaaattttc

SEQ ID NO: 877 - DNA, 300 bp, Homo sapiens
gcttcccgcttctgtcccccttggttccttaatgtggctgagcatagccaagtactcagctctgtctcgggatcctcaggaattccatcagcctcgtggggttcctttttccctgctcctggaggcaaattatatgcagcaaaacgtagaactagtcttgtggattttctttggtggaggagcatacaccaatggttccatgtaaaggctccagaatcagaactggcgtcacaccttggtgtcaccccttcctgctgagcctgtctccccaggagtgaaatgagggtaatattcctccta

SEQ ID NO: 878 - DNA, 300 bp, Homo sapiens
gagaggtttgtcactgggtgcaaggctaagatgctcagttaaagcaggaaattacgttgtttggctgagaaatacgtgtaatttctaagtgtgattattgcaagtaaaaatgagtgatgtttcaacaagagggttattgtaattcagggtatagcaacaattttaatgtaagcgagaagatgtttgtaacacttccaaaaaaatagtactgtatcagtccagtgtccactttcctccaaaccttcgtgcccacgcacacacacataaatacatgcaggattcctgagcagggaaggatcc

SEQ ID NO: 879 - DNA, 300 bp, Homo sapiens
cctagttggccatcagactttcagcaacttttatcatccagatagtcaccaaatgaaataaaatagaaaaatcccttgagcaatgaaacaattgtgaatgaacacaaagtccatgaatttaatccttatccgtttgctgagccaagcatgtgcatctgcagtgggtggcccaggctggcagcacagataccaccatttcccttttctttgctcagggcatggcctgtttatctcgttgcaccagatgagggttggaaaggatgatggtggtggttgtttcagatctactgacagcaatga

SEQ ID NO: 880 - DNA, 300 bp, Homo sapiens
ctgacacaaaattcaggtactcatgattataacctgattacagttctacagcaggttaatgaagtttaaataattagaatctattgtcgtaaactattaaaactggttctggtcacttcctttgaggtgagtaatagtgagagtgctattctttcttacctcctgggagcctgaggcacgatgcagagaagaacctcacatatcatgcatcatcagaggactagagtgaactcaggaaatatttgctcttgtcacattttcttcaccggagctagagactttttactaggaaaaactgcg

SEQ ID NO: 881 - DNA, 300 bp, Homo sapiens
aatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactg

SEQ ID NO: 882 - DNA, 300 bp, Homo sapiens
tctagactctgtcctcagaagaggtcctgggggcttcctatattgagaggaagatcattcgcacaactctgccaggaaactgccagataggagtcagggatcaggcctagaacgcagactgcagaaaggagcagatgtaaaagcagaaatttaaaacttgcttttccctgtcctcagactcttgagggtggcccattgcgtaagaagcagggagccaagaacattcatactggcctcctgcttagccttaactgaaataggcccccacgtaggatgtgggcctatgtgaacttggctgtt

SEQ ID NO: 883 - DNA, 300 bp, Homo sapiens
ggggccatagcctctattcctgcccagctgtggatcctcagcttgccatgttaggtacactggaccagcttgtggagccataacccaggagctcagggacattgagtgcaggtttcttactcctacctgctggccctgtggctgtccctggtggccagcccagctgcagcaaaacctacaaagcctccagccatggtaggcgtcttggacctgccccagtcagctggggcttgggctgctaggggttttggcacacgtccatgtttggcggagggtgtgccttcaaaccctgaagggcct

SEQ ID NO: 884 - DNA, 300 bp, Homo sapiens
gtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaaggctctgagaaagtcaggtttgctcctaccacaggataattccgatgaacctgaaaagcgggttttggcttgtgtgcagggactctggtggaagaaagggtgacagcacctggcctgggcatgacacaagt

SEQ ID NO: 885 - DNA, 300 bp, Homo sapiens
ctgaaacggaaacctttcgcaaagcctgtgcaggcagaggagctcacacacatccttgacgtggcactgtgtcttcaggggtgctgccctcttacagagagacagatctggaggccatggccgttttggtgagaaatgccagaaacagcttcagtttccacctactgcttcatatttataatcacagtaatctatttctcgttttgctatttctagagcaacaaattgtgtgatgcgaaattagtaccagaggaacaatgactccacttaacaaaaaaatagcatgggatctatgaaaaa

SEQ ID NO: 886 - DNA, 300 bp, Homo sapiens
gagaatactttatacttctcagcttcttgtgtatttgactgtgacctggttataccatttgccactgtgaggcttagctgtgcatctgtgaatgggagattgttcttagagattggtcatagttgtccacctgcctcggaaactgcaggtacaaatgcagcagcaaagtatttacattcttacttcagggctgatctcctatttctatcagtccttttgaaggcagagaatgttaatttggaacaacctgcatatttattcaaatttccagagagatgaaactttcagaatgctgtgctg

SEQ ID NO: 887 - DNA, 206 bp, Homo sapiens
caaacctgtgtcaaattgagaattactgtttttctgaaagttgcaagaaattaccaatgaattagccatggatagaaattgaaggttagtgggtgaaagttttcagtcttaccagtaaaaacaagtgagaatgcactgacgtccagggaaaaaaaaacagatggggtcagctttcattgtttccccattttacaaaaccaaagcca

SEQ ID NO: 888 - DNA, 300 bp, Homo sapiens
ttttgaactatcaactagatctgggaagatagaacaggcagcatcagattgccttgtttacaaagtgtcatcacgaaaagtgttcctctaggaaggcataatatgtggcctgatggatttgatgagtagattgtaaaagggttgggattctggcagaacaagaagagataactaattagtggaattaactgagaaaagagttcattagcatgttggctattagactctaataaaaatgggtgtgaaaagatgggatttggacctagaggcagtcttagagccataatcctttttttctcc

SEQ ID NO: 889 - DNA, 300 bp, Homo sapiens
ggtgaacaaaaatggcccagattcttattcagaaaccaattcacattttaaaaatatatactgtacactaccccatcctcttcctaatagctaaagtgatctaccctaaaacaccaagcagtccttcttacagtttgttccctcctgacagttcattgattacaatgtgaaagcaccaacctgagctaaaatgaaatgagaagcctgatgtttcaggcaccaagtactttaaaaatgtctactggctgtcctgcagcattttacttaatcattttttagaggagggatgaggactggttg

SEQ ID NO: 890 - DNA, 300 bp, Homo sapiens
caaaggccgtcacaccaaggtcaggccaggagcctaggctaaaggaaacttcaccaccggggacatcagctgctgtggccagagaagagaacatgaaagcccacatcccgtgcctgcagccacccactttgctgtcacttcccagctgaagtgaggagggactgttcagaaacatcgaactgagcaaggtctctgtctacctcatggaaaacctgatctggaaatgacacttggaataaaataagattactcttccattaaaaggaaatccacccaaaagagagaaatagtggtatattt

SEQ ID NO: 891 - DNA, 300 bp, Homo sapiens
cggacctctagtgcctgatgttcactttcttcaggtcctcaatttcctacatttaagctgttcggttaaacttttccatattcagcttgagatcaacctcctttacataactgattatttttgccttgaggagaaaagatgacgctaaacacagcacacatgtgtttattatatgttggtaatgtggaattcaaagatgaaagagacgtgagctgcatcactaaaaaagaaacatattacataaatgcaatgctgatatcatagataataaaattaacactaattttttgatattatcaa

SEQ ID NO: 892 - DNA, 300 bp, Homo sapiens
atagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaa

SEQ ID NO: 893 - DNA, 300 bp, Homo sapiens
gaagttgaaatcctagttcctggagtcctctgtgatggcaaattctgccttccttgtttcttctttttttctcctctgttttcccattttagtagttcaaatggtttttgtattattgaagacaggtatgtctcaaatccatggaactcacaaaaaaggctcattttctatcctcaaggagctttacatctaatggaaaacacacagtgaagtccagaaggactcactgtggactggtagcaccatgagggctttccatgaagaaggacttaagccagacttagcagggtgggcaggtgt

SEQ ID NO: 894 - DNA, 300 bp, Homo sapiens
atttgccttaatcttgggttactagtaatgctatctgcgctgtgcgtctaaagcctccagaaagattgctcaggcatggcctaatagcttttatcagttcactcagtggctcttacactttgatacctgaaacctagagttaactgtgtaggaccaagctcttctgaaggagtcaactgctctcctctgtcaataatggctgtttatgccaaaacagccaagagaacctccccacccccttccctctgtcaaagtgaaatggaacctaagaatggaagctagtggctattttgccatacc

SEQ ID NO: 895 - DNA, 300 bp, Homo sapiens
ggtggctgggcgcctacagaactgctgccgagcagcagccaattactgccgaagcctccagtaccagcgccgttcctcccggggtcgggactgggggctgctccctcttctgcagcccagctcccccagctccctgctctctgctacgccgatccctttaccccttgcacccttcacccagctcactgctgccctggtgcaggtattcagggaagcactggggtgccatatagaacaggcaaccaagagaacgcggtcagaaggaggtggaactggggagtcctctcagggagggacaag

SEQ ID NO: 896 - DNA, 300 bp, Homo sapiens
gtgatagagatcatgccgcttgggttgctgagttctccccctcgttgtaattcagcaggcttcccagtgttccctgcatcctcatctgtgaggccgacttcactatcattcccacttataggtggaggagactgaggcacagagctcccaaagccccacagctggcgagtggcagggctagcgtgcgatgtccactagactggtgtctgacgcagaagctgcgcttctcacccctgggatctggaagataattctgatgtgtgagatccaggagaatgcattgtttagccagaaaatgtt

SEQ ID NO: 897 - DNA, 300 bp, Homo sapiens
tgtacatgttccagtgggatgggaagcagcagagaccaacagagtctgaagaagcaagcttctgagttatgaaagcctgggttcaggagactaacctatatgtaggttcctaggaaagtccagttaaagggcctactttgccactgctgcctccttcttaatgctgaacctcatctcccacaagggggcagtctcagcaggtgtcagctgagccatgtgtcatctgtccaggctaactgcccacacatccttctgcaaagggtacctcttggttatcagtgctcactgatccctatataa

SEQ ID NO: 898 - DNA, 300 bp, Homo sapiens
gtgaggggctgtctggcccttctgattttttgttaacgagacatggattgtggcatcaagatttagattcattcctctgtttgttggagtcattgaagccagtatatcctggacattttttaaagaggtccccattctgagaaaagacaggagttgaatgtcttattgattcttacctttctgttcgttatagacgaccagaggaaacaaatgcccgacacggattcgactcagtcataagtgtgaaccaaataggccgatctgggttctctcactgactgaagaggaagagaaataaga

SEQ ID NO: 899 - DNA, 297 bp, Homo sapiens
  misc_feature (1)...(297): n = A,T,C or G
aattaagntttttgggttnantgccctncnntnaantttttaaagcagntttganttttgnctggnntnaaantgngtnttaangnangtgangagnncntaaaattttnanccntgnggnnccccccccttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattct

SEQ ID NO: 900 - DNA, 300 bp, Homo sapiens
cttgttttaaagataattgctagatttatgttttagctttccataaaatggaataacataaaataaaatataaataaaatatgaaataaaataaaagccatggggaaaaggtagggtttgattgctaataagaaatttcttggaaaagagactagctctcttttggttttccaaagtccacattttataacatttttagtgcttggtgtttgcttgtggtattacattagataaaaatgtatcacagtgttggtttatactggatgtttaaataggattcattgaaaggggtgtgttttc

SEQ ID NO: 901 - DNA, 300 bp, Homo sapiens
ctggaaggttactgcaaagacagcctggtgaaattgttgggagtacagaggctttaatgggttctttgaggtcaggtagaggttatggggggagcactacagtgagcatatacccaaaatgaagccagacttccaaggtacgttctcactggagagggagcttaatggtaaagtttaaactttaagggtttaggttttagattaaggcccaggagatccaaggggaaggaggagggtaggaaatcagagataagaggagctgttgtcatcgcaggtatagtaataattaagatatgttaa

SEQ ID NO: 902 - DNA, 300 bp, Homo sapiens
  misc_feature (1)...(300): n = A,T,C or G
attatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgntattcttactcatgaagttaca

SEQ ID NO: 903 - DNA, 300 bp, Homo sapiens
caaagcttgatctattaatatattgatcagagttccatgatccttttctaaaatggtggctttattttgccagaataattctgcagggtgttttttttgggacggagtctcactctgttgcccaggatagaatgcagagtggcacaatcttggctcactgcagctcttgcctcccagtttcaggagaattgtgtgaacctggaaggcggaggttgcagtgagccgagatcaatcaccactgcactccagcctgagcaacagggcaagactccatctcaaaaaaatttttttttggattta

SEQ ID NO: 904 - DNA, 300 bp, Homo sapiens
tttctctttcctttctgcacaatttagttctaaagccaccaggcagggcagaggaaggtaaggctttccatggtgcttaggagcaggggtggggttgttatcataacctaagcaaagttacaagggtaatccatatggggtagcctggtgtagagagtcagggccccagcaacattaaggacatccctgcaggatggcagccaggcttgggggtacaagaccctaaacaggatgatgagagcctccccaaggagaggtcccaggtatagagtgtcagagcctgagcagatgaggaaggca

SEQ ID NO: 905 - DNA, 300 bp, Homo sapiens
tttgaactcccttagcaagctacttgtctttttgcaggatcccatcggattgctgtctcctttttcagatattactggatcatcagctgtaaaggctctatgtttaattatgtctagcatttgaatggtaacagcgcagatgttacctgcctataatcctcctcctctctacagattttgctttgttcttgcttcttgtttttgagatcctgcacacaagttgaaattaattaaaaacagtagagcaacttagtctggataagccttcatctggcaaataatgttacactgccagagatt

SEQ ID NO: 906 - DNA, 300 bp, Homo sapiens
ccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttc

SEQ ID NO: 907 - DNA, 300 bp, Homo sapiens
ggctattaaaaatgtaatcagtgtgaaaattcatgccatctgaatcgtacgagtatgtaagggatttgagttccttacagaattttctgtaatttagtacttcaagtgacttataaatgtatatacttctctctcacaaaagtgttaggagaaggaaaatcttaaatactagcttgatttcttaatttaataacaaaaaacaattctcataacatgtatcacctaacatgtcactttcactttaaaagtctaaagagttgaggtttatttcttttcttttaaagttgatgtttatgttgg

SEQ ID NO: 908 - DNA, 300 bp, Homo sapiens
tcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaactagagttggggggaactggagggagcaaaacactgatttgatactagtcagttt

SEQ ID NO: 909 - DNA, 147 bp, Homo sapiens
gtcttcctgtgcagggtgctttggtagccatcagagaggaaccaagggcaacatcttttcttcccaggcgttcttctctgggtgctttattctcttctttttctttatttcgcccccacccccatcccctgcctttttttttttttt

SEQ ID NO: 910 - DNA, 274 bp, Homo sapiens
  misc_feature (1)...(274): n = A,T,C or G
ccaacttggatgaaggccagcgcagagcccaaactttgtgaatcagtaacacgtgtatggaacattcacttacatgcacagaggtgccaagggacagcctaatttaagattcatataaacacatttatctggcaacataagttaatattgtggtaggagtcccaccaagttaaaattctaaagtgtttgaatatgggcatttttaaagaaagaatctgcataccataaattcacgcttttaagtgtatgantcannggnaanantggatnnnca

SEQ ID NO: 911 - DNA, 300 bp, Homo sapiens
aacagatagagacttggtcttaaaaaaaaaggaaaagaaaaggaaacaaaaaattatctgggcctaaaggtgtgtgcctgtgctcccagctacttgggaggctgaggtgggaggatggcttgagccctggaggttgaggctgcagtgagccatgattgtgccactgcgctccagcctgggtgagagagcaagactctgtctttaataataataataataataataaagtggtcaggaagggacccccagggaggagcataaacctctccagtggctgtgatttgtcagtaaggacatggg

SEQ ID NO: 912 - DNA, 300 bp, Homo sapiens
gcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgt

SEQ ID NO: 913 - DNA, 300 bp, Homo sapiens
cagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcgggaaataaaggcaag

SEQ ID NO: 914 - DNA, 300 bp, Homo sapiens
  misc_feature (1)...(300): n = A,T,C or G
cctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagnactttaattttttctcttggactgcaataaagtatagctgcctaaaatacgtttcctgacacttggaggtttgtccacaatcgggaaataaa

SEQ ID NO: 915 - DNA, 300 bp, Homo sapiens
ggcaaatagccctaggagtcccatttttttaagctgagggaaataattttcaagaagcttgtcttactagtagcatcattcttttttactggctcacagcttggaaggggtgatggtttttcctatgaaagctaacaacatttgagcagatccagtgtgctggtgagtcacagtgaaagtgtggagtgctaaggaagcctcctggtggaaatgtaagttcagagaaggtctgcagaaaatacagggtgaaatgttatcaaggagccagggtattatttaagaagaggagggaggggaaaa

SEQ ID NO: 916 - DNA, 300 bp, Homo sapiens
tccaagaggagaagcatgttccaaaacccttaactttgggaatttagaactagcttttttactatcttctgcacagcataacttcagtctccctttactaattcaaggaaatctcagtgaacaaattgtataagggtagatgagctaaaagctcactgagtcattaatttgtcataactcatctaaatacaatgattaggcttgtgtaggtgtccctagtttctctttctaaatcatgtcttagtagggacagagcaataatggtggatcgtggcaacgggaaggaagatgatgtgtcag

SEQ ID NO: 917 - DNA, 300 bp, Homo sapiens
tgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccc

SEQ ID NO: 918 - DNA, 300 bp, Homo sapiens
caggaacgcaacaaactcaagtcgcagctcctggtggtgcaggaagagctgcagtgctacaagagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagac

SEQ ID NO: 919 - DNA, 136 bp, Homo sapiens
gtaagggagggggtagggctgggttattaagatacaggctgctgtattttacattggttgtgggggaaggggagcctggagaaaacaaagtcactattcccttttttgaaacaggaaaaaaaatattttttgttca

SEQ ID NO: 920 - DNA, 135 bp, Homo sapiens
cagactcgcattatggacaagtcccttctccccacacaaaggaagacatacaccgcatagtccatttcatttcagctcctgatggcatctgaccgccgtggacacttcccagtggtctggcttttggagggagag

SEQ ID NO: 921 - DNA, 300 bp, Homo sapiens
aagcagaaatgtgggtggtgtgactggggtttggtgaggggctgctgtggctggaatggagggctgccacaataatggaaatggtaaatgaggcaagtaaggttggactggtggcatagcgtcaaggttgccagctttattaaatcactcttccaatatgctagcactggcctgttgggaaaagtaatacatcatgtaatcgaacaaaagacagaggcaagctccaggaatgggcactgtaaacaggacttgtcccagagtagccagatgtaggctttaggtaagttgatgcaagctgag

SEQ ID NO: 922 - DNA, 280 bp, Homo sapiens
  misc_feature (1)...(280): n = A,T,C or G
tctcgatctcctgacctcgtgatccgcccgcctcggcctcccggggtgctgggattacaggggtgagccaccgcgctgggcctggatcaaatctttatccatgcacattggaacacaggattactgggttgaaatcattctagttttgtcatttagatacttgtacgatgaatctattttagcacaagggataaataactcgnnangncatctntannttgtntnntttngtgnntttgnntanaccacnttcangntcnangnnaactttncttnggat

SEQ ID NO: 923 - DNA, 300 bp, Homo sapiens
ggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtgagttttattgtatgttgcttgctgacaactgttttgggggcgcttcagtgatatacattcatagaaagactttgttttatggcagattagtttacaaagagtattctgcaagtgggatta

SEQ ID NO: 924 - DNA, 300 bp, Homo sapiens
ctcaaaaccaaatctcaactcagctacagaatctactgtggtccttgtctgaaaaaattagttcactcggttggaatcttgtctcagagcatcctcatctctttctcaaaagcccctaccccaacaccggcgtgttggttgtctattgaaacttacaagtggatggaccctttctcccgaataaactggcctttgaaagctctaatcgaaatggtttggcaaaatccatactgcaggagattagggaggacaagaatgatgtgcctttttgtactgctgagcctgatggtggtgccacta

SEQ ID NO: 925 - DNA, 300 bp, Homo sapiens
ggaaacagctggactagagatacacatttgggcatatatatatatatatatatacagtatatatatgcacgctgattttatatatatatatatatataaaataattatggaagtcagtgagattgtccagggcaagaatataatgtcatatgagaggggagtccagactctcaaggaacgcggacatttaaggggagagtataataggatgggccgtcaaagtctaagtcagagcatcctgatgttggaggcaaagcaggagagtgtggattaagcagctagacattggttactggggca

SEQ ID NO: 926 - DNA, 295 bp, Homo sapiens
  misc_feature (1)...(295): n = A,T,C or G
atttcagcctgggcaacatagtgagactcccgtccctaaaaaaaaaaaatcccacaatcctatcacacagagatggcaacacttaccatttgttctggtcacctttggaaggaacttttaaatcaatgtcttgcttctctgtgggttcttttgtgactcacacctgcttctgggtatagtatgactataaagttgatttcttgggtaaggtatgatctatgagaggaagcttctaatttgatgagcatcagggnanttttanctggtataccttttntttgccctctccaatcaa

SEQ ID NO: 927 - DNA, 300 bp, Homo sapiens
gtggtagcaggcactagataagaggtgaaccagtgtggaggcaggaggggtaggaaaggagatggaggcattattaccaaggcatgatagaagccatgggatctgataagtggtgagaactggaaagagagggacaactctgaaatttgcctctgattgcagttaaatgatagcatgctaatgacagaggtagcagtaggttggggagagtgtagtagtatttctgttttcagtacactgggttttaagcattgacaagccaccaaatgcaaatatcaagcaaagagtggcacatctagg

SEQ ID NO: 928 - DNA, 300 bp, Homo sapiens
gcgatttatttcacagagttaaggggccagtacacttcatggtataaaattatctttttcaggggatgaaggcacaaggagaaaattacttgaagcttggagatcttctctggcaagcaatttacaaattctggtgttctttgatctggctccccgcccagacaaccagggagttcttcatgttctagcctcatgtgttgcactataggcagtaatttggcatcagccatagaggagggatccgatagttgtcattgctgcccgccacatatactccacatggaatgatactcataatgc

SEQ ID NO: 929 - DNA, 300 bp, Homo sapiens
gggacactggattctcattctactcaaactcccactaggactgttggcttgttcgcttctcaagtgtttgtatttttctgagttaatatttttgggtgtaatttacatgtaggaaaatgtacacatttttagtgtacagttcaccaagctttggcaagcatgtatagcctggtaacccacaagccaatggagacctagaacattcccgtgaccccagatgctgggttctgtgtgccttcccagggcttgtggctgggcacatcaggcatggcgggtaccatgcctgacagctctgaacca

SEQ ID NO: 930 - DNA, 300 bp, Homo sapiens
gaatgggtaggaacaagcattagcctggtctgggttcctccagctcttaggacaagttggaacagatttgctgttctgatgattcatctttctgatcacagggatagcagaactcagctttgaagaaaggcatctgcagagatcatggcagttccattttgcgttctgagtttgctcctttaggtaagggaactagaatgcagatacagttagaatcagtctctctctctctgtttgtctgtctgtctgtcactctctctctccttattgcactgagggccgggcgcggtggttcacacc

SEQ ID NO: 931 - DNA, 300 bp, Homo sapiens
gtcatgagaagagccccagatgggacacccgttcttccttgtgacattagggaatttggtacagctttctggatcagtttttgcctttaagatgcatctggactcatcaaacccagaaagtgtagagcaaatattcctattcccatgtccttggcagacattgctaatctatctcagggctccaacagagttgggtctcagccttaccagcctggcagccactagacttgatccctgagatgaaacctcttgaccacacaggaactccatgatcttgaagctcccttctggctctataac

SEQ ID NO: 932 - DNA, 300 bp, Homo sapiens
ccaacatggtggtctcaaactccccacctcaggtaatccacctgcctcagcctccaaaagttctgggattgcaggagtaagccaccacacccgtcctcagtgcctggacttctgcagtggacttcctttaaaaatcctggaatatacactgcagtaaaagaacaaagcatacttcagtcgtttaaggctgaggtatgctttgttcttttactgcagtgtatattccagccttaaacgactgaagaagaatgtcaagtggggaagtggctttggttttcagtttgtgggttctgaatccac

SEQ ID NO: 933 - DNA, 264 bp, Homo sapiens
  misc_feature (1)...(264): n = A,T,C or G
ctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccacaaaaaaaaaaaaaaaaaaanntgngccnttnaaanttntggggggnc

SEQ ID NO: 934 - DNA, 300 bp, Homo sapiens
gatgtcctgctatacaccatccactgccctgccccttaagcctcacatctttcatctctcctagttccaacccatggtctccagacgatgactctgcctccctgttctggtagcattcacagattgccttgtttagtagcctttcacatgagatccacttgacagcccctgtcctcacccctcctcaaactcctcaccacactgaaactcttccagctccatgagtaggttcttgggtggtttcttcacctgcaggttcaggtcaatgctcagccggggactcgacagggatgctttgca

SEQ ID NO: 935 - DNA, 300 bp, Homo sapiens
accaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcaagtaggcccattc

SEQ ID NO: 936 - DNA, 300 bp, Homo sapiens
gagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagcccca

SEQ ID NO: 937 - DNA, 300 bp, Homo sapiens
tcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtctt

SEQ ID NO: 938 - DNA, 300 bp, Homo sapiens
caaagtactgggattacaggcatgagtcactgagcccagcctaataaagaactttctgacagtgaaaatggtctgtgcatggtgtgggtggggtgagggtgaggccgggcgtggatggagcagcagggaggttgtagacaatgtccagacatcagagagagggctgggctctgatcctgtgccaccctgaaaggctttgatcctatggtttggtcagaaacagagcctgtaaaacccatgtatgcagctgttgctaagggcaaccacaagatgctcaaaggaccttaaagatgtagatgc

SEQ ID NO: 939 - DNA, 300 bp, Homo sapiens
wcgtgtgtgtgcacaaagcccctaaggtttcatgtgtacacaccggtgctaagtgttttttacacccttgagcatctctcggcctggggctcctgtgcaggttgccctgagagttgggtttttagttcaaaaagaaggaacacagatgactactctgctggcgacacggccactctgctggcacgcacatagcatggcgcctccttttttgggggactctccttggtggcatctctggcaggctgagtcctctccagctgcagttctggaccctgtctgggttggggaggggcatttggt

SEQ ID NO: 940 - DNA, 300 bp, Homo sapiens
gctacacccagttctcccagttcaacaaggacgactcgctactgctggcctcgggggtgttcctggggcccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctg

SEQ ID NO: 941 - DNA, 300 bp, Homo sapiens
ggcttccaggaaaccaggcaagggtatgcccagggctttgcctcctggttttgtttcacctgtcccactctactgtgagatagagcttccagagttgttcacagggttgagatttttcgctctgaatttgagaggcaaccgtatctggccttctaaggaggcagggagctacctgggaggcaacactgacaggtcattttgcttcagtgtcaagcatttttttcctctccttttgttgtggcagctcagtgttgacagggctccacacgtcttctttgagtagtgggagtatgtgcccaa

SEQ ID NO: 942 - DNA, 300 bp, Homo sapiens
cctcggggggaggccagcccctggctcactggctcagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttt

SEQ ID NO: 943 - DNA, 300 bp, Homo sapiens
ggaagctccaggcctggcgtgctggagtcacgagatgagctgtccaggcagcatggcatcgtgagtgaactccgaccgtggcaggtgaggcttctgcacttagctggctgtcttcatgtgggccgattctgtggttagtgattctgatttctcatctgaaaagtggtgcatcacttagcccctcccacacttggagggttctactagtgtgcctgcgtggctgggttctgcacactcagctactttagtttctttagtctatccttaaaaagattcctaggtgtgttcctgattttgagg

SEQ ID NO: 944 - DNA, 300 bp, Homo sapiens
cccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctc

SEQ ID NO: 945 - DNA, 300 bp, Homo sapiens
gcttcctgctctttgtattttggctaaaggcggtgaagtgagaggcggagggggatttaaaaccagcagaaaaaggcttcttgttgggctgatggtgtttgtgcgagaagctgaggtgggcagggaggagagcctaggagagcggtagggctcatgggcaggccgttggtgtacgccttggccctgcctgtccccagtcccaccactgtggactccaggccatcctcagtccaggtggtcactgtggcctgggccacatgctggcgatgacggggatggccttccacatgcctgttctct

SEQ ID NO: 946 - DNA, 300 bp, Homo sapiens
agtacagtgccaggcagctactctcatgtggtcagatggcacattcacaacagtcctttatcatgagcctcctacatgatgatcctgcagctgccacttgctcctgtatgcctattcaccaccacctacctgtgtttgcaagttccatgaggaagggcccatgcctcctcctgcttatcacagtgtgtccaaatcagtgcctggttcagggcctgtgtgtatgggacatctcctaggcaccacttcacaccctctcagccctaccttccactccagccaccacctcagcaaccagttctg

SEQ ID NO: 947 - DNA, 300 bp, Homo sapiens
ctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcag

SEQ ID NO: 948 - DNA, 300 bp, Homo sapiens
ggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggct

SEQ ID NO: 949 - DNA, 300 bp, Homo sapiens
attcctttcatggtacagtatttaccccaagtcatgattaaatatctgtttatatatttctttattggattatttgtttatttttctctctctagactgcaagctccttgagcagaccatgtttattttgtctaccacaggtgctcaataaatatttttgactatttattacatgagaaggtttccatgcaaacacccattgaatacgattgaacttgaaccctaagagatgggctgtgacctttgttgccctcaaactaatcaaaggggagtgatattcaccatccagaatctagaata

SEQ ID NO: 950 - DNA, 293 bp, Homo sapiens
ggagggcactgccctcctggaagagatgcattagatcggtaggcacagaatacctttacatgagaccatttagagaatgattaggggccaaaggtaaggggtggactgttaagccaacagggactcagagaaagcaagggtcagggtgaccagaaatagagaaaaaaaagccttacagaggaagaggacctggacctgagccacagaggatgggtagaacttagaaggagggaatgagcccagtctgaatgatatgtctacaaagtatacaatatgcaatgatgattaactga

SEQ ID NO: 951 - DNA, 300 bp, Homo sapiens
gagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttct

SEQ ID NO: 952 - DNA, 300 bp, Homo sapiens
agagctcaccccatgtatatttccacttgggagcatcatctttccaagggccactttgaggtgaaatggcttttttacatactcagcatcaatttggtcctaaaatcaggagacattcacccttctccaccccaatttccaacatcccctcctttgtagagagagcactctggaagccactgagccccatagccctagggcctagaccactattccaaaagggaagacttttccattactatgacagacacccaggctggagtcctctgcctgcactcaaagctctaaccccaacctctt

SEQ ID NO: 953 - DNA, 300 bp, Homo sapiens
gaaaatatcttcaagcactttataaataaattatatgtctgatactagccttccattgcctggatcacatctgattgtcctggtaatttgagaaaagggtagccccttggtatggatagtagcttgatgacatggaattcagggaaaagactatgatggtgtcacttgtaactgcttttgtgctgtaaaattgtcatggattaagaagagagttggctgggtgcggtggctcacacctgtaatcctagcactttgggaggccaaagtaaggactgcttgagcccaggagttccagaccaa

SEQ ID NO: 954 - DNA, 300 bp, Homo sapiens
agtcaatgctcactgaaagtctgtcttagctgcctgtttgaatgactgttctttttctcatttttaattcttggactcatgtcctcattgcttcactcaattaaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatgggg

SEQ ID NO: 955 - DNA, 300 bp, Homo sapiens
cccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttctt

SEQ ID NO: 956 - DNA, 300 bp, Homo sapiens
cctctgcgcctggccccgggtgggtcagccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggccc

SEQ ID NO: 957 - DNA, 300 bp, Homo sapiens
ggagagagccacatggaggagagccatgctaccctaactgccatagctgaggctatcctcgatcagcacacatccattcaagcaccagacactggagaaagtccacttgaggtcagtagagctgcctagcagatgcccaactgacccaaaaagcataagacataaacatttattgttgtataccctctgaagttttgcatgtgttacaccatattactatagtaatagataattgatacaaatgtcctacatggcctggaccatgcattccttgctaaatttatttcttgctactctgtc

SEQ ID NO: 958 - DNA, 300 bp, Homo sapiens
ctgcctcctccttaggcagagagctccttggttccatttgaaaaccttccttccccttttgctggaattgagagactgaggacacaaagtggtgtgctggagaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactg

SEQ ID NO: 959 - DNA, 273 bp, Homo sapiens
  misc_feature (1)...(273): n = A,T,C or G
cccnttngnactncccaatggnggntttattannnnnnaagaaaccaggggaaatattaattttaatattatatccacctcaaaataatggaaaagaggtttttgaatttttttttttaaataaaccccttcttaagtgcatgagatggtttgatggtttgctgcattaaaggtatttgggcaaacaaaattggagggcaagtgactgcagttttgagaatcagttttgaccttgatgattttttgtttccactgggaataaagntggattcg

SEQ ID NO: 960 - DNA, 181 bp, Homo sapiens
gctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacaaaaaaaaaaaaaaaaaa

SEQ ID NO: 961 - DNA, 300 bp, Homo sapiens
ggcaggcactggagagccagggtggttcagccgcagctcctctgagcagggagtcaaacagggctgaaacagacaccagctctccaggaccagctgctccaggaatcaacctctaccctgaaccaggtccctgaggaccaccacgtggctgcaacacagcaggagttcacagtccagaggagaagcccgatgctgaacagagaatcacatccgtgagcaacacaaaaggtctcaatcaaaaacctctgaaagccactggcctagagttagaggaagagttagccatgagaaatggtggtg

SEQ ID NO: 962 - DNA, 300 bp, Homo sapiens
tgacgagcgactgtagacgttgccagcatgtattgatcaggagcagcctgtgagtcaagactgacaacagatcaataaatggcttttaaaaagcaaaacccctcaagctgtttatctaggaagcctgacaaaccctgccgcagtggtgtggccccatgtgtccccagggcctggggcccacctctgccccagaagtcctcttagtgtctgtagacaggtcccatttccaccaggtcaaccagggctgtggcagtggacctggatggcaggcagagcagaggaccgctgttctatttgttg

SEQ ID NO: 963 - DNA, 300 bp, Homo sapiens
gttggttgtcaactttgcattataccacccacttgtaatatctctgccttgaagaggaaaaaccaggaacatttcctagaatccccttcccgttatgatcccaagttaggatatgccagtgagaggtgctgttttagtcccttttgcctgctgtgacaaaatgacacagactgggtagcttataaacaacagaaatttatttcccacacttctggaggctggaaagtccaagatcagggtattggtagattctgtgtctggtgagggctcattttctgattcatcgatggcaccttctca

SEQ ID NO: 964 - DNA, 300 bp, Homo sapiens
aggacattctcctacatagccgtatattctcattatacccagcaaatattcaatcatattatctaaggtacactccacattcagaaaaaaaaatgccctttaccatagtttttgttttgcttttggttttgatcaaagattacaggtgtgagccaccgcaactggcccactgtgttacgatttgaaataaaaaggaacctgtcaagtacccagagaatatcagaactgctgtccgatctcctgaaattgaaattaatttcctcagtgactcaatacccactgccactcactcaagccctg

SEQ ID NO: 965 - DNA, 300 bp, Homo sapiens
catctgtagaattggctttccgtttgcatatttaaatgaactttgtggcttttgttaagtataataaaaagcatggagtcaaatataagccaagagtattacagagacttttaggctgactcagtatctcaagttctgtgtagattcatctaaacactgctgttatccatgctatactttaccatgttatcccaaaagggaatcatcagcaaattttaccagaaactgctgaattcaagatatattcaatatatattatacttctgacatcctaggaagcctatccaaagaatacattac

SEQ ID NO: 966 - DNA, 300 bp, Homo sapiens
ggaaggcagtggaaagccattgactttatcaaagtattagagtaacctaatctgatagatctgttaccacatcaccttgtccactgtatggacagtgaactgaatgtgaagaaacttgaggcagagagacagcacagaggctgttggaataaattcactgggctcatctcacatgtatgtcttctagtctacatgtcttctatttccttctgtcttctcctcatccccaccattaatctgtcagatgcacacatgggcaaagggtcttgtgtaccaaatgtgctcagtgataaaagcagc

SEQ ID NO: 967 - DNA, 300 bp, Homo sapiens
ggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacct

SEQ ID NO: 968 - DNA, 300 bp, Homo sapiens
tggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttact

SEQ ID NO: 969 - DNA, 300 bp, Homo sapiens
gccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcggggaaggtccctcagacataaaatactcacccatttagaggaatgacaacagcaaaggaaactatattctgctaatttactggtaagagaggaaaaactct

SEQ ID NO: 970 - DNA, 300 bp, Homo sapiens
gcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattgga

SEQ ID NO: 971 - DNA, 300 bp, Homo sapiens
gataaaatagacaaggctcttgtccaaaagcagcagcttatgttcttgtaggagcaatatggcagacacaaagatgcagactgggttaggttttagaaaaacttgacttaaatcagtaaatacagtaacagggatggagggcataaggctccagagcaatgctggcgccgtcagtgtgtgctctagaggtgcaacccgggtggttggtggtcagcctgggtgacacagcaggtggcccatgctggctgaggcctgcttctctccttttggagctctggctttaccccagcttccatgctt

SEQ ID NO: 972 - DNA, 300 bp, Homo sapiens
agcctgctgagggatgcccaagaagttccagggtgagaacaccatgttggcagcgtcccgggcactgaggtagaggccatggctgcctctgatgccaagaatcatagggagcttgaggatgcctactggaaggaccgacgacaaacacgtcatgaggaaggagcaacgcaaggaggataaggagaagcggcgcctcgaccagctggaacgtaggaatgagactctgcgcttactggaggaggaggactccaagctcaagggcggtaaggcgcctcgtgtggccacgtccaactcggtcac

SEQ ID NO: 973 - DNA, 300 bp, Homo sapiens
cccaagtagctgggactacaggcgcccgccaccacacccggctaattttttgtatttttggtagagacggggtttcaccatgttggctaggctggtgaccgtgtggtcatggtggggaccagccctccggggcacccagtcggggcaggttctcacgtgggagggcacagggcttcctgcaggctcggaggcccagggcggattgtggccagtggaagggaaagatgtttctggcagggggacttgtgtgggccacggctgtgcggctgcggcgttgagcacggcctcactgtccacctg

SEQ ID NO: 974 - DNA, 300 bp, Homo sapiens
aattactggaacccgggaggcggaggctgcacagtgagccaagattgcaccactgcactccaggctgggcaacagagtgtgactccgtctcaaaaaaacaaaaacaaaaacaacttctccctcctccacagactcctccctggtcaccactagtgatccaccttatggatctcccaaggccacctctgcctctgctctgtgttgtattatttggggacctgtggtctggcatgcattgtacttggtgccccaaagggctgtggcatctgataagtgatttatcctcaggcacagatttgc

SEQ ID NO: 975 - DNA, 197 bp, Homo sapiens
  misc_feature (1)...(197): n = A,T,C or G
aattccgttgctgtcggtgatgagattctgatggaagagattaaggattacaaggcacgcttgacctgtccgtgctgtaacatgcgtaaaaaggatgctgttcttactaagtgttttcatggcttctgctttganngtgtnangacacgctatgacncccgncagngntaatgnccccnnntgtnatnctgtttttg

SEQ ID NO: 976 - DNA, 300 bp, Homo sapiens
gcgagatcctccagttccttgtcatcccaaatagggccaagggaaaacacaaataaggcatatccctgacatttggctcgcaaggattccttctttaagatttccccatctaagtggctggtttccccagcagatatcacaaatatgactttgtttcttctcagattgggtgtacttaaaaatacattgtccagagtccactgtaaggcatgaccaataaaagcatctccatttagttgtttaactgactcgtgcacatgcctcttcatgaggcgcttacttctgtaggtggtaagattg

SEQ ID NO: 977 - DNA, 300 bp, Homo sapiens
tgtcacaaggggtttttgtagaagctattcttcacagaggttgggggagagattaagccaaaggatctctgaggtctttttcaaatctatgattatgtggccttttgttcattgacttccatgtgttctagttgatcattacaaacctggcaggccttctcaagggttcagtaattagctgtcatttcccatttgtccagagagtgtccaacacaaaatacccctaagatcttggccaatagagaaatgtcatggaattttagaaatgacagtatctgcggagtttattccaagttatat

SEQ ID NO: 978 - DNA, 300 bp, Homo sapiens
ctttttctcactgaaatatttaagcactgcattttaagaaaacttcctattcattcgtagacttttatctggccagatttccactctgagggcttttctttctagttatctgacaaaccataaattttatttcctttaagggcaaaaccaacctccaagcacatttatggcccatgttttaagagctggccgccctttctatcctgtatctctggttaaacgtgttttctttttcttggagcaaatttttcaaagaggggctaaagctatgtgttcctctggagagaactcctgcctacc

SEQ ID NO: 979 - DNA, 300 bp, Homo sapiens
gctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttg

SEQ ID NO: 980 - DNA, 300 bp, Homo sapiens
ggtaagattaggcagaggttttatctaacactaaagtttccttgccttgatgagctttcagtgttacgaaatgttattcaatagcaattatgagagattgttttagccagaaactgatcacttttaagttactggattattctgcttgagcttgtgagaacctcaatgtactccagtcctttctgaaataaggcaagatgtaaataagaattgtgtgaagtgtttaagatggacacttagaattattcagaacagaagtttaaagtgtgtggcctaagaaatgtaattcaaaatgactat

SEQ ID NO: 981 - DNA, 300 bp, Homo sapiens
gcctcatccatggatcagggaggcacgccagggagtaacccagttctgcccagcaatctacaccccactaactctgggccctgtctgtgctatttaacatttcattcaaacaggagctcctgggaagaagcttggctcagtatccttggcagatcacccctcaaagtctccctcaggtatattctaagtgaggacggatcccatatatacctcacttaggctttactctgctctgcaagcacaggcaagaccagctacatctttgcacgccacccctggttcttagtaggccaagaacct

SEQ ID NO: 982 - DNA, 300 bp, Homo sapiens
attaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagag

SEQ ID NO: 983 - DNA, 300 bp, Homo sapiens
ctccagtagaacttgagcacttggaacctgaaaaatgtaaagaactggtctgtatagtgagagctgtggattgttctagacttttgcccagccccaaattttagtgatagcaaaagggcactggaactagaggccagagggaaactattaaactcacgtgctggcgtgaggaggggatggagccaggagctcagactctccctcatctcacgggcattttgtaatactgacatttccagatagaacctgctgccctagtctagctacccacagttccctccgagatgctgtatttggaac

SEQ ID NO: 984 - DNA, 136 bp, Homo sapiens
cctgcagccactaatgcattgtgtatgataacaaaaactctggtatgacacattttctgtgatcattgttaattagtgacatagtaacatctgtagcagctggttagtaaacctcatgtgggggaggtgtgggagg

SEQ ID NO: 985 - DNA, 300 bp, Homo sapiens
cttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactc

SEQ ID NO: 986 - DNA, 300 bp, Homo sapiens
gtttctaagcacttcctgtattgcatatcaactcatttaatcctcacagcaatgtgagatacatactatcctccccattttataattgagggaactgaagcatagacaggttacatagctggtgactggcagatgaattgacttagccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttaca

SEQ ID NO: 987 - DNA, 300 bp, Homo sapiens
tgagtgccttccgaaattgacccacctgggagctatttacaaatgtccatgtgggagagagagagcatgagagcacagtagcccagcctgctggtcagcaggctcatctgtggttcacctgtagacagagagcagatcaatgtgtacttcagacaccagaaagtctggtggctttggtcccaagtgggtgaatcacctgaggtcaggagttcaggaccagcctgaccaacatggggataccccgtctctactaaaaatacaagccgggcgtggtggcgcatgcctgtaatcccagctact

SEQ ID NO: 988 - DNA, 300 bp, Homo sapiens
atgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcat

SEQ ID NO: 989 - DNA, 300 bp, Homo sapiens; identical to SEQ ID NO: 185

SEQ ID NO: 990 - DNA, 245 bp, Homo sapiens
cagagtcaacatggagcatctcactgtgaaatgatccatggattgaaggatatggtaaaatgtttataggttactttgaaagtaaaatatactatgtcttggttttgaggatattggatacaaaactctcttcctttagggctactgagacttgattcctgatcatcagaaatttcaccagaaacaacttgcttccaatatacccaattctatatgaagaattcatggagagtgtactggcactg

SEQ ID NO: 991 - DNA, 300 bp, Homo sapiens
  misc_feature (1)...(300): n = A,T,C or G
acccaccctctccaggcctcagtcttatctctgaaatggggtgggtgttgagaggtggcttctaagatctttctacttcccaaacttggaattctctttttaggagcatctgcgtgcccagatgtatgttggagcccatggtgtatgggggtggggtggggggaagggtggagggtacctaccccctgaggcttctccagagggtgtngggacccanatggacctgggtgaggaagggccctgganagggcnggcctnnagtctcactgntccttangtggnccgnngntncaaacctgg

SEQ ID NO: 992 - DNA, 300 bp, Homo sapiens
gtcagcttcaggtaggaggatggcacagactcaaggtcaagcagaggtgtgagccacagaagcagagtagcaggccaagttccagcatcctggctgccaggaccaccgtgcaggcttaagaagctggagctttaggatatggagtgtccatcacttggcatctttctcatagcccaggtggcatctgagaattaggttagggttgatttggaccctatggtttggtaaatcatgtcccttgaatgtatacaaatgatgtctgttgatatttaaaatatgtttctttctgtttaattgtaa

SEQ ID NO: 993 - DNA, 300 bp, Homo sapiens
gtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccct

SEQ ID NO: 994 - DNA, 300 bp, Homo sapiens
gagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggccctgatgtcaatgttta

SEQ ID NO: 995 - DNA, 300 bp, Homo sapiens
ttttgccctgctaaaatgatgcttagcctgaaaaatcggagcaccacttctcaaatttatttttccaactcagtaattaaaaaaacatttacttcctgcctactgggttgtggaatattgtcaggatctctgggttccaggtgagggatgcagaatgcagggaaagacaggtcccctgccctccagaagtcggtggcgccttttcagagtaacacacactggagcagacccctggaaaaggacagtccactggtggaccatgaccttggtcaaaagagggaccaggtctggcttgctcac

SEQ ID NO: 996 - DNA, 300 bp, Homo sapiens
ctaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcg

SEQ ID NO: 997 - DNA, 300 bp, Homo sapiens
gagcggggaggcgagcatgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaa

SEQ ID NO: 998 - DNA, 300 bp, Homo sapiens
  misc_feature (1)...(300): n = A,T,C or G
aaggcctgtgccagaggggttggccagttggagcctgggtcagcctcatcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtgnngtgtggaggntggcgaggtgcggagactgcagaccagtgnttcactgtntggagnntgncatgctgngtctgtaccctngggacttg

SEQ ID NO: 999 - DNA, 300 bp, Homo sapiens
caaagccactttgaattctggaaagttgacctgatggagaagaaccaggaaaaccaagaccagcatttgaggaaagctggttttgtcaacaacaaaatactgatggaagacagaaatagtgttttaggagaaacatttaatataaattcaaaccttgttccaatgagaaaaatacctgataaatatgacttatgtataatgaacgtgaattatatttcagaattaattgttagtaatagaaactcctttggaaggaagcttgatgagctcagtgcacatgcgaaattgctccttcatatg

SEQ ID NO: 1000 - DNA, 300 bp, Homo sapiens; identical to SEQ ID NO: 87

SEQ ID NO: 1001 - DNA, 300 bp, Homo sapiens
caaaagcagcagcctcatttctgtcctcctttgaatttcatattaaattgcttacatagaatgaaggtcgagttcactggcaggctaacaaagctccttgtaatttggccttatatgccctatgccttctgctgtagtaatactttgatgcttgtaattttcttgaacttacgtcattttgtgtctctgcttttgtcagttctcctgactcttagttttgcctgactctgtcttcatagacttgtgtgtaggcattattatctcctgtgaagtcttctctgacagttacttactccctcc

SEQ ID NO: 1002 - DNA, 206 bp, Homo sapiens
gtagtaaaaaagataagcttgtgaaatctatcagctctcaggctaagcattacaccaagagaatcttgcacgatccttcaatcataagaaatcacatgttagtgcagaaggtccagcgtgaaatcctctaagtggccaaatctaggagttcttctctggcttggttggctaaagcagtgatctgtgtcacccccagggccatcact

SEQ ID NO: 1003 - DNA, 300 bp, Homo sapiens
gttacctctcaattttaactttttttttcttttttaattaatgttttttacccatggcaagctgtaatagcttttttgaggggaggtaggtgcttgataaagaacagtaggtgctgcttatcaacagatgaaaggagggttctttttcaggcaaccatctcatttgtgagtgaatggactttctctttaaagtgctgggattgttagtgccatttttattgtaaatatcaaaattgttattttttgtcttctacctaagaattctgtctcttaggctttctcttcccagatttcccaaag

SEQ ID NO: 1004 - DNA, 300 bp, Homo sapiens
attacaggtgtggcgtgagccaccgtgcccggccaagctcctggccttcttattcacttgacagttttgagaatctttgatttcagggatgttgagagctgctcctgtcatctggagttgagtctcacccatgggctacagtgtacacaggagtgggaccttctgttcttgaacttaggctgtggtgtgatcacccttttctctgcatccacctgacaggctgggacttgggctatgctctggacaaggctggctggtgcaatgatgccctctagaggatggatcaggcccagtcaccac

SEQ ID NO: 1005 - DNA, 300 bp, Homo sapiens
gtgaaaacacctagaccaaagtcattctattctgacatattgtctttcttggatatgactttgaaagtaagaattggggaattactggttatacagattctacatttttcttcactaatagtgattccaagaaagtttagatctttccacatggaaaccgtcatgtaagaacagaaaaactctaaggtttatctgctgtgctgctcaactggatccagaccaggtattcttattttaaaagctatatttgatagatgttatattctactcttgcttcaaaacaaatcactttcgacacag

SEQ ID NO: 1006 - DNA, 300 bp, Homo sapiens
gttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctggga

SEQ ID NO: 1007 - DNA, 300 bp, Homo sapiens
gaaaggacccatgatgtaaggatgtttgttgtggggggtgcttgtggctccttaactggctctggaaagagcctacttcccatagtgaaccctgtgaggtccaattctgttcctccccttggagctccaagagaaggtcattgtccttgtagcagcaggtgcccccccaagctgggttctcactgcaggtgccagcgggctctcagtaggtatgacctggatgtgagtggtgagccaggattgaggcactcagcaccttcgaccacacttcccactctccctgggggttcaaggcaggct

SEQ ID NO: 1008 - DNA, 300 bp, Homo sapiens
aacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagc

SEQ ID NO: 1009 - DNA, 300 bp, Homo sapiens
agtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgct

SEQ ID NO: 1010 - DNA, 300 bp, Homo sapiens
tatacatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagaccttccccctaataccctggatgaacttatcgatgaacttggtggccctgagaacgttgctgagatgactggccgcaa

SEQ ID NO: 1011 - DNA, 300 bp, Homo sapiens
  misc_feature (1)...(300): n = A,T,C or G
atcacctgatgtcaggagttcgagaccagcctggtcagcaaggtgaaaccctgtctctactaaaaatacaaaaattagccaggcgtggtggcgtgtgcctgtagtcccagctacttggggaggctgaggcaggagaatcacttgaacccggaggcagaggttgcagtgagctgagatcttgccactgcactccagcctgggtgacagagcaagactccatctcaaaaaaaaaaanaanangganttacntnantttaatggntgnttggnaggttttttgcaaacaaaaantcctttttt

SEQ ID NO: 1012 - DNA, 300 bp, Homo sapiens
cctctgcaaaagtgaaaaggcaacgaaaggcaggagaggagataatcaagcatggctggtcccctcaatgtgtagagtaggggagcttgagctgagggtacagttggtgcccagatgctcagctgcccacctggcttggcctggcttcctccacagtccataccctacctccaggtgcttcagggtccacagccaccccagtgggtgtttgggctgaagtagatcatgtcatgtggatgggcctgtttacgtgatgtgccatggaagggagtggcaggtgggcagcttggagtgaaaagc

SEQ ID NO: 1013 - DNA, 300 bp, Homo sapiens
ctgtgaagtatatgtaacatgagcgagcgctaggggaacgcttcaaagcagtaggcagacatcattgtggagctaaactaagcacagtgcctatagaccagggtgctatgaacaggcggaaagagtgttgacaatcagaaattgtcaatggtaattgcaaataggaagacgcaagggcagaatggcagctgcaagcactgatttgcaattatgccactttcactgggaactctgagtactccagggtgggtagctgctgcagcttgctttcttctaatgaggattaatgattactttgag

SEQ ID NO: 1014 - DNA, 300 bp, Homo sapiens
cagctgtggagctactggcagtcttgatagaacagcagtttctaggtagtgaccagattgcctggaattagtacagtcgaagcggcacgtacaggacaagaattcaagatgcttgacagtggagcacaagggcattagcttgagggacagccagaataaatggaaacttcattatccatggattatgcacttggaacttaggtcctaggcaactctgatattagtaatttggccagcaggctcattaagctcttaagaaaagtgggcctagttaatgaattaacacaagatgacatttta

SEQ ID NO: 1015 - DNA, 300 bp, Homo sapiens
gcgaaacaccactgcaaggtgaacagcctgggttactagcagaaaaacatcattcagtctgtaaatatttatgaagatctgtgagaggcactacccttaccctggagctaacctgtgacccagagagcaagactcttgcttttacagaacacatattcttgtggaatgagaggggctatcatcaagtaagcaaatcattccatggagtgtgttagtctattttcccattgctttaaagaaatgccttttactgggtaacttataaagaaaagaggattaattggcttatggctccacagg

SEQ ID NO: 1016 - DNA, 300 bp, Homo sapiens
aagagcctgtctccacctttcagagaggactgaggcctgtccccagccccacccagggtctcctgggaagaccagcccttccaactaccaacccgttccttttcccagtctgagccacaggaagagcctagcggggaatgtcatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgg

SEQ ID NO: 1017 - DNA, 300 bp, Homo sapiens
gctgactgttggtcatcttgccagatcttgagtgatgtcttttgcttcatcctgctgtgcatcttgcaggaaagtagatgctcttggtcatttgagtaatccgaatcttgttatttccagtcaactcagttggatttctgggatgagaattagaggagtcccattgaaaaactggaatgagagatgagaagtttgctgaaaacagaacatttttttgtgtgtggattgatttgcctcgtatacctgccttgtactttaaccacatctttgcagtttaaaatagaacacattatttcttca

SEQ ID NO: 1018 - DNA, 300 bp, Homo sapiens
gataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgtt

SEQ ID NO: 1019 - DNA, 300 bp, Homo sapiens
tccaaccctggcgatgtcaccagcatggtggctcaggttagagctctctgaggacccagcatagagcactggtgccagggaccaaactgagaccccaccaccgtcatcaacacttacataccataaaggtcttcagagtgccttggccctagacctcccttcattctttgtagagatggaatctaagaatgaaacatctccactcagtcctgcaaatatggaagttcttgagatacctttttttggtagatacttgtgctggtattctgagagtcactttactctgatggtttgcaagat

SEQ ID NO: 1020 - DNA, 300 bp, Homo sapiens
atggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtac

SEQ ID NO: 1021 - DNA, 300 bp, Homo sapiens
gagaatcatgactgctggctgaagcctgcatctttgggtaaacagggcaattaattcccagagaacaaggacatcatggatagttaaggcaaccagataggtgcttatcctctaggtctccatccaaaatggagtaatgacacctactttcgtgttttaagatttaaacgcagtaacatatgtaaagtgcagagtctgatgttcgagtccacaacgatgtaaataatgcaaaaccagtggattactcatgcttaatttatattttacttggaaatttatttcctttttcttggttatctc

SEQ ID NO: 1022 - DNA, 300 bp, Homo sapiens
gcataggcagggctagaatgttggacttcagatctcttacttctgtgtgctagtgcaccattcttagtccagcacagacaattctcaaacagattagcaaaccaccctcttgaaattgcaagaattgttaccatgtgatcaaggcatcataattaatgcaaaccctagtttctagttgggaaagagattaagatggagactttgtagtaaaagatggacatatattttattcacatagcttattttattttgaatgaaagagccaagcaaactctagccttggcctgttcctgaggaggt

SEQ ID NO: 1023 - DNA, 300 bp, Homo sapiens
cagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatga

SEQ ID NO: 1024 - DNA, 300 bp, Homo sapiens
gcttagaaaattaacctttttctattaggctggtgcaaaagtaattgcggtttttttgccattaaaagtaatggcataaaccattacttctattaataaaaccctcaattttcattttcatagcctttcagaatgggagtaagctttgcaatcaacctgctccttcatcttatctgtacacttgataaatctgattcagtggttggaacggaatctgcttttcctgtattggttacaagcaagcactttgcctgggtgagtgtagctgcagtatagcatagaattaagactacagtttca

SEQ ID NO: 1025 - DNA, 300 bp, Homo sapiens
gttagagtaagtaaagatatggttaagaaaagtacttaaatccaagaaagagagtcaacaaatatttataccattctctcattaagtgacactggttccataaatttaaagacagcggttcacccatatctatggttttgcattccatggtttcagttaccacagtcagcctctgtctgaaaatattacatggaaaattccagaaataaacaattcataagttttaagttgcatgccgttctgagtagcttgatgaaatcttacaccatccccctccatccaggctagtacatgactcat

SEQ ID NO: 1026 - DNA, 300 bp, Homo sapiens
gagcagagatggccacagaaagccagagaagctggacgaggcctccttggcaacaaaagagtgacttaacgcagttctaatgtcctacatttttatgctcttatcctgcagttacaggataagtcaagatacacggtctacaaagaaattttgttctaattttataatagtagagatggggtctcactatgttgcccaggctggtcttgaactccagggctcaagcaatccgcctgcctaggcctccctaagtgctggattacaggcatgagccactgaacctggctgtacaaagaaatt

SEQ ID NO: 1027 - DNA, 300 bp, Homo sapiens
cagatatcagggaccgggactaggtgtgatggctcagctccccactacccagacctgggtgagattttaaaatgtattgctcaaacatttatatggtgtttactatgtgccctgcactactctgttttataaatgttacttaatccctatgatagcgctataaggtacttactataattatccccagttttacagaggaggaaactgaggcatggagagattaagtcatttgtcaaaaatcagatctgggaatcctgcctctggggtccatgctttaaaccaccataccatggtcccttg

SEQ ID NO: 1028 - DNA, 300 bp, Homo sapiens
aaaccatccaagcagtttttattcattaatattcataaatacacacagcagcttcattagagatttcaattttcctcttcagtttgaatgtggagtattaggagagccttttgcatgtcaaggtacaggaagcagagatcacccctgcactgctacctacatttacctgctagaagtaaaaattagttaagtggaaatgattatcatatatattttctctcttccttttgaatgtacacaatgtaacaagagtgacagacctgaaattacaatcaccaaacaaacccaagatagttgttg

SEQ ID NO: 1029 - DNA, 300 bp, Homo sapiens
gaaaatataggcctttattgtctttaacattgaagtaactttgtagttttattcaattatgagccagcagatccttagtttaggcccttatattgcatacctaattagaactttccccaaagttcaactgcatgaccttaatgtattggagcacgtcttacaggtggacttaaaactctagaatttcctgagtcgttgttattttccactgaaggtctttccactgtacagcatttcaggcatcatcactatgattcttttttcttgactgttgcttgttttcccactgctcttttcccc

SEQ ID NO: 1030 - DNA, 300 bp, Homo sapiens
tacaagttggattactatgatgtgtctcaagaagttttggctgtttaccttcagcaaattcctgatagtaccatcgcactcaatcttaaagcctgtaaccattttcgcctttacaatggcagagcagctgaggtattgatggaagtgtgtttttaatgtacttcattccaatttgaattactttatactttccaagttattcatgaaactctgttatctgtaactcttgattaatatccctttatcattgccactgtgattctataagaacctaattatatgtttatcaggtattctaaa

SEQ ID NO: 1031 - DNA, 300 bp, Homo sapiens
aagaggtctgctcacctactgctgcccaccctgggctgggcagcaagaggtctgctcagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcg

SEQ ID NO: 1032 - DNA, 300 bp, Homo sapiens
atctagttgaggcaaagctcatttggctatagagtaaatgtaagacttgttacaacagaaatttaagtggccagttcaatgtcctttggctatatttgacctacctttaaaacctagcccatttcatatcagcctcttctgtgcctgggcttgaaatgtctaaagctgccttcgtgtctgggattacaccatgtaggtcagtataaagagggcagtcactcctccatttctcccagcgtgtccagttcagcagatttctaaagctgttaagcagcctctctttttgaccgtcctaaactt

SEQ ID NO: 1033 - DNA, 300 bp, Homo sapiens
tttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattata

SEQ ID NO: 1034 - DNA, 300 bp, Homo sapiens
gtgaggaacgcctagaagtgtgcttgttttcagcctcttatcatctgccggcctgcaccctggtcagaggatcagattctttcaagaggcagtttctttcattcagccttttacttgagtgaagcaggcttgttgggcatcagtgaatatcatgctaagagttccgtagttcaaggagacctagaataagggggaaagcactttgtgaattgcccaagttattgcctagggatatgcatattgggagccctgaggagtggccaaggcaccacagaacagagactcacactcagtacctga

SEQ ID NO: 1035 - DNA, 300 bp, Homo sapiens
gtcggctgccagcaacaatcaccaggtacgtctcacttcctccttctggatgtggctggctttacggaaaacagagcgtatttgtgaaggcttgtgatgcattatagctattgccattccccaaaagcaaaaacaaagttgcttttaggttgttctgtggcatttctgttgggtactaacaaagaaatcacctgttaagcctgataatgactgtttgcaaaatttattataagagaaaaggcagggtattgagggttgcttttagaagtctgtcatgatatgaacacagaccccagaaac

SEQ ID NO: 1036 - DNA, 300 bp, Homo sapiens
aacgcttcaattgttttgtagaaattttaataggaacttcaagaagtaaacctttataacattgtaaattcttacgtacagcatcacaaaagacaaggaatactgtcatatccttttagcaaaatgatattgcctaggttcttgttgcaaaataccacataatgaaatccttcctgttgcatgattaactgggtgagaatatcatctttccttttggtccgtagaaatgtattattcactactccattcttgaggtttgttttttaatttttttggagacagtctcactctgttgcccag

SEQ ID NO: 1037 - DNA, 300 bp, Homo sapiens
gctgggtgtggtggattacacgcgtgagccattgcacccagccttaagggaccaggactttatctttctaccctgctgtaccatctttagctttttatctttttattctcatgcttttgtttcttcatgatgttaggatggctgccataactccagggtatacaccaatcctctaaacaagaaacaaggggttgagacaaaacactctgagaaggttttctgggaacaaaagacctccaagctgactttgcttcataactcattggctcaaactgagctatatgcccatacttagagcaa

SEQ ID NO: 1038 - DNA, 300 bp, Homo sapiens
gtgtttcttctacctcccctgcacaacattgtttatatgccccctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactgtttctaccgcctaacattgcctagcacattcattgcttcacaggcatctgaatatggttttataaaatacattgct

SEQ ID NO: 1039 - DNA, 300 bp, Homo sapiens
gccatgttggccaggttggtcttgaacttctgacctcaagtgatctgcctgcttcggcctcccagagtgctgggattacaggtgtaaactactgctcctggcctggaatccatttttaatgggaagcacaatttcatagttaatagttgggggcaggagcttaagttataattgcagctccactaattcttagaatgaatatagattgaagtcttggggtttttggcatgatttgtgagatgaaattatgtgatagcagaaggaaggcctcctgcacttcatgtttacagtagagtccta

SEQ ID NO: 1040 - DNA, 134 bp, Homo sapiens
gtaaaagtcactctgaggaaggccagaacagtgcagtggctgctgggtttgatgaaccgtactcctcagagcatctaggcccgtggtttttcagctggagctcatctgagcccctgtggggggctgtttaggac

SEQ ID NO: 1041 - DNA, 300 bp, Homo sapiens
gtggaatcagaggtttctggctgactcggtgggtgctttgaaccaggaaaggacaagaaagaggtgagttgcacttggcagttatagtacagctgcctgcctgtggctcttcttgctttgaggtttgctccttcttcagtgcaaccctttgcccagacatccctaatgcccccagctcagagcagcagttggcaggcaggagctttgcagttagccatcggagagccccacagacaggggttaataagtacaaacagtcatcacaattaattcaggccaggctgtgtgctcctggctttt

SEQ ID NO: 1042 - DNA, 300 bp, Homo sapiens
ggaaagccctgcatgacagcctgcatgactgttcacattggttttacacacgctggaaagattgggaatcatggtattctcagagctttggtttacatttttccttgagagaagaacagtggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatc

SEQ ID NO: 1043 - DNA, 300 bp, Homo sapiens
ggtagaagaagaaatgattacgaaaatcctggataagccagctccctttcaaggggatcagtgtcctcagtcccccacccccacctaaaaagcaggtcccattcagcccagccagctcatccctgcagttccatccaggacctacaggtgtcgccctccgcatggcgaggcccggaagggcagctggctgcaggaggcagaggagtctggaccgcctaacctgagcatgtggaaataatatatgtcttcaagtgaactgtctggtcctggagaaataaaataggacattcataagcagtt

SEQ ID NO: 1044 - DNA, 300 bp, Homo sapiens
cccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacatt

SEQ ID NO: 1045 - DNA, 300 bp, Homo sapiens
aaaaggtgaatgcagaggcctggcccagaccccagccctgtgtgtcaatacaacttttcacgttgttacatacacattttccagtctgtgtctccctctgaaagaaaccctgaaattcaggttgctaatagattgttggttgcaagtatgaaggacagaggaggtaagagaggaggcaacttgctaatgcaaaagcagtgtactgaaagtcacttttatttcttatttataatctacatgcacactctggataatagatgacactgctcattcagtactttaacttcaaagcagagagaa

SEQ ID NO: 1046 - DNA, 300 bp, Homo sapiens
gactgacagaggtgccaacatggcattctgtttttgaaaagttacatgacactattaagtattgaaaatgttctaactagaaaaacgattttcttaatcatagtttttattgtggggtgtgtatgtaagttttaacgtgcaaattaacatatagaagtcactttgtgaggtttcatttaaatgtatttctcagattttgctgaatctgtaatagccattgaaatatttaagtaccttggctgttcctggcatcaataaacagatttttctttccctcctcatgccatacaaaagttgaca

SEQ ID NO: 1047 - DNA, 300 bp, Homo sapiens
cactcttttatattagggacttgagcatctggagagtgtggtatctgagggagttcctggaactaatgtgcagatgccaagggacaactgtactattgtacttggaagtactcatggggtcatattgcattgtttctttgagtcctaattctgccaacatggcctggtgcttgcattaatcagctttctaatctctgagtaacaaggcacagtaacaaggagcagtaacaaggcacaaggcttggcacctgagagtggaggtacccaggaggcagacaccataaggcgggaaatggacat

SEQ ID NO: 1048 - DNA, 229 bp, Homo sapiens
  misc_feature (1)...(229): n = A,T,C or G
ccctcacactctgccaggctgccgggagcttgggccaggtctaaggtaatgaggtgctcctctatcctgctggaaaaaccggacagactcagaaccacaaaggcaggtgctgccagcctggcgccttcctctctgcttaggctggaatgagcttgtacaggcctgtgcctcacccnttctntcttctaggctcanngnatgcttaancngggcnnggtncacggcacct

SEQ ID NO: 1049 - DNA, 272 bp, Homo sapiens
  misc_feature (1)...(272): n = A,T,C or G
cccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgcnganattggacnttgggcatntcagttctnnnagatgttggtttggcgntatntcttttntt

SEQ ID NO: 1050 - DNA, 300 bp, Homo sapiens
ctgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctct

SEQ ID NO: 1051 - DNA, 300 bp, Homo sapiens
atccttcccactttgtatcgacaacccggttggtcccggcgtctgagttcttggtgtccgagtcgactcgaggcacaactagggtttggggttccggatatcgcctaggcccaacatcggaccgcgctctcgatttctgccgcgtcccgcctctaggacgcggagtccgtgtgcggttccgtgaggctggagggtagatcttaaggatcaacaaacagtaataatgactgaatgtacaagtcttcagtttgtcagcccttttgcttttgaggcaatgcagaaggtggatgttgtttgcct

SEQ ID NO: 1052 - DNA, 300 bp, Homo sapiens
attagtgataagtatatatggacatctaagggaacaaagaaactaacaaaagacaagaattttcaagaaggaaaacaaagaaaaaaaggtaatcagggtatgttacatagtttagctgcttatagtttttctttggttctgctcatggaaacacaatgactatcaatctaagtaagactataatatattagaaggatgggtgatgagaagtgtgaagtgttgcaaaggtaaatccttatcttccgctatgaagtatcaataagcaatgcccaaaaaaatgaactattaagaagtaactgt

SEQ ID NO: 1053 - DNA, 300 bp, Homo sapiens
acatctccaagcagggacttagtagttataggtgggtcttaaggattctccagtcagtctttaaactgctggcaccgaagcctccagtgcctttctcctctatatcccatagagagttactgaagtagttctttttggatttcagttggccttttagtagagcctttctcctaaaggattaaaacgtgagactgcgggcttgagccaaaaagcagtcagagggacaaatactgggttttacttagaataacccacctgcctagtgccagcctaccactcttgaacaaaacttgtatgatt

SEQ ID NO: 1054 - DNA, 271 bp, Homo sapiens
  misc_feature (1)...(271): n = A,T,C or G
gcagaaacaatagtcaggagtttgagaacaggctgattaacatggtgaaaccccgtctctactaaaaatacaaaaattagctgggtgtggtggcgggtgcttgtaatcccagttactcaggaggctgaggctgcattatcgctttaacctggggggcggaggttgcagtgagcctngatgggggcaataanagcnaaactttggctcaaaaannanaaaataaatanncnatanaatatgcnaagccccttntcttccngnnncctctcgg

SEQ ID NO: 1055 - DNA, 300 bp, Homo sapiens
gacacccagtttaagggacattctgtacggtgcctgaatggcgctcctgaaaactgtgcaggtcctcaaggctgaggaaagcgtaaactgtcccagaccagggaggccaaggaggcgcgatgactcaatgtcatgtggtgccctggatgggatccagggacgggaaaaggacacttgggaaaaactggtgaagttcacgcaaagtgtccgggttagttcagcatcagaagaccaatgatggtttcttggttgtgacgaaaatgttccatggtctgaaaggtgtcaacaccaagggaagct

SEQ ID NO: 1056 - DNA, 300 bp, Homo sapiens
gctacgtgggaggctgaggcaggagaatctcttgaacctaggaggcagaggttgcagtgagccaagattgtgccagcctgggcgacagggtgaggctcttgtctcaaaaaaaaagtccacatcttcatgaaccctcagactctggagttgggtgtcggcttttttagccagcttttgttccgtttagtgagaacctattaaagaaggaaagtgggtaatggagtcccagccactcaagagactggatatcccccgagaatggcttgggttaccagctatggacccttggaagatgaatct

SEQ ID NO: 1057 - DNA, 300 bp, Homo sapiens
tcccgggttcatggcattctcctgcctcagcctccagagcaactgggacaacaggcgcccgtcaccacgcccagctaattttttgtatttttagtagagacggggtttcaccgtgttagccaggatggtctcgatctcctgaccttgaatcacaagagtcttaacagggaatgtttcaggaaacaaataggataagacaatgccagaggaaggatagaaacatgggaagtttctatcatttcattttctgcgtttccagcatgcccttggaaaagactccctttagtccctttttcaatt

SEQ ID NO: 1058 - DNA, 300 bp, Homo sapiens
gagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccaggga

SEQ ID NO: 1059 - DNA, 300 bp, Homo sapiens
ctgaaattgaagatgttggttctgatgaggaagaagaaaagaaggatggtgacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagt

SEQ ID NO: 1060 - DNA, 300 bp, Homo sapiens
cccggaagcatccaggatgtgggaacattgtgacatttgcacaatttttatttattgctgtggaaggcttcctctttgaagctgatttgggaaggaagccaccagctatcccaataagggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtg

SEQ ID NO: 1061 - DNA, 300 bp, Homo sapiens
cctgtgtccagcgtcctcggttcaggggaaatgttttggtgttcatgagtagtatgtcccccagtgccccattgtgtgggcgtcctcatggggtatccattcttctaggaagatcctggggctgtttccagttcgaagccattattaataaagctgcaaggaagaaatatttttatggatgtgtgtttttatatctctgataaatatattcaactggaatcattgggtgtattgggccattctcccattgccaaaaagaaatacctggccaggcgcagtggctcacacctgcaatctcag

SEQ ID NO: 1062 - DNA, 300 bp, Homo sapiens
gcatagttggaagttaaggttgaaaagagagataggggaaaacaggtggaataatattgaaaattggatcaagaatataggtgtaggcgttagccattttatcctgggagaagggaggaaatgaaataaaaacaggaatagatagacgttttgaggcgaaaggaatgaatccagcatgctctgtttagtgatgtagatgagatcacctgggaaggcatgaatgggcgggctgagtggggtagtgacttcagaacagtaataagggttgaaaagcactgctgtgtgagggggaaggaatgt

SEQ ID NO: 1063 - DNA, 300 bp, Homo sapiens
atccgcctcccgggttcatggcattctcctgcctcagcctccagagcaactgggacaacaggcgcccgtcaccacgcccagctaattttttgtatttttagtagagacggggtttcaccgtgttagccaggatggtctcgatctcctgaccttgaatcacaagagtcttaacagggaatgtttcaggaaacaaataggataagacaatgccagaggaaggatagaaacatgggaagtttctatcatttcattttctgcgtttccagcatgcccttggaaaagactccctttagtcccttt

SEQ ID NO: 1064 - DNA, 300 bp, Homo sapiens
gatgcatgaattactgcattaaaattgatttatgggaattattgttgtttcagtagcatttcaattcagttgccaaatagagcagtgggcaatgttaacggaaacaactgcaattggcgcagtatggagtgcctatcgcactaggaaatctgagggtcacaaaagaaaggagatgtgaggataagaaactttgtttttcccttgttgggaactctttaggcctcggtttctggtgacagccccagggatcatcaggcccggaggaaatgtgactattggggtggagcttctggaacactg

SEQ ID NO: 1065 - DNA, 300 bp, Homo sapiens
ccttgttaaaaacatatgtgcttttccactgctaacttcagacccacactttgcccgcatttctgcagatcatacccctagcccaggagcctcccgcagacttcagagcctgctgtcctcaccagcgcccccacatggccggtctgagagcaagtggagagtcacagtcacagtcacagtgcccaacgcctccacctggtcctgacgggtccccaggggacaccatataaccttagtcatgtctcattgcccggaggaatcttcccccagataggaataaccttgtaaaaaagatttgtg

SEQ ID NO: 1066 - DNA, 300 bp, Homo sapiens
cagagctggggcatggcatgtctcaggaagccatgcttgtcacagaggaatcactccgaggctaaaggaacatctgggcaatcctacttgtgtactcattggattcattcagtgaccttgttattatccttctagctaaatgctctgggtcttaattcacgactccaaggttgctcttgattttaaggaacattttggcagaatagagagaagttgagcaaatattaacagatgtccaaaggggcagtgtgatttattatgtcaagagaatcagttttatgtcgagggaagaattttggt

SEQ ID NO: 1067 - DNA, 300 bp, Homo sapiens
aagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtg

SEQ ID NO: 1068 - DNA, 300 bp, Homo sapiens
aaaacatcagggaagctgtttgatagcagtgatgatgacgaatctgattctgaagatgacagtaataggttcaaaattaaacctcagtttgagggcagagctggacagaaggttagtgaagactgaaaataattagacttgcagcatgtccttattttttgacatagtccttaaatctgggtaaatgcaggcagaccttaacctacattatagcatcggggtgtttatttggagagtgagtcttctgtgatcctctctgattggttcataagtagatggaggtaggcaaacatcttaatg

SEQ ID NO: 1069 - DNA, 300 bp, Homo sapiens
ctcctatattcctgtcctgtagtggccttaagaaatgttcacatttgcaagctgcaccagacaccatcagatctggttctctccctggggcccaaggatgctcttctttttcatcttttattttgatcatggaggtgttttcacagagtttatccccagtagtaaattacattccaattctgtgagtcagaacaacgttttaacatgcacaccaacgtccgggttgctgttttgctaccagttttgcctggggtgcaggtatttttggagatgggtctaaaacatctcaaaaccacatga

SEQ ID NO: 1070 - DNA, 300 bp, Homo sapiens
gtttcactgtgcggtgcagtgcggcggcagctcgtgaggaggacccgtacattgacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctgtaagcatccccttgccccaggcattcctgccagtttctggaatgagttgtaactggtatattttgtgtttatcttt

SEQ ID NO: 1071 - DNA, 198 bp, Homo sapiens
ggaaaactgctaaattaaaatactacattttacggaaactgtggagctgcctccttgatagaatgttaggtctgtttttgttgtcttctgcctatgtctcttgacttgcagtttcttttgtttcaaatcactctgccctcgtatatactttggttagactacttttggtgaagcactctccaatagaagaacataatg

SEQ ID NO: 1072 - DNA, 300 bp, Homo sapiens; identical to SEQ ID NO: 602

SEQ ID NO: 1073 - DNA, 300 bp, Homo sapiens
ccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaacatgcccagggattgtctatttccctcctctcaacaa

SEQ ID NO: 1074 - DNA, 300 bp, Homo sapiens
gttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagg

SEQ ID NO: 1075 - DNA, 300 bp, Homo sapiens
ggcacccccaagatgttttcttcttaattattcctaaatacttttatgtgttggcattaaattgtaactttataggctcccctattctttttgcttttttttccccctgaaattactgagcaacaagattcctgttctctccccttcaaggctttgttttctggaacttgacattctcaaatcattgccagttatttttagtacgtgattagtctcccttcctcaggtatgttttccccaatttggattgaatctactgtttgcatcttgtttcccatcccaccttcatacagattgtat

SEQ ID NO: 1076 - DNA, 300 bp, Homo sapiens
tgctaattcagccctaaaccccatcctctacaacatgacactgtgcaggaatgagtggaagaaaattttttgctgcttctggttcccagaaaagggagccattttaacagacacatctgtcaaaagaaatgacttgtcgattatttctggctaatttttctttatagccgagtttctcacacctggcgagctgtggcatgcttttaaacagagttcatttccagtaccctccatcagtgcaccctgctttaagaaaatgaacctatgcaaatagacatccacagcgtcggtaaattaagg

SEQ ID NO: 1077 - DNA, 300 bp, Homo sapiens
taagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactg

SEQ ID NO: 1078 - DNA, 300 bp, Homo sapiens
gtcagatgtttctggggacgttgagctgcagtgaagtgagaggggcagagggggcttttgaagtcacaaggtcagggagaggagaagaagcgtgctggatgagtcacactgtaggactcaagccagtaggttcttgttagcccggctactgacctggagccaggcactgatagcaacgtgtcctctgagggaaggcaaatgggaaatccaagcaggcactgggatctgcctgtgacactcttgtggggcctggtccctcgacctaagtgagcttgggccactcagagccaccccaggtgc

SEQ ID NO: 1079 - DNA, 300 bp, Homo sapiens
gggcgaagaaggctggttgggaaggagaccagcataaacactttggggactgagaggataagccatatcattagtgaccctcggcagaaagaaaagaataaagcgttggcttctgattttcctcacatttctgcttgtgcacatgagacaggcaaatgtacactggggaccaccatgttcacgtgacatcaagaggaagcggaaaccagtggccacagcatctttgtctagccccagtgcaggtggtagaaggacagcccccctgccctgagacaacactcggaggcctgtattccagcg

SEQ ID NO: 1080 - DNA, 300 bp, Homo sapiens
atagttttatgggttctgagttggtgaccagtaagttgcatgtagtgctggcacttacttaataactattcatgatattgttaataacttgttataggattgtattcccaattacagtctctaagattgtaattgatattatctgagaggtagtgtgacaactttcttttgttgttacattaagccgaaaacataatactaatagacaactaacagtttgcttatcaggcacatcaactaaggcacctccccccatgctaagtttctcctggatataatgaagttgattgtttcccagtt

SEQ ID NO: 1081 - DNA, 241 bp, Homo sapiens
ctttgcagccttttcctgcccttaaatttgatacctttggtgtaggagctgcataagtaacagttgctgcttttacgtttccacgcgtgatcttgaccctgctagcctgaagtgtatggtttctcttagccagttctaatttttgttcaggtggaagatggatgcctgaagtgtagactgctgctagctgaataccatctgggagcataaaggtgacctgaaggtagggtgatatgtctta

SEQ ID NO: 1082 - DNA, 300 bp, Homo sapiens
aggatgttgctgctgtgggccgcaagggtcttggtagcttcctctagggcaggcttgtgttcctgattggggttgggatgggtgggggcatcccctgtggcctcagcaatccagccctgcgcatctgggtcccattacacagacgtagacattgaggtctagttagaaggacttgccaggagtcctgtaatagagcttggcacttgggtctcttgactctcagggactgggtgtgagggaagtgggctccttttgctccctacctgcagtgcctttgaggggatgagggtcttccatcag

SEQ ID NO: 1083 - DNA, 240 bp, Homo sapiens
gcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacactcccagacatgcc

SEQ ID NO: 1084 - DNA, 300 bp, Homo sapiens
cttggaggctgtttccagctagagaaagacctgcttatttctcactgaataaggttccaacaggctgccaaatcctgtgtatgcctgtacccaaatggaaggagtgcctttcctcaattcataaaaaagacaaagacagtggtaggatcagctattatgtcagtacatgaaaggaaccccctatctcaatcaaaatggtaaaggaagcttgtctcaaataacagcagagaaactcagtttaccagactataaaagttctttggtcaagaagataaagagctctccagaataagaatacct

SEQ ID NO: 1085 - DNA, 300 bp, Homo sapiens
gcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctg

SEQ ID NO: 1086 - DNA, 208 bp, Homo sapiens
aagagagacagggagaatccgaggtaaaactgttaggaaaacttaggagtccagatgctgtccagttatatgctaccctgtacaggttgataggttgcaaatgctttctgtccagtgtatcgctttgtagctcactaagcagttttgtatccaactttgtgcttttatttcagtgtttttctttttctttctttcttttttttttttt

SEQ ID NO: 1087 - DNA, 205 bp, Homo sapiens
tagggtcttagtactggtttgggcataattatactcagtgtttgggcctctgctaaaattctaagacgataagaatatcagtttaagttctgttacagttgttttcatgaagcttgtaagattgatatttaagtggacaaagtgggaagtagtcagttttcagggctacaggggtcatcactttgtgctcagagtacagctggca

SEQ ID NO: 1088 - DNA, 300 bp, Homo sapiens
tgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccat

SEQ ID NO: 1089 - DNA, 300 bp, Homo sapiens
tgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgaga

SEQ ID NO: 1090 - DNA, 300 bp, Homo sapiens
ataaaggcctagtttttgtatcccaatagatttttaccaagcttcccctgaagaaagtttagaatgagcatgatgggaaaagggagaaattgtatgctgcagatagagggaggaaaggccaactaggtccaacaagtaaaaagaggactagtctcaaactattaaatatatgatttacctagcaaaagctttaagtcacagctgaattacactggggaaacaattacagactttacaatggaaagaagcatcttcaatgttggctgcaatcactgacagcaggaatactcacttttgaaa

SEQ ID NO: 1091 - DNA, 300 bp, Homo sapiens
gcctggggcccttctagcctgagctggtgacctgggcatctgcaccctaaccccagctgaccgagtcagatctttgtccagtgttctgaagatcaaatgccgtgcccttttgcaatataacaccagctgcttttagtccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgcca

SEQ ID NO: 1092 - DNA, 300 bp, Homo sapiens
gttgccaaggattctattgccatgtgttgaggagtaggagcaaggagatagagcaggaccaatgttacaataagaacccactattaacccccaagaatctgtcttgtgagggagataaatagttatcatacatgcgataagtcccacaccagcacatgaaaagattagaagaacaagagaagggaagaaacctactgacctgtttcagggtgggatgcttcataaagaggataacagttaagccactaacagtaatgcctctaatcttgaatctgttacctactagttttgtgtccctgg

SEQ ID NO: 1093 - DNA, 300 bp, Homo sapiens
agaacctttattttaacgtttcccagttgcgactatctctttggaaatgtgcataaataaaagccaagtcctaacagctgcagcgggcattgattggaacactgactcctaaaaattttatgcgtatattctctcatttatttccatagaaggtgaggttaaattactcgctgaagttcgcacatttagtaaatggagatctgggatgcaaatccgctatgcctgaccgtaaagcctagttttaccctttacattttgcctattcagctctctctactccttggttttgctgataaagag

SEQ ID NO: 1094 - DNA, 300 bp, Homo sapiens
actcaaaagcctggaaaagcaagggcagccctgtccagctaagctccccaccctctaccctgggagtgtttgtccgtgggccctcaggtgccgctgtgacctcttccccctagaagctgacacactgagtcctcttagcgctctcctgtgatggggaagccgggagagaatgggccctgaaaatcagaactagaacatagaatcctctctatcttcttcaacagaacccgcaaagctatcaagaaaatgcatcccaccatattgcacatctgaaaattgtctttcttgctttctgatagt

SEQ ID NO: 1095 - DNA, 300 bp, Homo sapiens
ggtgctcggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgat

SEQ ID NO: 1096 - DNA, 300 bp, Homo sapiens
atttagtgagatttgtattctaggaagtgtgtgccgtcacttgttcatttacaactgcaaagattgtatgtctcctatgttttcctttcatgccaaagaaactcaccctttttaaaagccagcaggttgcacaaaccaaaaacaaaatattttgccccttaaataggcattttaagaagttttatttcctggtacttaaatattgtgtagagggaaagctagttgtaataatttgtaaaaatgcgtgtatttttaggaatgcgctatttccagtaagggaagtattgacatttttaagga

SEQ ID NO: 1097 - DNA, 300 bp, Homo sapiens
cccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatgg

SEQ ID NO: 1098 - DNA, 300 bp, Homo sapiens
gtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccc

SEQ ID NO: 1099 - DNA, 300 bp, Homo sapiens
gcaacacaaactgaatttccttattgctgatagctgcctgtagaggggtggtcaaagagactctacctggaaaactcttacagaaaaacattattgaataccctcttagtttcagagtttccagtctcatttctccttaaatctattcaccaaaacaccaccagtttcccctaccacaaacacacacataagtacacactcacctattttcaccttctcttccacttccacctttgtgttgaacctgattaaactctgatacttttaactccaaaatatgctatgctcttattaacaact

SEQ ID NO: 1100 - DNA, 300 bp, Homo sapiens
gtctcgagtttgttgttttttgtaatccgttttagagtgaattaaactcagacatccctggattgtatgctgtctgtagaatgttgattttcaggcacggggatgtagctgtagaatgtggcttgttcattcttcctgataagaaattgatctcctgaatggattggccatttggtaatttcttagtgaaaggctgactcttgaatatggctgttataatataaattcttaccaacataaagtaagggcttatttggggcttggtaaaactgtcatgccttgaagtatatatagcttata

SEQ ID NO: 1101 - DNA, 300 bp, Homo sapiens
attgaattttctgataattgaagcttattaattgtctaaaattatcttaagatattctctgatgtacatcattttaaaatgagttgcacacatttctattctgtttcaacatattcaatataatcttcgctcttgttcatctgttggtattcattatataattcagacgtggtctcaggtctggagacatgtgaagttattgctcctacactgagtgtttccatgtcattatgccttaatccttatttagacacagctatgataccctctttacaacataaaggataagcagaaggatgt

SEQ ID NO: 1102 - DNA, 300 bp, Homo sapiens
cacaagaaatgaaattaaaaaataaatcaagcagccatatgctcaacttcattggaccactgcaatcctggtgacatattgagggctgaagaaacccattgcatatagtcctcctgtcactggagatatgtgtggtaagaaagagaaatggccacgttgcaatagcagtgggaagcaaatgcagaaagcacccaggaaaggggaagatctaggtgacagaggccatctagtcttttggattcatctggttctggcacacagagaatggagcttttgtggcaataatttctctactgatgt

SEQ ID NO: 1103 - DNA, 300 bp, Homo sapiens
aggtgttgaaattacagaagggaccatttctggcaacacagcagaccagatatcctataaaagtcttccattacagaacacctacacatcaggagctcaaaaacagatatattctttaaatgtctagccaacattttggaaaagtgtgggaaatccctcagggccaaaaccagagggagttggacaccagagtgataagcagacactgaaggcaaggccaacctcagggcttggctcaatattctagaactttacccttgttctcaagtctccgtgtggacaggggatgagggttacctg

SEQ ID NO: 1104 - DNA, 300 bp, Homo sapiens
cttggccctgctctgtttaaagtcacaggaccataatcttctgaataccaaatctaagactgcctggtacaccccagaggtatgcatgtgcctaggagacggttagttactctgagttatgaggagctggggtgatgattttaagtattcttgttctgggaatggagggtatattctccattttgtgaaattcttggactataggttacattccattttaagctatcacccctcagcatcaccaccatacttgactaaggtgggactgtttgcatagggtaattttgggatgggggaaag

SEQ ID NO: 1105 - DNA, 300 bp, Homo sapiens
tgggttgactcgctacatcagctcagacttggctgtgggtaaccccttgtgaattgttgtttccacatgtgtgttgcttcatttttggctctccgttgtccccatcaccttcccgtctcaccatagggtttagggtattttgctgtgtgttcaaatagaacatgaaagaagccttttaaaagtatttctgtgcctattcacagtcccctaaattttattacagtttttacgttggtttaaagagtattttggtttgatttatatggaaaacttcttttttaacattatagtaacatagat

SEQ ID NO: 1106 - DNA, 300 bp, Homo sapiens
ggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgtcatgaatcgacctccatcctgagctctccaggcctgggacaatggaaagtggatagggggctgtcttccca

SEQ ID NO: 1107 - DNA, 300 bp, Homo sapiens
gagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattgttttctgatgaagaaaccaaggctttgtgactaactcaacccctcaagaaggacaaaactagcatcagagccccttgcttctgggtctggcaagaatgcctcttgtttgctgagaggtccacagatttacccggctcaag

SEQ ID NO: 1108 - DNA, 299 bp, Homo sapiens
  misc_feature (1)...(299): n = A,T,C or G
caaagacccttccccagaggcctaccccccatatgtcctcagagaggctgagtgtcccctccaggcagtcatgggccctgaggcccctcctgcctggccctgctccccagtggggaggtgactgcgtttcccagagtgtgagccgctctcctccccctaaaaagctgactcactgtgagtgaccttgggcaagntnccaaancttnttgagccttagnttncncatctggaaaaaatggggccanctcttgccannagtacagggctgccnatgcccntntctctncatgcnccatcca

SEQ ID NO: 1109 - DNA, 300 bp, Homo sapiens
  misc_feature (1)...(300): n = A,T,C or G
ggcagtgctgcgcggggctcccagccctgctgggaaggaccagggaaccactcagcaattagaccctcttggccctgcccccaccatgcacccagcagccgggagtgcagcggtcagcctggcagtgagtgaaacccaggccttcagccctccaaagcctggggccaccccctgtagcaggcgatgctagaataaggaggagagccagagctgaggctccttgccccttggccccttcaggggccatgggatctctgtctcccacacccctgtcacggnccgcctggancancccatagg

SEQ ID NO: 1110 - DNA, 300 bp, Homo sapiens
ccaagttccgcggccaccagaagagcaaggggaactcgtacgacgtagaggtggtgctgcagcacgtggacacgggaaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctga

SEQ ID NO: 1111 - DNA, 300 bp, Homo sapiens
attctcttagtgatgggctggaggaagtccaaaatgcagacatgaaagcttacatggaattagtcaactatatgctgttgactgcagagctgtatcttcagaggagtgatgaagctacagtaggggagatcactcatgctaggtatggatctccttacccttggcctctgaatcatatttatggcctatcagaggcagggggaagtcaaacgtaagattaaagctattggatggggaaagaagactctggaccaagtcttagaggatgtagaccagcgctgtctagctctctctcagaga

SEQ ID NO: 1112 - DNA, 300 bp, Homo sapiens
gactagcacatggcaaggtcaggattcaagctaggtagtcagtatctcagccaggctgtctcctggctccctgaacattatggtgctgaccacaaactttcctgtccacttatacaaacttctagtgagtgtgtgtgattactagcttcatgaatacctgacccctccactctgaaggaggaacaggcctgtctggatcacttctctgtccctaactgagcccatctcatttagggaaactacagagcactgttgctttttttttagatggagtctcgttctgtcgtccaggctggagtg

SEQ ID NO: 1113 - DNA, 282 bp, Homo sapiens
acctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaatgtcacagttcagttgccttattcctagttcaggcttactatctagaacctcatgctagcttaggttgcatgtttacattgctgcatgagtctttactggaagcttagttggatcgaaatggac

SEQ ID NO: 1114 - DNA, 300 bp, Homo sapiens
ttggtgtgtaaataaaactttagaaagggtctattgaactttggacaggcaagctccatgagctctccctcactctttgaggcaggttaaagggtacggccatgaccaccaccttaatccttcagggactatttacaaaagattgaaaaatgtgcccagggcccgtacctgcccctctgtggaactagcccaactcaagtgggctggcaggcaagcctggctttcatggggacagaagagagagtttgcggggagcttggcatttttcaacacatgctttttggcttctcctactgaatt

SEQ ID NO: 1115 - DNA, 150 bp, Homo sapiens
gaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaag

SEQ ID NO: 1116 - DNA, 300 bp, Homo sapiens
gtaccacatctagatacgaggtcagagttcagatgcctaaatattgtagcttgtgttttgtccactgttgggggaagagtgaagagatttgacataccataatgttgattagcttgtgatggtttggcggcagcttaggccagagcataaagtaaaaaggaaaagtgttcacagacaatgaaaactgggaccaagtggtgaatactcaaggcacacagaccaggcaaggatcccagtggccgtggatgagtctcaggctggctctgggccagtggaacacacctcagtgtgggtgaaggc

SEQ ID NO: 1117 - DNA, 300 bp, Homo sapiens
tctagatctcatcggagatttggacgggaaaggggttgaaagagttccccaaagccccggctaggcatccagcctcagccatgggacccatggcctctctttagtgaatgatgcgccacaccagctgtatcacccccaggtgtacctgccatccttccattgcgcaaatgtggaaactgagcctgggggtaggggtgagcccttttgagcagcaggtggtgtctggggcctgggacctgtaaacaaatcctcattactcccagcctggtctctgtgcttgatgtttagtactagaagtca

SEQ ID NO: 1118 - DNA, 300 bp, Homo sapiens
ctcaccaagaacacaaataaacagttgatgaatccatcacatcagtgatgaatccagaatgtgtccatcattttcgtaagtcttagtatgcagagaatctcagatagcaaagcagaaaggatgatgtcacagacgccttgggtacccagcacctggatgcagctgtttgtacacacatactttctgatattatgttgacagtgacttacaccacttcaacctcaggcaggattctatcagtttctttactacagattgatttgtttctttaataattattgtaattactgtcagtaaaaa

SEQ ID NO: 1119 - DNA, 300 bp, Homo sapiens
gatagctatctgacttctcaactatgtaataagcagatgttgtaaatcctatgctgtagttcatgaatctatatgacatgtggggtcgggaacatagtaccctaccataagtcaggttattcctactattctgcaacatgtaaataacactttgaacagagcaagtggtaaagattgcttaatttttgcatgactattttgataaatatgttgagaaggaccagctcaaaggaaaacctcttggtaacttggcataagttaaatgtttcccaagaaagtgcactcttcccaaataaagct

SEQ ID NO: 1120 - DNA, 300 bp, Homo sapiens
tggaaaatataaaaagtgacactttaggcaaatgtgatggcctccgagctgaaatgaaggaactggcaatctttccaaagtggcagccaaggccccactccctgtcctactcaatctctgcagggaaaaactgtgggataggatagcagccagctggggacacacagaggaacattcaacaggaaggtcccgcctagggaaaaggccacagagcccaggcctcttgccgattcagggatccttggatataagtggattagaggagagggaggaaagctatcatttcagtggtctccaaat

SEQ ID NO: 1121 - DNA, 290 bp, Homo sapiens
gcaagactgagggaggagggaggtttgagcagctgtaatgggtgagggaagagagtgggtgggagaaaggagatttgagaagcatcgctatgatccatgaatctttgtagtcaagtttaagaaattcaagtaaacagagttattgtgaaattattattttttggttgctattctctctctcctctcccactctgtctctttttttttctttgagatgggatcttgctctgtcgcctaggctggagtgacgcagtggtgagatcatagctcactgcagccaattttttttt

SEQ ID NO: 1122 - DNA, 300 bp, Homo sapiens
agggagggagggggcaggacagtgtggaatctctagggtgtatgggtaggtagggggcacagttagttctaagtgggcttttatgctaaaagcctctggggatatctgttttgaaaataaagataggtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtg

SEQ ID NO: 1123 - DNA, 300 bp, Homo sapiens
  misc_feature (1)...(300): n = A,T,C or G
cctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggagnggcagagcctggagcctgcagctagcagtgggcccctgcctacagactgaccacgctggctattctccacatgagaccacaggcccagcca

SEQ ID NO: 1124 - DNA, 300 bp, Homo sapiens
gggtgacttcctgtgacctccaaaggaagtctcagctctgctagaatgggaccaaagcccagctccaccttgaacttgtgtcatagccttgcttcttgttccctctccttagccgggcagatgccttgtcctttgataaaggcttcctgtcacctcctgagggctcttgtgctttttgcaggtggatgccattacctttaccgctgtgcctcccgcaattgctctgttcacacgctgtccgccatctgcctgcaagggcccaggcagggtcttactcatcattatgtcattgcttcaata

SEQ ID NO: 1125 - DNA, 287 bp, Homo sapiens
  misc_feature (1)...(287): n = A,T,C or G
ggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgttctgcctgccntnttccanncctgannnacntacatggaatccctananttnttnattttttntgnananantgnggngttttatttttttnntntannngnnttnttaatgntntnnantattatcntntatnnctttttttt

SEQ ID NO: 1126 - DNA, 300 bp, Homo sapiens
ccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccatt

SEQ ID NO: 1127 - DNA, 300 bp, Homo sapiens
tataggcatgagccattgcacccagcccaggtttttaataagatgaaaaaaatgctgttataaaaagtgaaaagaggccaggtgtggtggctcctgcctgtggtcccagctactccggaggctgaggcaggaggatcatttgagcccaggctgcagtgcagtggcacgatcacggctttctgcagccttgacttcctgggcggcagacggagaccctgttttttaaagaaaagaacagagtacaaaattgtatatgctatataatcacaactataataaatgatctgtagataaaatgag

SEQ ID NO: 1128 - DNA, 300 bp, Homo sapiens
tgtggccccaagagtgggaggagtgggctgtcagtaggccaccaataaatatctgtgttttggctgacccccatatgctaggatactggagatgaggaactggagaaggtgcttaaagagcacatctgtctggtagaggacacagagctgtccttcaagcatttgaacgatgttctcatttccctggaatcttctcctctccaggctcacatctctagctccttcaatgattcctcttgcgacatcattttagttctcttccccaacctagtctttttgcttttaatgaatgatcactga

SEQ ID NO: 1129 - DNA, 300 bp, Homo sapiens
catccctgacagttggataataggttccaggaagttcagtggaaaattaaaacaaagcaacatttatagctgattgaacttgaaaagccattttggtgttgaatggcaaatatgtggacttcagcattcctggagcctgatgcatcccgctggatggccctgttcctgtgtacatgatggcctggggactcagcagtgtgcagggtactctcctttagagggtgctttgaggaaagaagtttgctgccacttacagaagtccccttcccatacagtgatataacacaagtaccccatgtc

SEQ ID NO: 1130 - DNA, 250 bp, Homo sapiens
  misc_feature (1)...(250): n = A,T,C or G
gagatgctgaaggaaattatagccagaggaaattttagactgcagaatataattggcagaaaaatgggcctagaatgtgtagatattctcagcgatctctttcgaaggggactcatacatgtcttagcaactattttagnccatctcngtgacatggncttaattcacncgtgtntaaagtgannacntcttggaanatggatnctanangannatanggcngctttctactntnnnantnttnnngcta

SEQ ID NO: 1131 - DNA, 300 bp, Homo sapiens
attttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctgga

SEQ ID NO: 1132 - DNA, 300 bp, Homo sapiens
gttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagg

SEQ ID NO: 1133 - DNA, 300 bp, Homo sapiens
ctccagcctggggcgacagagcaagactctgtctcaaatagataaataaataaaaatacaaaaaaaagaaactcaaggtacagtggtgggagtcaaaaaagcataaggagaaaaccaagactgaaaactgttattgagcttagtctgtgcctagttcagtccctagcattttacaagttttctctgagttaacaaacttgtgggggaaactgaggctttcagatgttgaataacttgtgtaagttgtagagcaggttcttttccatagttccgcattttttacctgcaatacagcaatgc

SEQ ID NO: 1134 - DNA, 300 bp, Homo sapiens
gtgctgtcttgcgcttgcgcgtggcctcccaaacccctagggatacctggggccagctggggcagtctctgtctcgacctccttttccatttctggctagtttaccgatctgtttcatccttaggccagctgatgaccttggccctctcctcccgagatccctgcagcttccaacagtgaggccctccagcagtgaggctgctgattttcatggcctggctggagctgggggcccaggccaggagcagccccaggcaaaaatcacctcccgctgctcttccctgccactcagtacttttt

SEQ ID NO: 1135 - DNA, 300 bp, Homo sapiens
gtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttg

SEQ ID NO: 1136 - DNA, 300 bp, Homo sapiens
gtctcgctttgtgacgtagcctggtcttgagcgatccttttgccttggccttgccaaagtgctgggattggaggcatgagccactgcacccacccctgttttttatttaagtaaaccattataataactcatttataaaaaggttacttcaagagggctttcaacttaagaattattttcattttgaacatgaaaagttaaatagtaactaagaaactgagaactctgacagtgacctctaataggtaactttaggcaaaagtagacaagtttgtgggtattttgttgttcatgttaaaa

SEQ ID NO: 1137 - DNA, 300 bp, Homo sapiens
gtttatgaagaagctgtttcgtgtgtacagttgctgctgtaatttagccagcagtgccctgccctgccctgcagtgtctgcacagctcccactgcttctctttgctgttgggcacgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttg

SEQ ID NO: 1138 - DNA, 297 bp, Homo sapiens
  misc_feature (1)...(297): n = A,T,C or G
ctgagatcggccactgcactccagcctgggtgacagagtgagactccgtgtcaaaaaaaaaagtccnaaactgtttgncttnattnaggcagnaaatattnnanttcggnatgacctgncatgnanccagtaaggcctttacaaatnacatccnaaacaaatacanntcanatgancaaantanggcccaaatgaaatgacntctnnntctntgctatggcngaaactnatnangacntatggaatcanagatagctaaagttcattatttaaagctntactcccatgagnattatg

SEQ ID NO: 1139 - DNA, 289 bp, Homo sapiens
  misc_feature (1)...(289): n = A,T,C or G
atccagtaggtcttggggaacatgggaatctgcatttttttttttttnacngcnttgctgttcatcatcaagnanttcaggncnctaggggnaaaaaacttntttnaaaatgagggagngnttngcancntnngtnatttcnttttnaatngaatnngttnttntnaaatnccaggaccaagnnccaaagtcancagtaaaattcanctgngtncnttttnaacgacctgnaaaataagtttatgaccnctntncggatncaaatngtncaaaacccaaanggccatat

SEQ ID NO: 1140 - DNA, 300 bp, Homo sapiens
gtatagcgcctcatatgaacatgaattcatatgtattatttcatttatcttcacaaccatccagagatgaggagatgaaaactctaagacctcccagcttccaaatagcagagccagtcctcaaatttattgcctagcccaaattctgtgcttcttcacccaggccacattgcttccacatagtttcccttcagttgtaagtagtagaaaagtaggactccagaatcagtatccttacataaacagctcagtacatgagaggcagttgtgagactggaaaatggatgggactagactgtg

SEQ ID NO: 1141 - DNA, 300 bp, Homo sapiens
attatttaaaagtcttattgaaactgaattcaaagggaatgtactatgctcccaggaaaaagacataattgagagcctcttcctcttggtttttcacttatcatgagttctggtctttccttagcactgctggttctggttatcccccaggcttctcagctcagctgagggtgtgagccatcgtatgttggggactagctaccagctaaaggccacgttctctgtgctgtctagtacatgagcaacagagggaagaagttgtgtaattgtaagaacttgtcacctttcatctcttttagt

SEQ ID NO: 1142 - DNA, 300 bp, Homo sapiens
ctgatctccagacccataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaagacagaagagaagccatgggacagctgagcccgggcaccctcaagccttggaggcatgaagtttggtggggatctggcaaagaacacctgggagcagcc

SEQ ID NO: 1143 - DNA, 189 bp, Homo sapiens
  misc_feature (1)...(189): n = A,T,C or G
gaaacagacaaatctgtaataacggcctaattctgtgtctgtgataagtttcattactgcccaataataaaaaatgtgtaataattatttaagccaatttgttcatttccaacaatttcttttttttttttcccnanacccnnantttaaaaaccctggntnaanggttgaaaangggganngggtccg

SEQ ID NO: 1144 - DNA, 300 bp, Homo sapiens
agcagctgcatctaggggcccttggtgagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggc

SEQ ID NO: 1145 - DNA, 300 bp, Homo sapiens
gaatattaagggtattcatgagaggcaagtgataggttactagggatggattgtgtgggagaaataatgcagaggaaatgatgatcatctccattgaatgacagctgttatatagcaaagataaatgtaaaattagtcttattcttggaagtggaagacagcagttatcagagaggagaatttaatcaaaagaatcagaatagcatggtcacaggccagattcacattgaagtatttactctatattttactgctgttacattcaaaatgtatcagaagtctcatggttcaattaataga

SEQ ID NO: 1146 - DNA, 300 bp, Homo sapiens
gaacaaatcacttaaggagaaagtagaaaaaaagctgtattttaacaaagaggtattctaatcggcaagacaatgaccaaccattacgaccaaccattatgagaatatagcttagggacgtttgtgctcagctcctcttttacccaatgtcaatgcctgcctcagtgtattttcttctggaggagagttttgtggatgccatctttccgttacggaaaaccagtggaggaatgggcagtttcttgccatgacccaccatcatttaaacaattggtgtttgagttcagaaataagctcata

SEQ ID NO: 1147 - DNA, 300 bp, Homo sapiens
cctgcctcagcttttcaagtagctaggactacaggtatactctaccacatgtaggctagattattttctgtagagaagaggtcttggtaagttgcctaggctggtctcaaactcctggcctcaagtgatcctcctgccttggccacccaaagtgctgggattttaggtgtgagctacagtgcttggcctgcataattttataacttatatattcaccattttacacattcagagaaaggagttgtaacaagacactttataatatagactaagtcattttattgacagtgtcatgaaagc

SEQ ID NO: 1148 - DNA, 300 bp, Homo sapiens
ctttgggatctttagatgaatggtatcatacagatgtgtattattgctaattctttgttctcaatcacttgttttcaaggacactaaaatccatgtagcccctaaaaaagataaataagggcaagtcacttttcttcctccagtcacagactaaagaaattatttcagataatatatagcccttcagccatgggagcaggaagtgtttactgctcaagtcagggtctcagttggtaaaataaacggaaacttctggtttagttttagggccttctttcaaataaaaacttcattttctct

SEQ ID NO: 1149 - DNA, 300 bp, Homo sapiens
  misc_feature (1)...(300): n = A,T,C or G
gagaggaagaagcagctgacataaacatgctaagagggaaacgtctaaaatgttaatgaatttatgaagattaaatttgggaaatcatgagaatttagaatttctcgaaacttcaaacatgaggtacctcagcactttcttaccagccttttaacatgggcctccactgggtgcatgtgagaaagactgggatcagagaaaagaacctgacaagctccaccccctgtgtcngaggtgcaggaatgcaaatgagactacagtattcaaatggtgctgctggagaacagacatgaaatccag

SEQ ID NO: 1150 - DNA, 300 bp, Homo sapiens
agagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttcatacagtc

SEQ ID NO: 1151 - DNA, 300 bp, Homo sapiens
ggttactcccaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtca

SEQ ID NO: 1152 - DNA, 104 bp, Homo sapiens
agtgcatccatgcgttttcacttgttcttaggctacttcatccaataatatatttgagtagttctgaacaggaacacaagtaaggagaattttttttttttttt

SEQ ID NO: 1153 - DNA, 300 bp, Homo sapiens
aaaaaaaggcggtggggggaaattatctccacaaaacaaaaagtccgacaataagcaataagctgtccagggctgatacagggcatgatgaggtcatcacagatccaggttctttctgtcttctgctctgcattcgtagcctgtggctttgtcattccctcatctggaaatggcggctgcagccccaggcacaatggcccgttgaggaagaagggggacgatgtgcagtgtcaggttattttatcaggaaagttcaaagcttctcagaaatcttctgttggaattctacctgggtgtcat

SEQ ID NO: 1154 - DNA, 300 bp, Homo sapiens
gacaaaagaaaagtatcatgtagatttcaactggagacagtgactttaatcttctaagttcagagacaaatttcactgcacttccttcagtgtttctgaagcgtgagcatatttgctaaacagttgcctatctcatcattgtgttaggctcctcatattttccttagggaaatgctatggagagttcaggtcagaatattgtgttgtaaatgttgccacagtaaatgcaaccccggcctttactgttggttcatctcagatgaatatgtttctaaagtcatgataaaccaacctcatgca

SEQ ID NO: 1155 - DNA, 300 bp, Homo sapiens
cccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccg

SEQ ID NO: 1156 - DNA, 300 bp, Homo sapiens
aagaggaaggtaagtagataaatagggaagtaaaccaggtttctaattcatgggtgaatccgatagaataggtatcagattagggattacaaaatgtatcatgggtactaaatatcagtacaaagcagccacaataatattgatttatggatttaagtaacccgaccaaaccttgatgtatctcatcatgttgaatttctgctccagataataaagtattgttcgatcttgtgcattggccttttatttttcagaatgattcaaaggatggctttggggattcactgtaagattttttgt

SEQ ID NO: 1157 - DNA, 300 bp, Homo sapiens
gtaccataagaaactttttctgaaaagtgtattagcaaaaagaggactcttcagctttctacttgtccgcgaactttgatgttctcctgaaacctccatgtgtgtcaagattgggaaatgggagaatcaagaatcagtaggtgttaggccaccgggattgcctgtatcaaaggaggagcacaaaaccaagctgttctcaatcaaaagtagatccaaaacaacgttttcacaaaagtccaaagaaaagtatcatttttcaggttttgcgaagaggaaattgtggcgaacagaaaattggag

SEQ ID NO: 1158 - DNA, 300 bp, Homo sapiens
ttcatttttaaaaagcttctccttattatgttgttgtttaacaacttaaacgctatctctagaccaggaataattatttgctatatattacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggcatagtttaaaagactgaaaa

SEQ ID NO: 1159 - DNA, 300 bp, Homo sapiens
acaaagcatatgtaccaacaatgcatgtttatattctgtgccatgccaggggcaaattcatagttggcctgtttccataagtgtggggatggaaccttgaaacacaggacatctcataatgctgtaagcagggaccattgaaattgattcctagagtcttgttctacaacttctttaaaaattactgatttgacagcagtatgtattcaacatttaagactttctgtctaattttgagcatacattcttgactaaggctagcaattagagattctttctttaatttatcagatatctatt

SEQ ID NO: 1160 - DNA, 300 bp, Homo sapiens
ctcttttcttgcttagtgatggcatccattttaaggaacaaacctggaaatgctgagcgaagaacacatacccttcatttccaaaggttcatttcccactcttactttagattgacaatgagttgtagttcaaaggctgccctgcagggaagctcatataccctataatttaaagggcctcagacgactcttgggaaacttggtaaaacattctatttagagacatgcctgctgatatgacatatatttttatagttatacccctttattgctgggacataaaacctgttttcactcaaa

SEQ ID NO: 1161 - DNA, 300 bp, Homo sapiens
gttgtaggcctccttcatctgttcattggctgtggcattaggccagctactctttgcacttctgtaaagtgagacggtcgatcttgtctgcctctctagaggatggctgcaggtgtcaaatggggtagttaggtgggagggcatttcacaaagttaaaaaatatgactttggaggcttgttatattgatgaggattataatccctgagaattcctggtatgaaaaagggaaaagaagataatttgtgaaagaaataagtgtccagttactagtctttgaaaagggtcagtctgtagctct

SEQ ID NO: 1162 - DNA, 300 bp, Homo sapiens
cgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggcccaggtgctatggttccactggggagagaccatttaattctccagatgctttactccctgattgtcttttagccattattcttttcgttttaagagacatggtct

SEQ ID NO: 1163 - DNA, 300 bp, Homo sapiens
atttgatttaaaaaaggagaaatgttcacactcagtctagaccacttaggtatgcagagttgcatcctgaaagcaattgctcacactttccttaatatactccctctccacctttgcaaaaccttgattggcatggagcctcgactgcttgcattgtatacacatgtaataagaaagcattaaatctcttggaaattaggaattgacaagataaatagataaggcataaagccaatttttcacacatgtccttaggctcttgtaaatgtgtgcctggtgctgctttgacttcccaggtcc

SEQ ID NO: 1164 - DNA, 300 bp, Homo sapiens
aacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagta

SEQ ID NO: 1165 - DNA, 300 bp, Homo sapiens
gctgtttgtgcaaataccttgaaaactttgaaacttgaccccggacaggcctggtgccaggtcctttccgacttttgtgttttctttccacctttcactactgactttgcctctttcctaccaggaatggacagggccgatggaggtgaagcggacagcagctgcactgccctgtagagattcccaggccctgcccacttcaaagcacacaagcccaccttttcctcatcacatttccctttgcaacccagggaggcactcaccaggatgctgccaagaaggaaacattttattaacatg

SEQ ID NO: 1166 - DNA, 300 bp, Homo sapiens
ataggataacaggaaaaccagggctgtagccacagcctccatattttcctaaaaattttagagtgtccctgctacttgacaaattgaaatactaagatttatacatttccatggaaaaagcaacagtgggaaagagagggcttcccagatttgtcttatagatctcatccttcagagactagccttctgttagaaatgctgtctccaagcacaagacagaataatcatataataccaatacacaccagttgctaaggtctccatccttttaagtatttgttactgagtgttttgcctgta

SEQ ID NO: 1167 - DNA, 300 bp, Homo sapiens
ctgccatgtctagtgggctcttctgggctccgtcctgagtttgtcacacctcctagggcccagaggagatgatgtggtatttctatcactaaaaggagttcaagaccagcttgagtaacatggtgaaaccctgtctccactaaaaatacaaaatttagccaggcatgatggcgcatgcctgtaatcccagctactcgggaggccgaggcaggagaatcatttcaacccaggaggtggaggttgcagtgacccgagatcgcgctactgcactccggcctgcgtgacagagcaagactccgt

SEQ ID NO: 1168 - DNA, 290 bp, Homo sapiens
ctgaagtgttcctcagatcttagtatttacatctaaactcatctggaaaaaaatcataggagggtaaagaatatgaacaaccttcactgaatttccatatcttatataataggaatgaatttaacatggacacaagtcccagtgatataaggaataggcaagagtagtaattcttcacatcttataaagtgtaagaactcacctttgggagaaaaatctggttctaaggcatgtggtaaagcctttgtttcttccactattggttatttttcttttttttttttgaaaca

SEQ ID NO: 1169 - DNA, 300 bp, Homo sapiens
accagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaact

SEQ ID NO: 1170 - DNA, 273 bp, Homo sapiens
  misc_feature (1)...(273): n = A,T,C or G
ccttttttttttttttaaaaaaaaactatttaattttttaatttatttttggttgttttttgctcaatgaagtttcagcttctcaaccttctccccttcccagggctgtggacccagactggccttgagccacagtccctctttccctcctccccctcttccccctgcgggctcccgggtctgtccatttgttactgtgctgtgctggggattggcgccgaggtggcgtgagattccgcttgtgtagaccttgtgantangaagggcttccaa

SEQ ID NO: 1171 - DNA, 300 bp, Homo sapiens
gttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacccggcagtcccacaacaccaagcctcagtgagaaatcaaccacctt

SEQ ID NO: 1172 - DNA, 300 bp, Homo sapiens
gctggtttttctccttaagtgacaggccaggaaattttattagtcccttatgagtgtaaattagtacttaatcctttagtcttaataggcagtgatgggatattacctgagagaaactttccaaaatgagagtgctctgccatttcgttcattttgtgtgtggttcatcatgtccccaaagttcctgcatccactctatcaggaggcagaaagggagcatctgagacctaatactgcctgcatgcagaagtggtcctgctgggtttgtttctgtagtgatgacactttgaatgttttttc

SEQ ID NO: 1173 - DNA, 300 bp, Homo sapiens
cccaggctggtctcaaactcctgggcttaagcagtcttcccaccttggcctcccaaagtgctaggattacagacatgagctgttgcgcctggcctgaacatattatcttcttttgcttttcttctctactctccaaccctccctctgtcctgttgggctgggaggcaggacattggtggtttaatcatggactctgaagagtcactgctagctgagtttgaatcccagcaccctaattacataggtgcccttgggcaagatattttacttctctgagcttcagctttcttacctataaag

SEQ ID NO: 1174 - DNA, 300 bp, Homo sapiens
atgcagtgtaactggcaggaggggagtgagaactacttgggtagatgatcaggagatactctgcaagaggaaacatacagaaggagcctgacatgagaaaactggggcagcagttttccaggaagagggaccagcacaggtccaagttgaaactcagaatggaattttaggaaattatattcttcatgatggttagatcctgtgggctatcatcactgcagttcaacaatgtggtgcctagtaggaagagttctcccaggaaccctccacgtgtgctatgggatttctgagaaaaccagt

SEQ ID NO: 1175 - DNA, 300 bp, Homo sapiens
gcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggagggtgaggaacctggggtaagccacaggggtgtggaggggctgtccccgcgtccgctgagccctgctctgccccagccatcgagactttgctgtgctacctggactgcacccacac

SEQ ID NO: 1176 - DNA, 300 bp, Homo sapiens
cttgaagtagaattttttttcattccttacacttctcagtgagtggtaactgtagtttttgctatcatttttcattttcgtttttgcagttgaacatacttttttcactcagagagttggagggacttgcccaagactgcccaatggcaatgagatttcaacctcaaatcaatgttctttttaatgcaagatgataaagagtaggatttagcctaatttaggatagaataaagccaaataatttaggataggttctttggtgttcatgggtgtaatctaatgcccatgatgcaagtggca

SEQ ID NO: 1177 - DNA, 300 bp, Homo sapiens
taaagttacacttaaacagtgatacatagattgccagataaattttggaagggctttgattaattaggcttcagggaaattgtgaataaaaacataaatcttgcaatagggtaggggaaagaaaataatcccactcctgaagtgatgaaatgaagagtggctagagaggagaaaagaaccaggacaggtgatatattagcaactgtcagtgtgaataatccagggtatgacatttctaatttagcctcacatttaaggtcatttctgattcaacctcaaatgatccttctagcctactgc

SEQ ID NO: 1178 - DNA, 300 bp, Homo sapiens
cttaggggaaggaaatgaaggtcagctttgggtatactagtgtaaggtgcccatgagacattcagataaaaaccagccaccaggcatatggagataacagggctgaacttaggagaaaagcctgggttgaaacagagattcggatatcctcagtatgaaggtgatagttgaaactggggactggatgaccgaaagagatcacccagaacaccagtacagagaggagagagctgaggatggaattttgggacataggtgcttctacagcacatggcaccaacctctaataatcacaccact

SEQ ID NO: 1179 - DNA, 300 bp, Homo sapiens
ggagaccaggtgggagccactcacagaaatcagtaacatgaaaaccacagccacaaaaccaccactggcactcaacgcccatcatcacgggcaggacagttctacatcatctccctccggcctgaggcttcccaggcagtgtgggaaggggggctgcatctcctggctggggttcacacctaagtttcctgaggtccaagctgacctggaaagtttctagtgagtggcacatcctgtcccaacaaggggaacacgggcaggatgtgcctgcaccctgggaaaagtgttgtctccgcacac

SEQ ID NO: 1180 - DNA, 300 bp, Homo sapiens
ggagaccaggtgggagccactcacagaaatcagtaacatgaaaaccacagccacaaaaccaccactgtcactcaacgcccatcatcacgggcaggacagttctacatcatctccctccggcctgaggcttcccaggcagtgtgggaaggggggctgcatctcctggctggggttcacacctaagtttcctgaggtccaagctgacctggaaagtttctagtgagtggcacatcctgtcccaacaaggggaacacgggcaggatgtgcctgcaccctgggaaaagtgttgtctccgcacac

SEQ ID NO: 1181 - DNA, 300 bp, Homo sapiens
caaaggtgatctcaggaaaggtctaagctagtttacagtatgcccatttcctgtgtaaaccatttaatttaaatgactctgcttgtctcactgttatgataaatttgtgtggtagatcgcagcctgttagctattactggaagttttctgcttttattacaggcctctcaaataggtaggttttaacattttattggaccccctgccccttcccaatttcaactattaaatccttaaatttgttgttttggttatgcagaagttagttatcaggttatatggttcccaatgagtgaggaa

SEQ ID NO: 1182 - DNA, 300 bp, Homo sapiens
gagatccaagtggtttagaaggggatgattgctggtgaaggttctgaacatggtgacaggtgggaggctgagcacacactcgtacaccgctggcaggaagagaaatgacttttctggactacaatttggagataacacaaacattaaaaagaagaaaaaattgtatccctttttgactaagcaattctaggattgttatttttttctcctgaggaaactagcatggatgttcacattcaggtgtggggatgtttatcaatttgctattttagaaaagagaaaaaaagtttagcatgtcac

SEQ ID NO: 1183 - DNA, 300 bp, Homo sapiens
ctctgcccaatctatttccggctggatgtggagtctgaaggcctggcacccactctggctctgtgatttaccagctgtgagccttggggttgctgcttactctcttggtgattctttactcatttctatgatggggtagaggataatgcctatgcttacaaagtggctgtgggaagtaaaccggatgggataagaatggcttgctgtggaccacaggcaccgcaggataaccattcctcagaactcctcgtactgctctagtgcttggaggtccgtgtattacctcagctattccaaccg

SEQ ID NO: 1184 - DNA, 300 bp, Homo sapiens
atacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggc

SEQ ID NO: 1185 - DNA, 300 bp, Homo sapiens
ctttaggttcttgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcc

SEQ ID NO: 1186 - DNA, 300 bp, Homo sapiens
ctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcat

SEQ ID NO: 1187 - DNA, 300 bp, Homo sapiens
aatatatcacatcatgtaataagcctctcagagatgtagcattgagcagattaaggcctgatttatagaaaaattccaccctggccatgtgggcctgaaactctggagggctttaacaatgtcttgaggtcattgtcatttaaagagatgactcattggttttatttagtagaaataaatactaaataaataatctccacagattatccagaggggtaagttgaaggatgttgacagataactcagtaaattgcgtctcaaatattaataagtttattctatgccagcaccaaaaatatt

SEQ ID NO: 1188 - DNA, 300 bp, Homo sapiens
agtgattaagtctcactagaataggcttttctaaattgttttatctcatcctcattagaacttcaccacatgtgggaaatcatgtggcaaaactgtctctcttaaaaaaaaagtcaccaaggaaacctccttctgcaatttaagaaataaaatcccagtgacattgatttggatgctccaaacatgtccataatggaagagcttttccaggttttggtttgggccccccagaccaaagctttgacacataatacaagctctgtaagtctgttttcctgtctgtaatttgggattgtcatc

SEQ ID NO: 1189 - DNA, 300 bp, Homo sapiens
gttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctata

SEQ ID NO: 1190 - DNA, 300 bp, Homo sapiens
tgactttgtacctggtccaagctgttggggaattgctgctgttgacccaggcaggagtctgactagagaacaaactaaggttgctgcaacaaacaaggacctcttccaagaagggctcccaggcctggcgcagtgactcatgcctgtgatcccagcacttgggaggccgaggcgggtggatcatttgaggccaggagttcgagaccagcttggccaacatgatgagaccccgtctctattaaaaatacaaaaattagccaggcgtggtggcgcctgtagtcccagctactcaggaggttg

SEQ ID NO: 1191 - DNA, 300 bp, Homo sapiens
ggccaagcatcactgcacgtgccagctccccaaacggctggtaagggggcctggatacttaactgtaacttgcaaatcgtatccctagcgggcccaacacaaatcctggagaatcagagctggggtggccttggaaactggcaagtccagcttcatcttcacagggctagggaaacagggcccagggaggtcgccctgccagggccacacagggaggaggtgtgtggctccatgtggcctcaggcctgaattctattattattattattattatttttgagatggagtcttgctctgtca

SEQ ID NO: 1192 - DNA, 300 bp, Homo sapiens
gggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacat

SEQ ID NO: 1193 - DNA, 300 bp, Homo sapiens
tgtaggggtgtgtagggtgctggggattaagatctgctgagtaggtgcttaccagagttatactgaaggacctgaagacagatcatcttcacataatcagcatgacccataatctgtgatgtcactgagcttcttttatttctgtagtcaaggaatgtgcacaagtaatgcaaatataattacttttagtcctgaggattagggaacttgggggatgttcacattacctgatgatgtcaatattgtgttatgtttaattttttttaaaaaagatgcttatttattactgaaataatctaa

SEQ ID NO: 1194 - DNA, 300 bp, Homo sapiens
aattgataataattagacaaactgaactaaatttttttaacagatacctgagtgccaagcttaacagatacctgagtgccaagcataataaacaggaaatatacacttcaaaaaagaaaaagaaaaatgaatgcatacttatcaaatacttgctgtaagagcattaagtactttacataagtcaaatcatttaatcctcatgaccctaagaagttattttaagatcttttgagaatgagaaaaaaggatgagtaagggtaggtgatctatgtaaaacaaataaattctagtaactggcaa

SEQ ID NO: 1195 - DNA, 300 bp, Homo sapiens
gccacggcgctcggcctgaattttttttaatacttaatttagatcaataacttcgactggtactgaaatttgcactcactttcagcttacagtttgggtaggactgctagacccagttcttttgtcatctcattcttagagagctcttgaaaaccaaagtatttaaaaccctgcaagtttctgtgcagatgagtgcaaatttccacccagcattggttcctgagtaattagaggaaggaagccatgcaaaagctgctattgcccaggctccagaaaaacatcatgtaaggtttgattcca

SEQ ID NO: 1196 - DNA, 300 bp, Homo sapiens
ttatgcttcatgttcattgttttaccaattttagaataccccaatggggtaggtacttttatctctctttttacaattggggagctcgaggctcagtttggtcatgttgtaagtccctgtggagttgggctccaacccaggtcagtctgtttcccaaaacccttctgtttgactttgccgctgaagaagatacaatgagatgaagagtcttgggcatgatggcacacaggtcatcaggaagaaggccatcaggaagttggactagaggtgggaggggagaaggaattaggggatttggaa

SEQ ID NO: 1197 - DNA, 289 bp, Homo sapiens
  misc_feature (1)...(289): n = A,T,C or G
agtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttangacttggtgttaaaggagccagnggtctctctgggtgggtactatncngagttattg

SEQ ID NO: 1198 - DNA, 300 bp, Homo sapiens
cccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgt

SEQ ID NO: 1199 - DNA, 300 bp, Homo sapiens
aagtcgcaaggcataatttgttgcctaatggatttgcggctgctgatgatgattgctgtagttgttgagcaattttgtttttttttaaagcagggtgacctgaaaatgctttgtagaggacatgggtttgggccgccccttgaaatgctggggaggatttgactcctttactgtcgaggagggggaagggcattgccacagttgggacagtggcacaaactcaaaaggaaggaagaactaggtaatttgaaaaacagaataaaccaatttggctggaaagtgaggtcttgtgagaaagca

SEQ ID NO: 1200 - DNA, 300 bp, Homo sapiens
gacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgg

SEQ ID NO: 1201 - DNA, 300 bp, Homo sapiens
gtgtgtgtgtgtgtgtgtgtagaggagagaaagagaccattatcatatgagtgtgttggggctgctgagagggtttcgtttacaagtgaccttgagtgtatttcatctctggaatgcatggtccctgcgctcaagctacacaatctgattagtgaagtattactaatacactagaaaaatatacatagtaattaccaaatgactgacacaattttatagggggttcagagaaacatctgtgaatgggtaataatgaaaaaagaaaagtttttctctttgttttagtctgacccttttaac

SEQ ID NO: 1202 - DNA, 148 bp, Homo sapiens
cttcctgtgccaggggaccgtggagaaagtgtcaggggccgctcactgcagcagcctgctctgctgccttccctggcagtgttctgggggtggattccctacacctagatgttcaaggccttacttttcctcccacaaaggattcgca

SEQ ID NO: 1203 - DNA, 300 bp, Homo sapiens
cagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgatgcttcct

SEQ ID NO: 1204 - DNA, 300 bp, Homo sapiens
gttgcaggatccgttacaagaattcagagttttggcatctcccctttgtatgttgtaggagaaggtttggcattgaaaatgtgctgttgttccaaagaaaaattagcagaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaa

SEQ ID NO: 1205 - DNA, 300 bp, Homo sapiens
ccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttaca

SEQ ID NO: 1206 - DNA, 300 bp, Homo sapiens
cagagtcaacatggagcatctcactgtgaaatgatccatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatg

SEQ ID NO: 1207 - DNA, 300 bp, Homo sapiens
gtcggtgttacacacattcacacttgcaggcgtgcaggtcggtggtgttacacacattcacactgttgcaggcgtgcaggtccgtggtgttacacacatgctgttgcaggcgtgcaggtcggtggtgttacattcacactgttgcaggtgtgcaggttggtgttacacacattcacactgttgcaggcttgcaggtcggtggtgttacacacattcacacttgcaggcgtgcaggtcagtggtgttacacacattcatgctgttgcaggcatgcaggtcggtagtgttacacattcatgc

SEQ ID NO: 1208 - DNA, 300 bp, Homo sapiens
attttttttgttcgaatgagccttaatctcctactagtgattttttgtttgaaggagccttgatcttggaccaccgaaaaggtaaaaccagtggcaagcttgaatgcttgttttatggtagacttagatacgagaacgggtaaagggtactggataaacttgggatataagattgtcttcttttatgcataccactcataccactggtgggaaatttcatttggaattactccctagggccatggagtcttcctgcatatgctaataatgtaagttcccattacctttggtaataagaaa

SEQ ID NO: 1209 - DNA, 215 bp, Homo sapiens
acctggtgtcctcgtgcttcttgggcaggccagctccatgcagtgcagtgcccctgaagggaatggggccaggagaagacataacagggcatgaggatcttctctgtgccaagaatcatgctaggtaacccccctgagatttctcatcctcttgagaatcctgtgagatgatcctgctgcccttatttttccagatggaaaaacggattacccag

SEQ ID NO: 1210 - DNA, 300 bp, Homo sapiens
cacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccc

SEQ ID NO: 1211 - DNA, 300 bp, Homo sapiens
ttgcacaggaggagaattagcacgatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgtttcacttattttgaattatagtgcaattttgtggagggtgaaat

SEQ ID NO: 1212 - DNA, 300 bp, Homo sapiens
agggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaat

SEQ ID NO: 1213 - DNA, 300 bp, Homo sapiens
ctctcactagccctgggcacttcccactgcctttgtggacttctgtttgctcttctgtagaatgggataacagtgccagtcctgcttactatttagggttatgtgatgcttgcagatgtacagggaaagcaccgctgatgggagctgctgaagtttctaggggaggtgaaggtggcgcctcctcccctggtctaagtggtagatggtgcagggagaggagaatttcattctgtggcagcagctgatagattccaggtctttaatactacctgggaaaccttaacaaagcagtcagtcacc

SEQ ID NO: 1214 - DNA, 299 bp, Homo sapiens
  misc_feature (1)...(299): n = A,T,C or G
aaacagtctatacatgttcagtacagatgcagccatccattttcttgtccaaatattttttatctccagttggttgaatccattgatgcagaaaccacggatacggagagctgactctgtgtgtgtgtgtgtatactcaccaattctttatttattnaacngatatttattgaatntttactatgngggangnatanttnangagcntgnntntancttagncntcanccntggcttanngcnccnggantctnatgnagatccnagancgntngnccnnatcacnntgctttgcgcct

SEQ ID NO: 1215 - DNA, 300 bp, Homo sapiens
tttttagttttccaaatctgaattgactctttttttctttcttctagagccagaaacttttgataccatttttcatgctgttgaacttcatcttgtgtttttccaggaaggtgttctagaacttcttccataaatgttggcttccctttatgtttgtttctcacctttacaaagttctggtgatcataatcatcccaggcaccttgtcgccctcctgtttgctgaaggaatttttcaaaatctagtacctcttctggaagagtacttggtgttactttgtctacaggaactttgcttgag

SEQ ID NO: 1216 - DNA, 300 bp, Homo sapiens
tggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagc

SEQ ID NO: 1217 - DNA, 300 bp, Homo sapiens
ggaaggaaggggcaggaccctccgacggggcagcagtgggccaggtgtcccccctgcacagtgtttacaccctgggacctgccgcaaggcatggctttcagaagagcctccccccaagaaatgctgcagacaggacggggcttctagagaccttggcttctacccaggaaggctgatctattcttcgactgttgcatcagcttcctcaacctctgcaggttcaggctgcgagccctagggagcatcactcaaagcaccctgttggccacttaggatcaggagggcctcggctcacccaag

SEQ ID NO: 1218 - DNA, 290 bp, Homo sapiens
  misc_feature (1)...(290): n = A,T,C or G
gagaccaacctagcctacatggtgaaaccccgtctctactaaaaataaggatattagccggttgtgttggcacgcacctgtagtcccagctacttgggagcctgangcannanaatcgcttgaacctntgaagtngaggttnatagagncnnaaccgngcnanngtactccagcntttnngacattancnagattncgnntnanaaatnaaaannccnccctttaaattctgtttttttttnncttnnnggtnntttttgtggagtanattttnnnttttgnttctatta

SEQ ID NO: 1219 - DNA, 300 bp, Homo sapiens; identical to SEQ ID NO: 300

SEQ ID NO: 1220 - DNA, 300 bp, Homo sapiens
  misc_feature (1)...(300): n = A,T,C or G
tgtagagacgaggttttgccatgtttcccaggctggtctcgaacttctgggctcaagcaatccacccaccttggtctcccaaaatgctggcattataggtgtgagttaccactctgggccaggattagaattcttggtctcttaacctctcgttcagttttttcctcgtcgactcacatgccctccaaatgaataccgaagttagattttgcatattaaattgaaagaaagttaaaagccttactactttctacttcagtgtagggnggatatgcnaaggnttccnagtccaaatngann

SEQ ID NO: 1221 - DNA, 300 bp, Homo sapiens
caaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctg

SEQ ID NO: 1222 - DNA, 300 bp, Homo sapiens
agatttcagtaaagctcgttcgttttgtttggttttctttttacctagttgctatagtggctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttcct

SEQ ID NO: 1223 - DNA, 300 bp, Homo sapiens
ctggcctctctgaagactaagggcctggtgctgttttggttgtaaactgtgttccattaagtggtacctcaaatgaaccggacactaaatactcctccattattatagattctgcattggatgtcacagacattgatctgtgggaaatactgtgtgctactcctgagaaaaccctatgagaaattttaaacttttttgctgacaactatttatgactttattcaacaaagtgaaacaacatttggacgactgttgcctgttcttgaatgtcattcatggtcagccacacaaaaacactgc

SEQ ID NO: 1224 - DNA, 300 bp, Homo sapiens
tgcttgttcgtttctgtgtacttgcttagtggactgtagcaacacactcagcttctccagtgtcaacccagattggctttcccactctacagtttctgtaggatgcatgttttcaccattatcaggcttctgcagtgctcagagggcagcaatacccagcaaccagtgacccgaggccagcaacttcttttacttccccctcagttggatttgtaacagagtatctttggtgggacacttctgtgtgaagagattttactagcaccctaaagaatggatttctggcaagttccacaaggt

SEQ ID NO: 1225 - DNA, 300 bp, Homo sapiens
gctgctgggcctggaagtccaggtggggccactcgctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccggggaac

SEQ ID NO: 1226 - DNA, 300 bp, Homo sapiens
attctcccaaaaaggttcatcccgagaacactgaagaataatttttgggaatgttaatgatgtgccacaaaaattagtattttatgatcaaatgaatttgctttataatattttatctaaatattcatgctcctgaagactcacaaaataaaggaaactttatccagctttttccagaatttacttgcacatagactccatttatatagcatgcctattgaactctgtaaatagtgcagttcaggaaagatagcagtgtgggaaatgtcactctaatggtcatatacgtttatcccatgg

SEQ ID NO: 1227 - DNA, 300 bp, Homo sapiens
gaatcttccttaaagtccagagtctcccggaacatggagactgtccttcccaagccttctcgcggggagggaattccttctttctgccgcctgttacatccctgtgtgagaaggtctgtgagctgagcccacatcactcgttctgctgcccaggtgtgcttccatcttcactgtggaaaagtcattttgaactccccggagactgcaaattaagtaatcaaggacagatgggactgggttgaccattccaaggagtacagttacttgaagaatctggaagcaataccgagcacatttgtt

SEQ ID NO: 1228 - DNA, 300 bp, Homo sapiens
ctgaataacaacctaactactacccctcaacctcacccccaccccaggaaaagtaagtctttttctaacgatccaccagattagggttacatttaacagtaactagaaaggttaattttaaccttaatcagaaagattaatttctgtcctttcagtcttctttctgtgctcataaataagcattgtttcttttaatcaacctgggcagtatctttctcattttaacagttgtctagagctcagttgtcccagcatttatttcactggtccctgatggatggagggtggtgttgcttcagt

SEQ ID NO: 1229 - DNA, 300 bp, Homo sapiens
gtcatgcaggaaaacatggagagagtttttattccagcttcaaataaggaatcacttagtaaagttcattctttctagtacctacattctccaagtaatctgctcttttcagtgcctgaagtaaatcttggttaacagctgaggagtagtattactgcaagtgttcgtcacttgttgctgtatacatctgtcagtcttatcaaggaaatgtggaatggtgaatctgctttacaatgagtatgcctagaactcagaatcttattttatttaaaacattgatctcgttttattttattgaga

SEQ ID NO: 1230 - DNA, 300 bp, Homo sapiens
gcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaatgcagagtcagagctatttgtacttcattactattcgccttggaaataataatgaagtacaaatagttggctttctttttgcaaaaataattaaagtttttgtatgttgca

SEQ ID NO: 1231 - DNA, 300 bp, Homo sapiens
ctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatct

SEQ ID NO: 1232 - DNA, 300 bp, Homo sapiens
atcccttcaagacaatgacttgtcttcatagctcatcagtgagttcacagtctattgttcctttttatttggccagtgtaaaatagcagttattgcaagaacaaagggattaaagcatctgaagacctttgtttgagttctgccactttagtagtgatacatctcagagatcaacctctttaatgcctgtctttgttccctggaacagagtttgtgtttccttttgtgttacaacagaactctggtcattcctaccatagcacttttgcacactatagattgcaacccacagtattttac

SEQ ID NO: 1233 - DNA, 300 bp, Homo sapiens
aggtaatgaggacccctgctagcgaagcagtggcagaaatggagaaaagagttgggtgcagggaatgtcagtgatgtaaaagtcaaagacttgactgctgaaggaatgtagggaatcagtgcccttggaatgtcaatggcctggtctacattgagaatgaagactgagaaagggcttcctgagggacagagagctgcaggtgatcaaggacactcaatgggtctctgagggaaaagaagaccaaagaattagggagtagctagcagaaaatggaggcatgacactaaacacagactgaaa

SEQ ID NO: 1234 - DNA, 300 bp, Homo sapiens
aatggggggtgttcttcatagtggatttctttttttaaacataccatctttgtgtatatacatttctctggaaatgtttgtgaaaaggtaaagataacttccttagtgtaattgtgttgaagtggaatgtttctagtgtttgtgaagatatcaattgctggctgatattttaagctggatgaaaaatgtgggtgaagtaatcttaaagggtgatagatttgatatgagaaatttaaagtaatgtgctcagtgcgtagtggtgataaaagaatgtagcctacttgttttccatagactata

SEQ ID NO: 1235 - DNA, 300 bp, Homo sapiens
gggaagaggtggttctatctgaggacagtgtgtgacttccctattgatgggctccctgccatcagcacagatgggcatgttgtgtgcccccaggcgactatctgtgcatcagatatggttgctgaagtcacaattcactgatggaaaagttgaaacagctggctgtcctgaaacaggagatgtgccattgatagatctactggatccagagtgatttggccaaagttaatcatttctttcctgacttgaaaaattgttcattatgtatgtgaagttgccttagaatagagcatcatctta

SEQ ID NO: 1236 - DNA, 300 bp, Homo sapiens
tatcacagtttgtaaacgggtgtttttgtccttgttattgaagtatacaactctgcttagccaaacataccaagcaacagacagaagcgtcacttggagagaagaagaaagggttaactggcagagctactgtaaaagaaggatagaggagggtaagtttgaaagtggccatgggcaagaattttctccagatagctcttgattataatctctctcacctggattatttcccatctcctgacagtttgttctcacataactatcagcagtcctctcaacacagaatcagaccatgtctct

SEQ ID NO: 1237 - DNA, 300 bp, Homo sapiens
tgaaaatacttatctatagaaacagtgttgtaaataagagagtctcagattatcaaatgaaacttatttaaatccatgtaactgaactaataataccagctgcagttttatcctggctgtaaggactaccatgatgggaaaaaataagaggaaaccttaccctcccccacattcccacatgaccagcagcataagggctccaggttaccacagtatccatcatttgtcttatggccacccaagtacacctgtttacatgacttactgggcctgtgtagaaattgcagtttgtgataggat

SEQ ID NO: 1238 - DNA, 300 bp, Homo sapiens
cagttttgatgagcatgatgaaggcagtatcatttttgtgcttgatacagtggccggaaagttcaggtctgggtggcatcctgagaaagggagcaaggcagtgtggtgatgccaggtgcaagaagttgggggtgtccagagggaagtgagatgctctgcaaaaaagtcagagggcatctcagaaaatagagccacttttcttgatttcccagaaatagtcactcactcaaagcccttgtatgtgcagcagatttcactgatgctttaaggaggagtttatgctgcaaaaaagcaagctat

SEQ ID NO: 1239 - DNA, 230 bp, Homo sapiens
  misc_feature (1)...(230): n = A,T,C or G
ctcagattaagggtttgaaaaacaaaccgaaaaagatgggccacataaagccagacttgattgacgttgacttaatcagagggtcnacatttgccaaagcaaaacctgaaattccatggacatctctgactcggaaggggcttgttcgagttgtattttttccattgttcagcaattggtggattcaggttacctctttaagaatctttgtttggctgttactactttat

SEQ ID NO: 1240 - DNA, 300 bp, Homo sapiens
gaattgttagagaaggggattctgattatttaacaacagagaaaggcttctgggttatctattagagatgaaaggattaaagagaaactatagatcagctagtccttatggagagaggaatataaaggaaagagaaaaaataggactgtggcttagtttgggctctgttgactgactataaaagtgagccaatcacatagtaattttctgacaaaatagagtttaggttaaggcttaggtcaaggctgtactttgtgttaatagtattataatgagcaaattaatagaaacaagaaaaca

SEQ ID NO: 1241 - DNA, 300 bp, Homo sapiens
gggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacag

SEQ ID NO: 1242 - DNA, 300 bp, Homo sapiens
gctgggtgtggtggcttatgcctgtaatccaaacactttgggaggccaagaagggaggatcacttgagcccaagaatttgagaccagcctgggtaacttagtgagaccctgtttctaaaaataaatagacagatgatagatagtcagatagagagagagagagagatgatatagatatagatagatagatagaatgttctctaccccaagggtggagaaagacttgagcaaagacacagaggccacatggattaaaaggaggaggagaagccctgtgtttgcagggatgaatggcctatg

SEQ ID NO: 1243 - DNA, 300 bp, Homo sapiens
cggcggccgggggtaacgcacagagagccagccgggcgcctatctgggccgtaccgtgctggtggctggtgcaccggcctgcgccatggccaggcctttttctctagtcaggaccgtccggatggggccttagggccccgccccgtctagcctggcccggcctgcgcgagccccgcaagctctgcaggctggctagcgggcagaccccagccccacgtcctgctacccacctacgaaggatccggggatgggcagcgccacccggcccgctccagagtcagcatgggtctccgtgaggcc

SEQ ID NO: 1244 - DNA, 300 bp, Homo sapiens
cgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggct

SEQ ID NO: 1245 - DNA, 300 bp, Homo sapiens
aatcgggcacgaggccagcttgacctggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgaggtgcgtgaagtgggcaggccctgtcagtctcgcgttcttcttggaagccgagacgcgggccaccctcggtc

SEQ ID NO: 1246 - DNA, 300 bp, Homo sapiens
cagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaag

SEQ ID NO: 1247 - DNA, 300 bp, Homo sapiens
ggccgttgggcgagatgaagctacactgtgaggtggaggtgatcagccggcacttgcccgctttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggatt

SEQ ID NO: 1248 - DNA, 300 bp, Homo sapiens
aaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatata

SEQ ID NO: 1249 - DNA, 300 bp, Homo sapiens
atcacatctctcaagttttaaaatgggtttttttgttgttgttgatgggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggagggcggagtctgcttagttctgaggactgcgtgggtccgcgcagagagctcctgctag

SEQ ID NO: 1250 - DNA, 300 bp, Homo sapiens
gagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggag

SEQ ID NO: 1251 - DNA, 300 bp, Homo sapiens
ggagcgtggagacagggtaggggcagatggctctggactctggacctaatcctgagggccaatgaagggggttaagcctgggagtgagcagatcagacgtgcttttttagcaagatcattctggatctctgtggaaactgccttgtggtgatgagagcaaaccctgagaccactggggtccctgagctgataagcaccaaggcagtgggccggagagaggagagatgtttaagaggtgtcctgggttgggtgcggtggctcacgcctgtgatcccagcactttgggaggccgaggcaggt

SEQ ID NO: 1252 - DNA, 300 bp, Homo sapiens
cttctgtgtgtgttccctcaccttccatttaagtttcagcctttatctatgtccttttgggtgtctgccatgctgatgatagagctcatcagtctttgataaatactgttaggtccttaagtgattttctgtgaaatcttacgcataggatttctgtggtcagggtttgacgtctgatcttgttcgtcagctccccttgctcaagaatgcaagtgcattacctcttaaattttaaaagctggtaaacttaataggaagtgcttctttatattgcaggtgctaaacttaaggagcccatta

SEQ ID NO: 1253 - DNA, 300 bp, Homo sapiens
gtcatgcccggctaatttttgtatttttgtagatacagggtttcaccatgttggccaggctggtcttgaactcctgacctcaggtgatcacccgcctcggcctcccaaagtgctgggattacaggcgtgagccactgtgacgggccttacatgcaatttttatttatagccagtattagagaattactaggaaatttcatttttatatttagtgggagaaagccatctacagcatgtcttcaagcatggactatctgtaacatacagtgtgcttgcttttgaattgttttagtgttaaat

SEQ ID NO: 1254 - DNA, 300 bp, Homo sapiens
aggagatagggacagagcatcctaagattcaggagagcattctagtcacagggagcagtgaattcagaggccccaaggtaggagggagtttggtctgtccaaggaaagcaagaaggtcagtgcagctgaggcagagtaagtaggaaggagagaggtcagggctgagatcagggaggtagtctgaggcccctctgtgggggacctgataaatgtgtttgaattcattttgaagtgtaataggtccatattagaagcagaaactagaaaaggagttaggctgataaacatagggatcataac

SEQ ID NO: 1255 - DNA, 300 bp, Homo sapiens
cctagttatgctataatcaagcaggaaatgtttatggaatggaaagattaaggaggggggtatgttcttattttagcaataaaacgaataccagaagctttaacattcaccagtacaaataaatagtttcaatggaataggtcgaaagtaaagggacatcactagagtaaatgctagaccttccctctccttttatttttagcaacagcaaagcagaaactaagatctacaagtgatcaaagagggtgatccattcagtttctgtgtagacaggaataataataataccttttacatatt

SEQ ID NO: 1256 - DNA, 300 bp, Homo sapiens
gtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaat

SEQ ID NO: 1257 - DNA, 300 bp, Homo sapiens
gctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttcc

SEQ ID NO: 1258 - DNA, 300 bp, Homo sapiens
  misc_feature (1)...(300): n = A,T,C or G
gagccaccatgcctggcccatcgtttcatttgatccttgcaacaccctatgagaatatttagatagaacgatttcacagataatccatagtgatactcagctaacgggtggtactgccaagacttgaacccaccattcttgnaacttccttgatatctctaattatggtttaggtctgccagtttggtatggagcagaaaagaagatgtaagctttctggaggtagtagctgctacaggcatacantatatnatctcangcaatagcaagtccaagtaggactgatacagtatacacaaa

SEQ ID NO: 1259 - DNA, 300 bp, Homo sapiens
cactacatgaagtccggggtttggttaaaatatctgtcttatttatgaaaggctgaaaagagaaaagagctattcactacccgagactataagttttagctgataaaaacacagcctcatcaatagctattgaatgaagccacttgctgagtcagtaactgaatgtctatgtatgatatttccagtatcatgattaaaatggagccccgaaatgtcattataaggcctagttgtggactgggggcccagatggccaagtgggagcaactctgaaaccattaaataggaggagagagagaa

SEQ ID NO: 1260 - DNA, 300 bp, Homo sapiens
catagacaaactacgtatcaagcactgtgccagacactgagtacactatggtgaataataaaagtctaggggtctcagccagtataattcataatccagtgagagacaaaaacatgtacacaggctgtgatgagtactgtacattggcaaatgtgccatgctactaggggatggatgagatcacagtttaagcttgggaagaatgagtgagacttggcaaagaaggggggacaagaatattatcataagagtgaagaaagttgggggacctcaagtgtaagagaagagaagaacttgctg

SEQ ID NO: 1261 - DNA, 300 bp, Homo sapiens
atgactaccattatttttcttccttctattggtttaaaatatacttatctcttccactgtatgttcctgtgttttattgcatgggaaaaggtaataagtgtcatcaataacagccatcttaacatgctgcaggaactgtcaagtaacagtgattattgtaaaaaacgagctttctaatttccttgtcgcttacagagtaatctaagtgaaaatttccaacgtcctatctttacaaagaaacaaatacatttattttttcctctaatggaagaacttatgtacatgattcctacttgatgg

SEQ ID NO: 1262 - DNA, 300 bp, Homo sapiens
cccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggca

SEQ ID NO: 1263 - DNA, 300 bp, Homo sapiens
acttttttaacgaatgggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtgatccttag

SEQ ID NO: 1264 - DNA, 298 bp, Homo sapiens
  misc_feature (1)...(298): n = A,T,C or G
ttggaaatgnttctagctccggacattngacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttctttccgtcaaaattggatttgtaattaaattgtaagcctcgtaggatgtatgttggagattttaagtctttccttcggttctatgcaaaaaa

SEQ ID NO: 1265 - DNA, 300 bp, Homo sapiens
tcctggtgtcaaacactataaacctttgaccagctgagctgtgactgctgtcacatatctgagtcctgtgtgcacagtaatatcctgggtcaggtaaaatccaggtcttcaagttttaaggattttttgaagaattcgggcttctttaagacgatccatgcccaaatccacaagcttgttgacagtggattacagtttgtgtggcaaagtccaagttgttacactgtgctttaaaaaaaatcttatctgcatgtattgttaacttagagaccatgagatctatttatcaggaccaggaag

SEQ ID NO: 1266 - DNA, 300 bp, Homo sapiens
ttttagtagagccaccacacccaggatctttctttttaaagaaagattcttctgttggagcttgtgagctgaaggacttcaggaaaacccacggaatcccctcaaattgtatacagatttttgtgatgtttgtgtctcacgtgtccgtgtgaagagaccaccaaacaggctttgtgtgacagggcaagggtagaaatcatgttccagaactcagtgagagttgtaggcatgaaagaggagccttctcaacaggagctgtggccaaacaagaaacaaggcaggtaagaagtttgatagctg

SEQ ID NO: 1267 - DNA, 300 bp, Homo sapiens
cagcatccacatgacaggcggcgccgaagggatcctgcccctgagctttcatgagctgttgaaccatctggaattcacaggcctgtcatgagagacacgatgagaagtccttaaaggtagatcactgattcacaggggagcaggcggaggcaagggtgagtcagtgcttggaactcagtcatccagatttggctctggaaacttctgaagctgtagcctttggggatccctgactgcgagtacaggaagccaacgctatgtggtcttctggaaactcattatctttttcactggtgctat

SEQ ID NO: 1268 - DNA, 300 bp, Homo sapiens
cagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcaggttgtgctgttaacaaagatagacacttttcttgcgaagactgtaatg

SEQ ID NO: 1269 - DNA, 300 bp, Homo sapiens
  misc_feature (1)...(300): n = A,T,C or G
gagggcaggtggatcacgaggtcaggagatcgagaccatggtgaaaccccgtctctactanaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaacaaaccaaaaccaagttcccactggtgatgcctgtctgacacgttttggtatttagtaggaaatgaagtgtttcg

SEQ ID NO: 1270 - DNA, 300 bp, Homo sapiens
ccgactacttgtgcagtttgccctgctgagccctcctcgccccgggaggcagaaggggaggggtcctcagcaatatgctgagcacctcctaaacaacatcacctgaaaaaggaacctagaggagagccattctcaaatctgatcctggactgagctcgagagctgggttgagagctgggttgatcaaagttgggattttgctattattgtgacaaagggtccagccttgcagtccagatcctgaaaggcctgggacaaggccaggtaatttggggagtccgtcctgcattgtgcaggatg

SEQ ID NO: 1271 - DNA, 300 bp, Homo sapiens
cttgtccccatggtcagaggagacccagctgtcctgcacccccttgcagatgagtatcaccccatcttttctttccacttgttttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgaatttttagtagagacagggtttcaccatgttggccaggctggtct

SEQ ID NO: 1272 - DNA, 300 bp, Homo sapiens
aacatctcctcttgtcattcctaggacatagacggttagggaaactctcatctttccttcaccacctcatgagtctaaaaacaatgataaacccagggaagcttgctgaagagcatcctccatttggttattgctctttgtctaggaaaatcagactcagctgtgaattgtggaccaagtggtgcagaactcattactttgaacaatgcctcctcggcctgggaagcatgttctctcttctcactagcaggggcttattccaggctggctttggtcacaaggaaaatcatttagacacag

SEQ ID NO: 1273 - DNA, 300 bp, Homo sapiens
ggaacctttcaatcactttaactagtcacttaaggactctaggcccagaagcctggtttctgggtgaatgtttttatacatcactcaacttccctcgtcctaaaaggacacctaattttgttactattgaaaatttttattttggtggccagaatacgaaatcgggagaggtaacccaaacagttgtcttaggaaaaggcagattctcagaggcaatgggctatcaacaaaataggtgctaagcacatttgtttgtaatgatcattcatataatttagaagatttatggtaacagtttat

SEQ ID NO: 1274 - DNA, 300 bp, Homo sapiens
ctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttgga

SEQ ID NO: 1275 - DNA, 300 bp, Homo sapiens
actgtggagagatctcagtttttctatctgtaattgctcatattttgaatgctaagttttcatcaaccataatttttacgtgctctaatatgtttcttcacagattcatgccatgttcagtttaaaagagtcctgttcttttaatacattatctttgaaatgcctcttactgaggaatgactaaacttcttctgaaatgtgctctctggattgaagtcaagagtacatgttgcaacaaagataatcatgacttttagtattaagagacaattaccagattgagtgctacttagaaaagtt

SEQ ID NO: 1276 - DNA, 300 bp, Homo sapiens
aaatgctgaatattggtaacaagcaacaggggaaacaaggcagtctgagcacacagaactcaagtcctcctaatgggatcccagaatgcccatggaggaagcagcatgtgcactgtgctgagtgctgagcaggatttcaagagagcaaaggcagagatgctggacagggcagcacaggaggacgagtgtgcatggtcactctgagcagggctggttcctgggctggttggagcacagcatggggaactgaaaggcagacactggccaagaaagtccttgtgcagggcttcagaagtgagc

SEQ ID NO: 1277 - DNA, 300 bp, Homo sapiens
gttactttctttctcacacaaaggaaaaaagagactatctttaggaaacactgctttaaatcatcttccttgaatattaattctctgttgcttcctccaaaaatggagaaaataatccctaccctcataggcttattataaggctcaattatgataatggtgtgaaaactttgaaaattagacttcagagaaattgagttaatctgggattatttatcaatgtcttagtaaccaaaagtttaaaatgtgttttgtctaccaactggttgcatgtacatggttaatccaaaaggctcagct

SEQ ID NO: 1278 - DNA, 300 bp, Homo sapiens
agacaacgggaggggtcaggtgtagtgagcaggagatgaccatcctcaacctcgccaggccaaatctcaacccaaacaacaattgttatttttgtacattcccttccagaccccatttgcgagctctactgcattgcctatttgcaaatcctagtagcacaagaggacaaccacaaacaacctgacattcgaagtcacacaagcgcaagtttttcccatcatgcctagttggcaatcatcggctgagcagtaaatcagaattttgtcccgaatgttactcacctgttagtcgcagccctc

SEQ ID NO: 1279 - DNA, 280 bp, Homo sapiens
gaggagttaaattttgaagctctttgagaaaggtaccttttcttaacatgttttataaataaaaatacaatggcttatttaaaatgtccctatgcatggtgaaatgttaaataccaagtggatgaatggttctcaaatatattgtaatggagaattattcacatgcatctattgtttaaactaataagtaaaatagacttcctttttctgttctgttttaaatgtgcactaaaattacctgcttgtggttaagcatgggctggacagtttattgattttt

SEQ ID NO: 1280 - DNA, 300 bp, Homo sapiens
ccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggacaat

SEQ ID NO: 1281 - DNA, 300 bp, Homo sapiens
cagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcaga

SEQ ID NO: 1282 - DNA, 300 bp, Homo sapiens
acacagccctgggcaggaagggaggcaggaagagagatcctcaggggctgggctggaggagcaaagccagccaaaggggagtgagagggcagtcaagcgcctagaagccaaggaaccccaggaggatggcatcgggcaggtgcctcctggtgcccagagacaaaaagatgtgtgggaaggtgacagaatcaagcggtaaggtcagtgctttgagggagcaggcaaccaccagcctccagtgacacttgcctttcacagggatcctggaggtccccatttgggaaggtggaaaatctcagt

SEQ ID NO: 1283 - DNA, 296 bp, Homo sapiens
gtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataaactggtg

SEQ ID NO: 1284 - DNA, 300 bp, Homo sapiens
cgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagc

SEQ ID NO: 1285 - DNA, 300 bp, Homo sapiens
atcaccttggagctccttgagtgagttctgatcaagccattacactcttttcatgtagacctgcctgtaagtgtagacatgcacactcagctgaccttactgttcaaaagctggagaaaaagaaacagctttcatacagtgcaaactgtctacgtctatgtaaaagaatttgagaaacatggcagtagccattgctaattaatctgggtatgtgtaaatagtttaacttgatttttgactctggtgtttggatctattttaagatcgatggagttaattgcttcatgacagttcttatga

SEQ ID NO: 1286 - DNA, 300 bp, Homo sapiens
cggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatca

SEQ ID NO: 1287 - DNA, 300 bp, Homo sapiens
ggccatttccccagcaattacttagataatagggggactgggttgggtgggaggaggtgttcattctctctaaaccatcctgccctgaaccgccattccttcttccatctccagagctgggctccggatggggaaggaaaaggtctggttgcctaaccacctccttcctcatccaaccctgaaacccccaggatgtggaagaaaaacaggtagcattttgctttcataatgcaaagacctaaagatgcatctgtgtttgtcaggcatgtatgcatgtgtgcctgggtgtgcacatgtgcg

SEQ ID NO: 1288 - DNA, 300 bp, Homo sapiens
aacatgagggccctctatgccagaagtgaattcatctcacaaaacatgttgactctagactggtgcctcctccagctactactacccccattagtcacctagtaaaaaatgacgacatttcatcacctgcacatgaaccgctttccccccatttcttaatcatgaatttctgtgtcttaaattattaatggctaagactaggtctggcagttaatttctctctcctggatttttggcccaactcgagtatttttgaaaaaccgacacagtattttaggggagcccaaaaaccatgatggg

SEQ ID NO: 1289 - DNA, 300 bp, Homo sapiens
atggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctc

SEQ ID NO: 1290 - DNA, 300 bp, Homo sapiens
ctggtcagggtttgactcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaag

SEQ ID NO: 1291 - DNA, 300 bp, Homo sapiens
gttttatacattttatgttctttgcaaaactggagccccagaaagaatacaaagtgagcttctgttcccacttctcccagaatagcctaggatgggcaaccatgtaaaattcaataaaaatccaaccttctaactaactcgtggtgttggagagtattaagcatttgaaaagttcaggtagaattttcatcctttttgagctctttcctagctgctttgctgtgatatatctgtcactccagatgagggagtagtggtggaaaaggaatgcattctcagattcattgttggtagttcaaa

SEQ ID NO: 1292 - DNA, 300 bp, Homo sapiens
aggtaggcacctggcatgtcagttgcctgaatttgaaagttttcacctgtatgttttggtacgataaaaataaaaatgtaatttatatatctgaatcaggtctgtatgttatgatcaattgctcagcaatttcgggcagttggtttgatggttatgtagtaatgtagcctgagagcagaaatacagagcctctgggctagagaaagtataaatggcatcctaggctatgtagggttacagctcttcagaaggaactttcattttcattgtgacacatcgtctacatgttgtagaagaaca

SEQ ID NO: 1293 - DNA, 300 bp, Homo sapiens
gttgtaccaataaagtttgcaacctacagcaatagccagtcaataaaggaaatgatgctgatgtagcatttatgagccttaaaaaacaaacaaaaaaccttaagatgttaaatttattccaaggattctttttttttgttgtacatgaatgttcatatcaggtttatttgtaatagccaaaacagtatacacctgaatgcccaccaacaagtgactagataagcaaagtacggtacatggatatgatggactacctcagagcaataaaaaagaatggactattgatacatgctacaacat

SEQ ID NO: 1294 - DNA, 300 bp, Homo sapiens
gtttccttctgttgtcctgtgcattataatatacaaaataacttattttgatgatcagaggtcttgaggtcttgacctcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttatacccctt

SEQ ID NO: 1295 - DNA, 300 bp, Homo sapiens
acggagttgagttgctaacttttttccttttcctcagtttccagatgagtttagcagtaaagatgcttttcccaggcacaaattgggaatggaaatcacctagttccgttccctctgacagctgtaatccagagagctaagctgcttacttcattagcttggtataagctgacgacagcagtgcccttgctttatatttgtcagagctaggaaataagccttctttttttctgctgtaatcatagttacccttgaactgaaatatcttacatttattctcaagcaggtagggagaggaga

SEQ ID NO: 1296 - DNA, 300 bp, Homo sapiens
ggttcataaacacatggctaacaaagtaaagccttcaagtctggcacagactcttgactacacgatgggaaaagggattccaattacgatttaacttgtattttaaagatgagaaaagaaatgaataagaaaatttgttgctatttttcttcttccaaattagaatctatatctctaaaaatactttgcatgtttagtaaacatccatcttgaacagaagataccttgacatcagttctatttaatacttatggcaattaagagatttagaaagcagaggaaaagaccaaaaaaaagtat

SEQ ID NO: 1297 - DNA, 289 bp, Homo sapiens
  misc_feature (1)...(289): n = A,T,C or G
gagacatggctgtctcaagactgttttgtttcccttcctggtggaattttgcacttttatgtcctgtgtagcagcaggtagtgtggctttgagaaaataaaatggccaccttgctccgctgttctttctttgtaaaaaaaaaaaancggcnnaacaatnttggcctttntagctnggnnaccccnggccggncaatccctnctnctctcnaagcctcggnttcctcccctgaaaagtaaagaaaataactcctaaactgcctcccnaggcttgctggcaggatccaagg

SEQ ID NO: 1298 - DNA, 300 bp, Homo sapiens
ttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagccca

SEQ ID NO: 1299 - DNA, 300 bp, Homo sapiens
gctgcttcctcaagaaaatgaagagggaaggatggctcagggaaagtaaatcagagggaaaatgtcactctgtaaagagtaaaaaatttaggatgatgatacgatctgggaaaaaaaggcatattgaagaccacttaaaaacaaacaaaaaaacctatgaaggtgcatgctatttccccagagctaaaaagataagtgaaattgtgtttgaactcttaagtggaggtgaagcagaatttattagccaccaaccacataagtgattatgaagtaactgagaaacaggtaacattttttccc

SEQ ID NO: 1300 - DNA, 300 bp, Homo sapiens
cttggggtgagtctcatcttcaccctttcaccaactgtcctggtaacaatctcccttccatttccttgttcttacagcataccccatagaatcaagcctcgttattgccagggctgaactgacttttttgtttttgtttttgttttaagcagtaccattgtgcaccttgggaaaattcctgtgttgatctaattttaccatattcttcactccactgaccactccaattaggatactcctggcactcttggttttagagaggcttagatatgtggctatttatcctttggtcttcagcac

SEQ ID NO: 1301 - DNA, 300 bp, Homo sapiens
aggaagctggttgagaagaagaaggaaaaagtcgattctactgactgacgtttccccctgctgttaagaatcccaaccacacactttcacacactattccaggttctggctactgaatgatcccacagctgaggtctattgtcatcgctccacttctatttttagcagcactaaaaacattcccaaaaaaaatgttttttagctttttaactgcgattcaccactaagaaattggcattggaacagtccacagagcttattcaaatttcacccattttacatgcactcatttgtgttgca

SEQ ID NO: 1302 - DNA, 300 bp, Homo sapiens
ggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcct

SEQ ID NO: 1303 - DNA, 299 bp, Homo sapiens
  misc_feature (1)...(299): n = A,T,C or G
gtgctgtctttcctgagccgctacagtaaaagtgaagacatggaaaattatcccagatgggacgaatcgctcattctctgttctttttttaaaaagaaaagatttcagaaaaaaaaaaagtcgtctttttctttaaaacagtatgaataaaatctggacagctgtcgaaaaagatatgccgtctgcatttttttttaatttctagccaccaccataactaaatagcttgaatagaacctcttttcttttttttccccttcatacataangatctctacttcnttaaaagcgtattaatc

SEQ ID NO: 1304 - DNA, 300 bp, Homo sapiens
gattcatttttgtactagttaatatcaactctttctcagaagtagtcaaaatataaataggaagttcttcaaaagtaacccaggagcaacagctgagcagtgccagagttgtgaggtaaacatcaatcatttcacaaatgttctgacttgttgagcagtgttcatttccaggtttcaaacttaaagtatctattaagcaatcttaaaagaaagaacaccgccttaggaaaaaagagatttgccaaactcttcatacttccttcaataactgcttagcaaacactcttgagtgtcttctat

SEQ ID NO: 1305 - DNA, 298 bp, Homo sapiens
  misc_feature (1)...(298): n = A,T,C or G
ttgctctatgtgatgtttattatcaaatacatataattttgaagattttaatgaatggcttaagattttatctttgtgtagaatgtggctaaagaaaccttagttgagattcaagaagttggtgtctgtttctgattcttatcacaacttgctacttagtgtctaccaagtcctccacctctttgctcctcaaagagctgtgaacactgatggcaggagccggcaccacnccacnnacttagagancnncncanagctgccatacnggcgatcnctgacntcanacttccccctctaa

SEQ ID NO: 1306 - DNA, 300 bp, Homo sapiens
gcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtct

SEQ ID NO: 1307 - DNA, 300 bp, Homo sapiens
gtttgtttttcctgagacaagaaaatcgcattcttgtttatatttgaagatagcaacttttagccatcatgtgaaatatggttattgtttctgtacacctggaacgttgtagtgcctgatactgagattttggaaacactgaagaattatagcattataagaattttaaatttatgagaaaatctgagacaggggcagagatggctgattttgatcttgctggatcttagaccatgagaatgacaggcctgaagccctgaaatctcacctcagggtggagtgtcagacttggcaactttg

SEQ ID NO: 1308 - DNA, 300 bp, Homo sapiens
gcattttaaatttttgtcagtgtccttcatgtctcagctcctgtcttccaataattttctgaaaaaggtaatgtgttctttaaatgtgtttataaaaaggtattctgctgtctccaaggaactgttctcaaccagtagaagtagcttggtaaatggctcatgaaaatgggaggcacgcctttaaagataatagaacaagaaagtacgtttcaccatgaaaagccgttcgtcatgatctactgagatggaacataatgtaaactctgtgactcagtggtttcattcttaagtgttgtgtac

SEQ ID NO: 1309 - DNA, 300 bp, Homo sapiens
ttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatg

SEQ ID NO: 1310 - DNA, 300 bp, Homo sapiens
ggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccac

SEQ ID NO: 1311 - DNA, 300 bp, Homo sapiens
cctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaa

SEQ ID NO: 1312 - DNA, 132 bp, Homo sapiens
gatcagtgaaaaacattagtatacgtttttaaataggctaatttttcaacttggatcattaggcttacgtactacttgtttcaaatgtgtcaaatacaaaaatggtaactaggttgacagatactttgtatt

SEQ ID NO: 1313 - DNA, 300 bp, Homo sapiens
aatgaaggttggggagaaaagaaagcaatttaggagactctatagggaggaaaggatgagatgcatttcagaaacaaaatattaacgtaaacagaaaaaagagaaagcaatcatgacaaagcctaagagggctagtggaatgctagaatgaactcatttaccttcctttgatatttaggggctctattgcctgctaatttcatcactgttatttttcttacctcttatctttttccctgtagttattatcagcctaatattcattcattcattcatttacctgagttttcaggcttgtgc

SEQ ID NO: 1314 - DNA, 300 bp, Homo sapiens
gtgatatgaaaagcgaatgcaccatttcttggtgatgattcaggtcagcgttgggacccaggaatctcctgttaatcagtaccctggtgattttgatccaggtcatcaagaccatggcttccatcgtaggcagtcacactctttctctcttggatcatttgctgtggggaagcaaactgtcatatgagaggacactcaaacagcctctggagtctcatttgctaaggaactgaggactccagcctgagaactcaggcaagtaactgaggcctgccaacaaccatggagaaagcctggaag

SEQ ID NO: 1315 - DNA, 300 bp, Homo sapiens
gctaaggttaaatagtatgtattcctttcttacagtttttactctaagatagctatttcctcagtgttaactcattaaattacttgataagaaccagctttatattgtaagatgtgtaagcagtgggagcaatggtggaaatagcctttctattttatttacccaagtctgtgtactcctcatccttaccagggcccctaactgatctttccactaaattatgtgtgtcacagcgaaattaaaattactcttccaaagtgcaactctaatcatggcacttaagggattttcctttactta

SEQ ID NO: 1316 - DNA, 300 bp, Homo sapiens
ggtagcacaggcctgcccttgcacccatgctgtacagtgcggttactagacttgtggccgttgttgtgctgtcttctcattagcatgcaatattcacttgactgaattcctttttagctaagagaaatattacagggcatgatcattttaggttattaaggtgtctaactcaatatgtaaactgctgaaaagaattatatgtttttatcagataatctcaacatttcaaaagacaacacattcagactactcccctttccccccaacttttatctagtgtctgaaaccacatgactagtg

SEQ ID NO: 1317 - DNA, 55 bp, Homo sapiens
gcatcctgtccttgggaaccaatttctcattattgtcagccggtcagctgcctgc

SEQ ID NO: 1318 - DNA, 300 bp, Homo sapiens
  misc_feature (1)...(300): n = A,T,C or G
gaggaagtgagattgtgcatgacatacttctcctttgtattctctcagtgccttacagcaggttactccattctgctatgacaacttgtttcaaatgttaatttacataggattttttataagccattaaggcatatgtatagtatatcagtaaagatggatggtgcatatataaatagtcttctgtaatagtgattggatttacttctggattatnagagactcaaaatnttccccancctgtctctatcctttcncaggttgatcccttgtcatgatttttcattacggtggttcagg

SEQ ID NO: 1319 - DNA, 300 bp, Homo sapiens
  misc_feature (1)...(300): n = A,T,C or G
cctcatcagcaagccagtgagagggtgcctatccgaggatgatattncatcacctctggcagattctgcttactagtcagtccccaggcccaggccactcgcaaggggaggacattacaggaggcgtgagtataggtggtgtgatctgtggggaccgtcgcagaggctgcccaccacaaggggttaaaacctataaaacttcgaagttggatttaataattttcaattactaggaaatagataaaaacaaattttctgtccttcacagaacactaaagtatgtattggattttttatccc

SEQ ID NO: 1320 - DNA, 300 bp, Homo sapiens
gtacaactcttaaagctttctacattttacatatacagtcatctctcagcatccgaggaagattggttccaggatggctcaaggtcctgatataaaattgcgtagtatttgtatataacctatgtacatcttctcgtattctttaatctctagattacttataatacctgatactatgtagatgctatgtaaataattgttatactgtattattttcaaattgttttattgctatttttattgcttttccctgaaatatttttaatccacagtaggcggatgcagaacctctttatacgg

SEQ ID NO: 1321 - DNA, 300 bp, Homo sapiens
gtgaattcctcagcaccaagttgtttaacacagaagagaggtggaaacaaaaaatgcttggattttactggctttcttttagcatttctgtctagtcgaaatgggggccaggcttgcacacatagacaactgaatgaatgtaaccggacctattccatctaggctgacctcttgaaagataggaggggaagtctaaaacaggagaaaagttttagaaatcctttggattaggcttacccagattagtggtatgtaaaatattatgatattcttagtgtttcaggattatggattttaagt

SEQ ID NO: 1322 - DNA, 300 bp, Homo sapiens
taaacatccagatgtgttttgatagcctggggtaattaaggttgaggacaagtgtaccagatcaaggagaggaacccgtcccatgcctgccgtgtgttcaggtggctagacttgttgttgcatctgttagttccactcttagtacatcattgtgctgtgaggtgtcattagccgccgtttaatttttcttttgtttttagagacagtgtcttgctctcaccccggcttaagtacagtgacatgatcatagctgactgcaacctcaaactcctgtactcaagtgatcctcctgtcttagtg

SEQ ID NO: 1323 - DNA, 300 bp, Homo sapiens
ctcgagttttcttatccagttgaggccgccttcgctgtactcactctctgcctcccaccccatcttctgccacccgacctccatctttgatggttagcgccttcagccctcaacagcttcgcacaaccaacccctagaagccgtggagtcagaccggccagggtgggacctaggttttaactcgggttctggctacacacgctgcgcctccatacagtttgtcccaggtttggcagcaggccggctaccttcaggaattctttgctttggcttctgtctgttcctgtctgttgggcaagt

SEQ ID NO: 1324 - DNA, 300 bp, Homo sapiens
cgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtgga

SEQ ID NO: 1325 - DNA, 300 bp, Homo sapiens
ccttgggccagaccctttcccctggggtgctgatttcacacctgtaaaatgaagaagtttgacttgcacagtgcttttcttagactgtggtaaggggtggatgtgggggtagtgccaagaccaagtgaaagaggcttctggacctccatccttgcttcagccagagcagcgtgggttcatttcatttttggattttggtttgtgggaagaaagggttctcttgccggtgtgtgtgtttctgataaacaaagaagtgtggaagtggctgaatgagatgacccaaggactctttctgggaag

SEQ ID NO: 1326 - DNA, 300 bp, Homo sapiens
tttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgccactgcactccagccgggcaatg

SEQ ID NO: 1327 - DNA, 300 bp, Homo sapiens
cagctactcgggaggctgagggcacaagaattgcttgaacccgggaggcagaggttgcagtgagccgagattgtgccaccgcactccagcctgaatgacagagcgagactccacctaaaaaaagtaaaagaaaaaaaagaggaagaattagcacatttctattacagaattggacttgaacatgcaaaatcatgtctggatttctcagtgaaaagctgttttacgttagtggactcttctaacattttgaaatggtgatctggatttgggatctggctatcactgacccaccttgggtct

SEQ ID NO: 1328 - DNA, 300 bp, Homo sapiens
ggcaaggagtttgaattttattcaagaattttattcaagaattttatttattttattcttgaattttattcaagaataatggctagccattgaagagtttaaagtagggaaacagtgctttcttattcacattttgcaaagttctccatgggctactatgtgaataatcagtccaagggggaggtaagagtagaagttgggagactagttacaaagtcattgcagtttggagattatggcaccttggactgtaggtgatagggatggagatgacgataagtgaatatatccagaaaatat

SEQ ID NO: 1329 - DNA, 294 bp, Homo sapiens
gtcagaatggggaaagtggcaggatgcaggcaaacatgttcttaatttagagacacgatgaaggctcaggactttcctaggcagataaaagaagaaagaagctgctttttgaaaagagggatcaagattatgacaaaaagggagattcagccatcagcagaacccaaatgagagcctacaaagagacactgtctactcagagtacatcttcagacatccagggtcccaagctactgtgtttactgttagcccttatccattgttatgtcttactgctttataactcttctttaa

SEQ ID NO: 1330 - DNA, 300 bp, Homo sapiens
gtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaa

SEQ ID NO: 1331 - DNA, 298 bp, Homo sapiens
  misc_feature (1)...(298): n = A,T,C or G
actttcaacatttcatggatagaataagtaatggtgggttagaagaaggaaaacctggggatctagttcttagctggggtggacaattttgaagctcgaatgacaataaataccagcttggaatgaacttggaacaaacatggatggaaatctggggtcaagggaaaatggcagtttcaggggaatataccaggttaataaatccnggaaaaactgnttggtttgngggggnctccaccacttggaagttgctgnaannattgatgnaaagaactctgaaannaaaaggtgttgggca

SEQ ID NO: 1332 - DNA, 300 bp, Homo sapiens
aggatatgttgcactagttgttccttgtgactggaatattctctgcccaaactttgaaaggctagttagttacttctcatcattcgggcttaggttaagtgtttcctccttagagttcttccttgatttatcttccccccagtctaaagtgccagtcacattaatctgttttatttctccatacagcactcatcactgattttttaaaaatctattttgccatctttctctctcactggaatattatgtgctcatgaagaagctccttggctattttgttcctgatcgtctgcgctgcat

SEQ ID NO: 1333 - DNA, 300 bp, Homo sapiens
aaaaattttatggacttctatggatatttcttgatgcttagagatttgtttttttaattgcaaatgtgaatagtctatttacaaatgctattacatatggagcgggcctgtggtgtatggcactattccttggactaatggtacccaggttccattctctgctcagctcggaggctctagacaaagcccctaaaatgctgtctgcttcagtctccttaatggtgaagtggaaatgaatacctactgtcacttaactcatggagatgctggactgataattagatcatgtaagagcacttt

SEQ ID NO: 1334 - DNA, 300 bp, Homo sapiens
ggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtaggcagtgaggaggcggacagcatcaccttgggccggtatctccggcagctggcacgccatcggaacttcctgtggttcgtgagcatggacctggtgcaggtgcagtggctcacgcctgtaatcccagcact

SEQ ID NO: 1335 - DNA, 300 bp, Homo sapiens
caagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatac

SEQ ID NO: 1336 - DNA, 300 bp, Homo sapiens
aaagcctaactagttatgataaatgtatccgtaagtaaagtaattaagccagtttggggttggcagaggaattgtgccagacatctgtggattttgctacccagcagcattcgctcttctcctggttgtggggccccagccctgttgctattacctggaactaaaggttaagatgatggttcaaagatgaagccaccatggaagagagcatagcggacagatggagagaaactgcatccaggtgaccccatttgtactaaacctggttacctggtttttctttagtacatatgccagttt

SEQ ID NO: 1337 - DNA, 292 bp, Homo sapiens
  misc_feature (1)...(292): n = A,T,C or G
ccctcttaaaaatacaaaaatcaaaaagaggaaaataagttaaattaagcccaagtaacaaaaatactggaattattaaaacgtatagtatgctagctatccttttaaattatgctaattctcttcttctgaaattatggtcacactatatactatagcatttcggttttatcctttgataaaacttttcttttttctttttttttttgaaacagggtctnaccccgtcgnanaggctgnagngcaggggcaaagnctcnactnantgcagccttgacctccnggncccagg

SEQ ID NO: 1338 - DNA, 300 bp, Homo sapiens
caaagtcataccaaaacttcacttaagagtccctacccctactccagtgcttatttcattatctagcagaatgtacctttatttgattcactatttaccactgattaaagtggagcgtctgtggagttatacgttactttgtagacttttgtctagtgaaatacaaaagacaaccccaaaggttataatttttttgcctatagaacatttcaggaaacaggagtaggatttttgtctataatatagcaaacttgcttcaacataccttccacaacttacaaatgctctttgaaccagcct

SEQ ID NO: 1339 - DNA, 300 bp, Homo sapiens
gcatttggcccattggccgcattctgctgacccatcaccttggtgctttttctgctttttctctgttgtcctctgtgtgtgttcctttgtcctgatccttgtcaccttgtgggtccaaaatggttccactagcctcatggagcctggccttacattgcagagtccaaagcaggagctgagggaaaatgaaaaacaacttcttcatcaccggaagcccagcaaacttctccttaaaaatcactggtcagggctgggtgcagtggctcacacttgtaatgccagcactttgggaggctgaga

SEQ ID NO: 1340 - DNA, 300 bp, Homo sapiens
ccctcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacaatactgtgactctgagtaac

SEQ ID NO: 1341 - DNA, 300 bp, Homo sapiens
ggccttccagatcgtgctgtcccacctacctgcaccgccgaggccttccagatcgtgctgtcccacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctcccttggggctgcccctgtggagggggatcccgcctctagaactatagtgagtcgtattacgtag

SEQ ID NO: 1342 - DNA, 300 bp, Homo sapiens
aactgacctaagcctcagtttttcagatctgtagtacttactttacatgattgctctttgaattgaataacataatttatgtgaaaacacttaattatgaatgctgtaaaactatcaaagccattaatatgtgttatagtagcatcatacattttgcagcataatccagagaacaaggagttgttaacaagggagaggaagataatctggttgggctagtattatactctcaggtgctactgacttcttagatgaccttcaagatgttagtacaactctctacttggagatgctattttc

SEQ ID NO: 1343 - DNA, 300 bp, Homo sapiens
atgttttgggaaatagcttgcgagaggtaagaaggattgcaaagtttttccaaaatattttatgaagttagtgaagtcagttgaaatgtgtatttaaacatttgaagggatacagttaacatttttttaatgagaggaaaccattgtctgtagttcagaaataagatggagtgttttacttatttaaggggtaatttaaaaagtaaacaaaagcattggcctacaagagaaaggtgatgttggattataagtgctttttctaatcgttaatattaatcaacaggtgagtatattttccgt

SEQ ID NO: 1344 - DNA, 300 bp, Homo sapiens
tcttgactgaggttcccatctttcttagttctcttaaggatgtgctattctattctagatgcataggagggaagttaatccagtcttagatcagcagggctgagttctttctcagaaccatagttgaaaaagcctaaatagaattttaggaaagttctatttagaaagaaactaagaattatgattaagttttggcctaagcaacttaataggcagtggtatcatttattgagaagcaaatcagataagaagcaggttatggggcttgggaggaggtaagggcagaaagttgggtattct

SEQ ID NO: 1345 - DNA, 300 bp, Homo sapiens
ccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggaagtcatttacacatccttatataccatgaggggcaaaagtaagctttcttcctcccaaagcaaaactctttttccttaaggagctgg

SEQ ID NO: 1346 - DNA, 300 bp, Homo sapiens
ctgaaatgtcaaacacggccacctaggcagcatttacaagcaagagtccactgcttttttgatgtatatcttaagcgcccccagtgaatgaacagcatataactccacataaaaatcattaaatgtaattgacttccagagcaggcagttctgttgtatgcctctggagaaggctggctgaattggaattggtctgtaccttctgcctatcatgtacatgaggtttttgggcaaagagaactttccacaaaataagtccaaaaattatagatcatcagacaaccaataacatattgatga

SEQ ID NO: 1347 - DNA, 300 bp, Homo sapiens
cttgctcatcctcatttggtaaactgctacgttaaatgtttcaggtatgtctgattgacctgtcctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtgg

SEQ ID NO: 1348 - DNA, 300 bp, Homo sapiens
gggatccctccctccacccgccccccagccccgggaccccgagtgccactccagcctcaccccctgccagtgccactcctagccagcgccagtgcgtctccgcagccaccagcaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaa

SEQ ID NO: 1349 - DNA, 300 bp, Homo sapiens
  misc_feature (1)...(300): n = A,T,C or G
aagaattgnacgactcttattgatgagtgcaaaatttttctatagatttgaaagtcactactaatcatgactagctgattataataattgagagtaaacttttaaaattattaaatatcctgtgaaagttggagcacagtaaccattaaccctaaatttgatactatgtccatatgaattcagatcataatagtgctctatcatgtgaaactactaaaggatgtatagagttaaatattacgtatccactttaatgaagaataggtattacacagtaatggttgtttaaaaaaatttttt

SEQ ID NO: 1350 - DNA, 300 bp, Homo sapiens
  misc_feature (1)...(300): n = A,T,C or G
gccctgtgttaatccaggtgagaacaggtagtacccaaattagggcatggtagcagggatgcagaggaaagaagaggagtaggaactatttgggaggtagtattactaggattttagctttgaagggttgagagaaatgtcaagcctaactacaagcaaggtttctagtatcagtaacttcatatcatttgaaatacananattagcaatcaatgtatanancntnctgggctaancntagcatgaantctgacttcantgtagcattgaggagggtcctggcctcagatactgcaccag

SEQ ID NO: 1351 - DNA, 300 bp, Homo sapiens
  misc_feature (1)...(300): n = A,T,C or G
agatactgtatatttgaacaagatttttttttatcatttctatagtcttggagttcatttgtaaggcagtgtcttgacttggaaaggatgtgttaatggggtgactttgtagcatggtatgttgtcttgagttaactgtagtgggtggggaggtccaatgccctccgcaatgcccttcatctcctgtgttgtcctgtaccctgctcagctccatcctggggttcagggaaggcacacttcccagcccagctgtgttttatgtanccganatanagngnngtccgattcaanntcatncac

SEQ ID NO: 1352 - DNA, 300 bp, Homo sapiens
gctattccgaatagccccaggtgatccagctcacaccaacgtagcaatggaagtcagcacctctgctgggccaaggccatgcttccccagcctgtggctgcgcctctgctgtctctccgggtctcacctgggcgggaggctcctctggaggccaggacctgccttgtgagggtgcccttgtgggagaggcgcttgcccaaacctgctgttccccgggggctccttggtggcccccaggactggagctctctgccagagtgcccctccccagaggttaggactcccatgaccctgtcccct

SEQ ID NO: 1353 - DNA, 300 bp, Homo sapiens
gctgagtatttttttcaagtgtatcatttgcctgttaacttaaaattctattttccccctaattctatgtcccagttttggttagtgtgctctgggatttttgacccattccatagtaatagttattactactaccactacagtaaattcttacaagaactttccatgttttttgggaggaggaggaggagtagttacattcaggatcatatacataattgtttagcttcagttctgtatttatatatgtcacttgtaactgactgggatacgttctgagaaatacattctcaggtaatt

SEQ ID NO: 1354 - DNA, 300 bp, Homo sapiens
acatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctggga

SEQ ID NO: 1355 - DNA, 300 bp, Homo sapiens
gattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattc

SEQ ID NO: 1356 - DNA, 300 bp, Homo sapiens
  misc_feature (1)...(300): n = A,T,C or G
ggcatctggactaatagtgaacgagtggaatagtgtgaaactgcatgctacagctatgaatacacgtattcaggaaagaccccaatgatgcntganaacttctactttggctncctaangntgaatncaattcacatctctnagaggntcaccgtaaacagntttggannctacccttnatntggacanattganttctcctgaggtggatcttgtatngctctagaaactangcatcntcaccatgtgctgaataanagtgtnntcggtgtaatngccgcgcacgtatgnnnacatttg

SEQ ID NO: 1357 - DNA, 300 bp, Homo sapiens
ccataagtgacttgcaaagggcctcccccataggaaggcctcagcaaattttcagtgaactcaagttcattgatttccaatttgtgaaataaactagagggcctctctgaactacctgcctcatgagaatgactgtgaagtgtagtcagtttaaaacaaacagacaaaaacaaagctagacagcattacaggtttctcagaaagaaggaaggttcaagttcacattggtactggtaccacgttgccattgccctcctagactgttctctgcaagctttctatttactggaggctggaata

SEQ ID NO: 1358 - DNA, 86 bp, Homo sapiens
  misc_feature (1)...(86): n = A,T,C or G
ccattgtgaagggttatgcccctgagagcgtgctggagcgcaactggtgcacagagaangtggacgtgncnggggacggggggact

SEQ ID NO: 1359 - DNA, 300 bp, Homo sapiens
ggctgtgttgtgtgtcttgtttgatgtaaagatagtttctgtaatagttttgcagtttgattgttcatctttaggtcttcaattacaacctgcacatccatcccctctatcctctttcttactctgtttttctccatagcacttatcatccaataatatgtcatgcactttatttatctgttttgcatatatattttgtctgttacctgtttccttccactagaatgtaagtcccatgagggcagggacttgcatctattttgtttgtggttgtatctctaacacctgggatagtcactg

SEQ ID NO: 1360 - DNA, 300 bp, Homo sapiens
gctgcttcattaaactcttcttgagtgaggggaatgaggattgtcctaatcccttggcacgaggtgttcctgggccttggggagctgcttctgtcctgcaactgggcagtggttgccgacatcctgctgatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcaca

SEQ ID NO: 1361 - DNA, 300 bp, Homo sapiens
gttacagggatcttgccacttaaagattcaatcttttagactggcaatgaggattcagacaactcaatctttgtgtaaatacttggtaaagcaacaggacacagaagaggaatgctggaaaaatctggtttatgaaaacagaaatcaaaccaagttactaaccaacctccccgtcccctccaggcacacaaaaacatttgcctttgtactctgccaatgcttgatttaattataatacacactcaagtggctgtaaaaaaacccaacagaacagaaaccatttaacatctgaatagtgat

SEQ ID NO: 1362 - DNA, 300 bp, Homo sapiens
cagctatcacaagtgttaatgtattttatgtgtagcccaagacagttcttcttccagtgtggcccagggaagccaaaagattggacatccctgtgttagaccatcatttgtttgctatatgatgtcatagtggtagaatggtcacttaaggtaaaatctgaatagagaaatttggcagaaatcataggaatttctgtttgaaggcataatgagggttaatcatttttcataatagatgttaagattaatagtaatcatagcccatatttattaagcactcgccacacactggtttcgaga

SEQ ID NO: 1363 - DNA, 300 bp, Homo sapiens
aatacacacaacatataagacatggcaattaactgtttatgttatcaggtttaaggcttctggtcaacagtaagctatgagtagttaagtttctggggggacaaaaatttggttgtcaactgatgggggggcggtgttggcacccctaacccgtgcactgttgaagggtcaattgtactgtatttatatatgccagcagctctccaactgtggtctgcagatctcatgaggtctcctttcaggggacccacatgggcaaaactatattcatactactactaaagccatttgcattttcca

SEQ ID NO: 1364 - DNA, 300 bp, Homo sapiens
gaaaagcacaccccaagttcgtacagatcccgtaccccattcttatcaggtggaagttctgggggctgagaagtccaagatcaaggtgctgccaatttggttcctggtgaatgagcaaacagcacagaaaaagaaacagcagtatatgtggaagaaagcaagaaaaatcaactggcctggaacctaagacttgtccaaagatgtcacagagagtaaaatgagaaaaatccagtagcccgtgcccagagcagttcctcgtacccagcagaagggaacgatgctcttcccaaggaaggcaga

SEQ ID NO: 1365 - DNA, 300 bp, Homo sapiens
ctcatcacactgttgtatacttcgtagctattacttctttaatccccaaggacttgtttaacaaagtattcttcagtttctacttcctagttcctttgtggaactggtaaaaatttaaaatatcttaacataatattttatttcaaatgataaacagtaaggtaaaatgtggtttttcttggacaacttatggtagaatgatgtctagaatatttagttatgtcatttaatactttttttctttacaatttaaaaaaaaatttattttattttagattcagggggtacacgtgcaggttt

SEQ ID NO: 1366 - DNA, 300 bp, Homo sapiens
tagttttaaatttagcaatttgatattgatacagatgaaacacctagatatatcactttttattgagagttggtgatcaaattgtacattagctagaaagaaggaaggaaaactgatgaaaattttacagtataaagtgtatgggtaaggtacacaaatcttttttttctcttttttttgggaccactgtcagaaacaaaattttgttcatcacattattctaatagaacgtctcacacagcatgcagtgagctattgaagtttattgtcctaggaggtattaacgaaacgaatgaactt

SEQ ID NO: 1367 - DNA, 300 bp, Homo sapiens
gctgggctagcagaaaacctcaggcatctgtgaggacatgagtttacacacgctgagactcacttatacaaaaatgcaacccaattccacccctgaattgaggggagtgcatagaagtgaatgtcccgtctttctgaggtctgttgattttgtaattagtaaacgaagggtgcatttctgatttttttttcttgtgtgctagaattcattgctagtaaaactcaagataatagcgatgagtaggaggtatcaaagatgaactgtatagggacagtttaagttacttaagaatcgtcagca

SEQ ID NO: 1368 - DNA, 300 bp, Homo sapiens
tctgggaccaataatgttttaaaaatatattcatttgagattcagaaaacttgcacatcatttgctactcctatcatcttaacagtgaagaaaactgaggcctagagacattaagggggttgcaggtccagagacatgtctcaagaaagcattgctgttaaaatgtgcagttcgtgggttttcagtccatctcttaagaaaccaagtcaatcttcccctcaggaaaaagaaaagaagtagcaataagcaatttgttaatatcactacttcttatcaaggtaaaaaatgcctcataatcag

SEQ ID NO: 1369 - DNA, 300 bp, Homo sapiens
agcagattcagtgtcgatgagagcctgcttcctgcttcatagatgatagaagtgcaaagccagctgtctgggccttttttatgatactgatcccattcatgaatgctctgccctcatgatcatttcaattcccaaaggccccacctcctaatattatcacagtgataattgggttttcaacacatgaatttgagagaaacacattcagttcctagcattagcttgcttatatttatttcatctcattctctctcatagcttttatttttgtttcccctgtccaatttattatagtttttt

SEQ ID NO: 1370 - DNA, 300 bp, Homo sapiens
gttatgagtggtcattgtgaaaatttggaggaatacaaaaagtagaagaaaataacagttctatatactagagttaacctttattaactgttttgtcatatgacatcaaaatgttatattattacctgttaaatttagtatagtatagtatactaaaacagtatgtttacaaaattgaactcactgtgcagatattacaggttttattcatgtaacactatagagtgtctattgtcacatgtcattcaagttcttctagagtgtgattttctcaggcacatattgcacagatgctctata

SEQ ID NO: 1371 - DNA, 300 bp, Homo sapiens
accaaacctggagtaaagtggttgaaaaaaaagaaagtataaaggggcttattaaagtggttaataaatatgatttaggttggtttttgatatgtttttcttccaactgttatataagaaactactaatgtaaaatagtaggctatatgttgggatgtgtatagctatgtcttcaagactaatactcagagaatcaaattgtagattgtacctatctgtgagcctatttctttagccagttttctgtctactgccaagaaacagaattctctgcctcatgcaaatgccctttcgtgttta

SEQ ID NO: 1372 - DNA, 300 bp, Homo sapiens
aaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctg

SEQ ID NO: 1373 - DNA, 300 bp, Homo sapiens
ggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggc

SEQ ID NO: 1374 - DNA, 300 bp, Homo sapiens
gcgggaccctgcctctactaaaaaattaaaaatagctatgcatggtagcacatgcctatagtcctagctactgaggaggctgaggtgggaggatcacttgagctcaagaattcaaggctgcagtgagctatgatggcactactgcactttagcctgggtgacagagtgagaccctatctcacaataaagtaaaataagaattaacacactcataataactatttagttaataggaaactctgtttaagcgatattgcttatatttctctctcatgcttttgtaggtctggactcatcctc

SEQ ID NO: 1375 - DNA, 300 bp, Homo sapiens
gaaagatagaaaatcacccaggggcctgtaggctggagcttctgtagacgcacagtggacactgccgagaaacaggcctcatttctcccatgttcccgtccccgctcccggtttcctgcatgactgctttggtgccccctgactccagaatcaacaccacaccagctctgcctttagactctgcccagaggctctgggctggatactgtatttggtgcgaccctctggggcatttttgcaagttttcaggcagatgggtgggggagcagtgaaggaaggaggaaaaaagacaaagcacaa

SEQ ID NO: 1376 - DNA, 300 bp, Homo sapiens
caagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacat

SEQ ID NO: 1377 - DNA, 300 bp, Homo sapiens
agaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaa

SEQ ID NO: 1378 - DNA, 300 bp, Homo sapiens
ggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaaagacctccgctacctccgggcccagctacaaaga

SEQ ID NO: 1379 - DNA, 300 bp, Homo sapiens
tcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaacgccatttcagaagagatgatagttttatcttgccaaggaattatcttcttagtagcctatattggcttattccaaaaaaggcg

SEQ ID NO: 1380 - DNA, 300 bp, Homo sapiens
gccatttatccttttatatttgattggctcagtgattttctttacttaaatgtagcatttatcaaccacaactagcagtgcatgttatagtgttaacagaaaattccacaggaccctcttcacactagggaaggggaccatctgctactttcatattaggatgtcaggatttagaggtcaatgtgtttcctcatcaaggctgaaggctttgggaatccggggaagtgtcaggctccaagcagcacagcctgctcaaacttcatatttaagcactggacaagacactgtttccaatcctac

SEQ ID NO: 1381 - DNA, 300 bp, Homo sapiens
atcacgcccagctaattttttgtattttttagtagagatgggatttcaccgtgttggccaggatggtcttgatctcctgatcttgcgatccacccgccttggcctcccagagtgctgggattacaggcatgagccaccacacctggccacagaagggatcatttctaaatagcatagaatcacagggagtacacctcatgtgacttcacgtttagagtcagcatttgctcataatgaattacatatcagtaaatgaacatgacatgcttcaacttcaataatattaaacaaaactctttc

SEQ ID NO: 1382 - DNA, 300 bp, Homo sapiens
cagggggtcagctctggtaaaaggcttggtaagaaggaggctgagagtaacagccaacataaggttttcagattatctacatccaggctcgcccccaaccctgtcctcaggaatcactgaatgcagccatgacactgaaatttgtttttcattcattattttttcattcttacaataaacgtggttttataagttagttaaaaagtctttttcaggatgccgtagtaaacaagagtcccttttgagcatttccttagtaaacgatgaatggctgctggtcaagcttgttctggcaagtct

SEQ ID NO: 1383 - DNA, 300 bp, Homo sapiens
gttttaagtattctcatccgtcaactgggattggtaatagtacagggctgttaggatgattgcatgagatgaaatacatttagcacttggtaagcactctataaatatggcaatatgatagtccctgactcatcttcctctctgttgccctttaaacaggtgagcacctagccttgttggttttatgtgctcaacagcagttgactcccctggctcctctcacccatgctactgcgtagtcaagccctccatagtctcctctctggtctctgtttcccatctgcctttgcctttccctct

SEQ ID NO: 1384 - DNA, 300 bp, Homo sapiens
gtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaa

SEQ ID NO: 1385 - DNA, 300 bp, Homo sapiens
  misc_feature (1)...(300): n = A,T,C or G
gcaagctggagagctgcagaggctggtagcgtggctcagtccaagcacagaggcctcaaaaccatggaagctgatggtataactcagtctgaggatgaaggcttcagaacctgggggactacaggtgcaagntctgganaccttttgctggaataaccttgntttttttgtncctntttnnanntttncnnttttcnntttncttnagnantttnttnnntgtttttntnnttnntnnnttnntgnnttttttnagctctnnttttntantttttntttntntnttntancttttttatg

SEQ ID NO: 1386 - DNA, 300 bp, Homo sapiens
cctttattcattttcactgttatccagaattccattatatgaatatgccataattttaaagttcacgttactattgttaagtgtttctaaactggaaattactccagacaatactatgagcacacctgtctgtggcttttgatgagcatctgaatgcaggccaaacttggcctgccaaacagtttctgccgttgtttgtaccagttcacactccctgccaaacagtttctgcaatgtttgtaccggttcacactcccacggcagcacatgaaagctttatttgctccatatcctctcaaa

SEQ ID NO: 1387 - DNA, 300 bp, Homo sapiens; identical to SEQ ID NO: 387

SEQ ID NO: 1388 - DNA, 300 bp, Homo sapiens
gccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagca

SEQ ID NO: 1389 - DNA, 300 bp, Homo sapiens
cccagaggccaccaatggcaatagtagccgaagcgtacctgtagttcagcttttgacatgtgtgtaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgggcttactgtgggctgcaaggcctcgtaggatttgccccccatgactttctgacttcatctcttgtcac

SEQ ID NO: 1390 - DNA, 300 bp, Homo sapiens
cttttctttgcagtatgaaggtagataattcttcaagttaaagatggacttttttcaccagaaatggctttatggaatcaatttgcaaaaatgtaagaggtggcaaaggaaagaataaaataatattttcattttcttctgttattcttagatcctttggtagattgtaaactccatgaaagcaggataccttcttttgccctaaggcttggcccaaaagagataccaaaaaaatacttgcttatatactaacctagtctctgggtgtgggagccatagagggttcagggtggggtggtg

SEQ ID NO: 1391 - DNA, 300 bp, Homo sapiens
ccctgccttttagttagcatatgcccttcttctcccccttgtagaagcagtaggggacagaaatgataagtcatatatggccggtgagtttttcttccaaagactggtccacactagagggtgcagcctccacagacactgggaattgctcctgacctatggaaaacaactttctttccaagaaaattatttttagtcctttggtgtaaagacacagtcctgagttgttttcacttactgaattctataactaggaatgaaacactatactcttgctaaaaatgaccttttttctttcag

SEQ ID NO: 1392 - DNA, 300 bp, Homo sapiens
gtaaacatacaataaagctgaaaattttagtgactacttatatgctcatcatctagattctatccttgagtaatctatttttataaaggtattgatgtaactattttataaatgaaaaactacacactaaaaaccaaatatgtgatctccagcatcacagaaatgaaataaggatttttttttaacttaggtaatattgcttgaactgtagtaattcaaatgtagcaatttcaaaggtagaatttcccatgtattactatactgcttcacatcagctctattaataaaagtagaacagtt

SEQ ID NO: 1393 - DNA, 300 bp, Homo sapiens
gggactacagctgtgtaccaccacaccggcctctcctggcttcttaaccacttacattaaaattgagaggagaaaggcattttcagtttctttagttaataaaaagaagccatttctggaggagttttatgcctgtaccagcagaggttcagctttccaggaatctcatcatgatccatactgctgacacaggcctttgtcacctgaagcattcttaaaataaggagactgacattaaacaggacaattgtgaactccactttgtaagcatcatacatatcttacaactcattctgaaga

SEQ ID NO: 1394 - DNA, 300 bp, Homo sapiens
gcctgaccaatatggagaaaccccatctctattaaaaatacaaaatttttaaaaaaaatacaaaattagccaggcgtggtggcacatgcctgtaatcccagctactcaggaggctgagccaggagaatcgcttgaacccgggagacggaggttgcagtaagccgagattgtgccattgcactccagcctgggcaacaagagcaaaactctgtctcagaaaatatatatatatccctaaaactacctcagttgaagaattcaaagtgcaaaataacttttcttaggattttttaatctatt

SEQ ID NO: 1395 - DNA, 300 bp, Homo sapiens
ggattacaggcacccgccaccatgcccagctaatttttgtatttttagtagagatgaggtttcaccatgttgaccaagatggtctcgaactcctgacctcaggtgatccacccacctcagcctcccaaagtgctgggattacaggcgtgagccactgtgcccggccccagttaggcttttgcaattacctagatcagagataatgatagctgtgactaggaggacagtggggaagtgacagagatggaacaaagcctaagggcctgtgagaggaagacccaggagtgaatctcaggtttc

SEQ ID NO: 1396 - DNA, 300 bp, Homo sapiens
gacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcatgacactctgtggtatcaacagaccaggaaagtgctgaggaaattcccattttaatcatcgaaggttttcttctttttaattataagcccctttgacacta

SEQ ID NO: 1397 - DNA, 300 bp, Homo sapiens
ccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctctccgacagtggtgtctgaacccttggggacgagggcctgggccgcggtgag

SEQ ID NO: 1398 - DNA, 300 bp, Homo sapiens
ggaggaaaaacagtgtcttgcacacagcaagcactcaatatttttggccgttgaactttatctgaacctcccttagagcatctattgtagcctgcttggtattctattttctcataggggcctcagtgtctgtagcccccaaagcaggggcacagactctgttagttattgatactgcttgttcgtactgaagagtatcaaaaggtggggagaacattgaaaaccaaagcatcctgagtacattcagtttgctgttttccaagacagacattccagatatatagaagccaaagtcctgtc

SEQ ID NO: 1399 - DNA, 300 bp, Homo sapiens
gtgtgagttgcatataacatatataaaagctgtaacctgggaaaaagttattatctggaagctttagaaattaatgttattctttcttaagtatcatcaggaaattaatcaaaatggccaccttgataccaaaaataaggttttggggcataacatccttatgaattcaaatgttagtcatttcacatatcttccactttatttcattaagtccttcctagtagacactgttcaaacattattcaccatttactaatgctgttacaacattattttagaagatggatatggatagctgtt

SEQ ID NO: 1400 - DNA, 300 bp, Homo sapiens
gcgggcacggcggtggctcggtctcccggctgcgcgcggagcgggagggctctcctcacacaagcgcttccttgccgagaggctggagctgcggcaccgcaggcctgagccaccccttctctgctgtctccttctcttcctcagggctcccgtgtctgctcgccctccgacgctgctcagactatggaaatgatgttagacaaaaagcaaattcaagtgattttcttattcaagttcaaaatgggtcataaagcagcagagacaactcgcagcatcaacaatgcatttggcccagaaatt

SEQ ID NO: 1401 - DNA, 300 bp, Homo sapiens
ctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaat

SEQ ID NO: 1402 - DNA, 300 bp, Homo sapiens
gaggaaagcggtgcgtgaggcgggcggccagggcacgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagag

SEQ ID NO: 1403 - DNA, 300 bp, Homo sapiens
  misc_feature (1)...(300): n = A,T,C or G
acattgtgttgcatcttataacttgtatagattgagctgattgaaataagattttgttccaagtattatctgatagaatacaagatgattcaaaattatatagatatttaaagcttttctgctgttttttttttttaattgcaacngcttttntgccgngcctntnttccctacccaaaagngatgagttctgancaagacaanactgtcatattgtaaanactttggtatgngatnccatanaatactgatnggatagccatcctagtcacttaccaatactgactaaaagttaactct

SEQ ID NO: 1404 - DNA, 300 bp, Homo sapiens
  misc_feature (1)...(300): n = A,T,C or G
attattataagactaacattctgataagccatggtataattaacattattaaaatgtttacatataatccttcttaaagtatactcttttaaaaatccattgacataaccttacttttagtttagtgatccagaatttccccagagcttaaagccactgcagtaaattagggtacgtaggatattcagtcgctactagccccaaggagtctccttatttaatggacctccctcagtacttaattcctgcagagcgcctcaaagtgggggaagagaaatgaancaantcntgggctcaagt

SEQ ID NO: 1405 - DNA, 300 bp, Homo sapiens
ctcagtaacccaattactagtaccttttgaagagaccaggctgggaattggtattaataataatagctgacatttaccaggggctacccacatgccaagcatcatgctaatcttgccaggtccttctgagtcagtgtgaatggcaggagcaccacatgttcctttctcttcagttcacacacattgagtgtcttcatgtgtaagtaacaacagagactgagggcatatgtattgtgtaaaaaaaaattttgttactgggaaaatagccattactgggaaatagctttgttacagaaagtc

SEQ ID NO: 1406 - DNA, 300 bp, Homo sapiens
gtcatgatcaactcagtataggttttcttaaaaaattttttcttaaaatgttttttaaacttcaaataagtttggttggtgctacagatttaaatcgacttgtttgtgaggataatagaattctttttgctatgaacttatcagtcagcccagcgtctgtgagacggtgcctgcttgcatggtgcagtccagagtgtattttgcaaacgtctagcactgcctttatgtaggacgcgtgcttcgttttattggtctaaaatttcccatgtcataacactttgatcatgccttagagaagtc

SEQ ID NO: 1407 - DNA, 300 bp, Homo sapiens
ggacaaaccatctccagagccttaatcgcatctgtaaagtcccttttaccatgtaaattaatattcatagtttctgaagatcaggatctggatttcttttggggcaattattcagctaaccacatattataatgaggaagcacttcttgggaggcatcataatgcttgttttttcttttcctaaatagagtatcacttttacccaaatggaataactcgctgggttattttactgagctcttgatgctcatttctttggtcttctctgtgatgaattaatgtttctatatggacatcatg

SEQ ID NO: 1408 - DNA, 300 bp, Homo sapiens
tagtagagacggggtttcaccgtgttagccaggatggtctcgatctcctgacctcgtgatccacccgcctcggcctcccaaagtgctgggattacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaatttttttttcagtatgcaa

SEQ ID NO: 1409 - DNA, 300 bp, Homo sapiens
gggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtgt

SEQ ID NO: 1410 - DNA, 300 bp, Homo sapiens
caggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaac

SEQ ID NO: 1411 - DNA, 300 bp, Homo sapiens
ctttgggggacacattcaaactgtagcaggaagtatttgctttctcataacatttttttaattaattaattttcagcgtttgttatatcagaatggacattatagcaatttccatggctgtgtcgctcctggcagattttaaagttcttccagcctgattcctctctctgtttgggtctctggcatggtgcctgctggagagtagatacttgataattatctattgggttctcaggggatctctcaaaggtggtattcaggcacccacaaggcaactcccatcacaagaaagaatggtgg

SEQ ID NO: 1412 - DNA, 300 bp, Homo sapiens
aattcggcacattgggtaaggctgtgttctttcctttccttcattaattcagtagagatttactgatcacctaatatgtaccacaaaaaaatgttctagatacttacaacacattagtaaacaaaatcgtaatccctgcctccatggggcttactttctagtgtaaggagacagacaacaaacaaaaagcctcatatacagggatattataatatggtatgttaaaaggtgataagtgcaacatagtaaaaaataatgaaataaggcaggataaaggggtattgggtgtgatagggtggc

SEQ ID NO: 1413 - DNA, 300 bp, Homo sapiens
aaggctgagacaggagaatggcgtgaatcggggaggcagagcttgcagtcagccgagatcacgccactgcactccagcctgggagacagagtgagactccgtctcagaaaaaaaaaacaactaaaatatgggtattatgcccaatccaaatttcaaaaacgtgattctaagtgaaagaaggcagatgccacagaccaggtattttctagtaccattttaggaaatgtccaaaaatggcagatcttcagaaacaaagtaactgcaaatgttacaaggaatctttttagggtgacgaaaatg

SEQ ID NO: 1414 - DNA, 300 bp, Homo sapiens
ttttagaaatagaactcctgtagatgtgtagaagagtgatgggaaagagaaaggactgatgtccttcttttcattgaaaaagatattgtttaggtcctacaatggcttaggtatggtttgagactctggggttacaaagcaaagaaaacctggcctctgccctgctcagagaacagcagggatacagcatgttagcaaataagtatatagtgtggaaaggtctgtagtcaatagcagtcattttgacaataggaaaaggaatgtgtgaaacttctgggtctgtgtgtgtgttggggttgg

SEQ ID NO: 1415 - DNA, 300 bp, Homo sapiens
agagcgagtctctctttgttgcttaggtttgtcttgaaatcctgggttcaagcaatcctccctcctcagcctcccaaaatgctgggattacaggtgtgagccaccacacctggcctctactttcttatatttccttaaatagatttcctttctttttggattaagaaaaaataaacagaaaattaaaatttgaacatattataaaaatgaaagataattgtaaaatcttggtttggagagtgtctctctgagcccagaaatcatccagaaaaatggacagatttgactgcatcacattta

SEQ ID NO: 1416 - DNA, 300 bp, Homo sapiens
gtcctggctactgaggaggctgatgcaggagaatcatttgaacccaggaggtcaaggctgcagtgagctatgattgcaccactgcaatccagcctggacaacacagtgagaccctgcctcacaaaaattatattctgattttctgagtccatgaacacattgtccaaatggatttttctagctcctccaagttacagatagttccacgcacacacagaactcaccactctcaaatattttccccactagtattactattaaatttttcaaacatgcaaaagatgaaagaattgctcagtg

SEQ ID NO: 1417 - DNA, 300 bp, Homo sapiens
gttggccaggatggtctcaatctcgacctcgtgatccgcccaccttggcctcccaaagtgttgggattacaggcgtgactcaccatgcccagccacttagttttttcttattcccacctttctatcccatataacactcttttttatcttccctgaaccatattgatgatataaatagggctgggggctgggccccgctggtcactcaacagagtatttcccttggccgacatggaagttttgacccaatagatgagctgctgagtatcaacaaggtgacatttttctgctgcccatttg

SEQ ID NO: 1418 - DNA, 300 bp, Homo sapiens
aaataagcttttctttaaattaattagaaattacttgtaggaaatgtatagaataacaatgatcattttttttaactaaatgatttacaatagtgagaaagttgaccttgagttacatgttgaaagaatagtatgtaagctggcaacagaaattgaaattgagacagatttcagcaccactgttggtaacaggctcttattccagaggaaacatgtcagttttttattagtgagtaaaggatttctgcgaagctttaagaatatctcatgttgagtattgacatgtattttgaatgatga

SEQ ID NO: 1419 - DNA, 300 bp, Homo sapiens
tttgtaggcaatggaaagccaccagtggttttagttgagcagcaatgaaattaagcctgtgctttgcaaagattaatctagcagcaacagattggaagcaacaccaccattcctggtatcagtccaggtaaaatatattacagctctttactggagcaataacagtaatattagaaggagaaataaaaaagaaaaatattgcacaggcagaatggggaggtcccagtgatggagctgatcttggttcattgaggcaggggtggcattaatcatgtaaaacacaggaggaggaactgggtt

SEQ ID NO: 1420 - DNA, 300 bp, Homo sapiens
ggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagta

SEQ ID NO: 1421 - DNA, 300 bp, Homo sapiens
ctaatatccagaatctacaatgaactcaaacaaatttacaagaaaaaaacaaacaaccccatcaaaaagtgggcgaaggacacgaacagacacttctcaaaagaagacatttatgcagccaaaaaacacatgaaaaaatgctcatcatcactggccatcagagaaatgcaaatcaaaaccacaatgagataccatctcacaccagttagaatggcaatcatagagcttttcatttatctgagtgttttcctctgcttgtcgggacttgtgctttcacgagctcctgctctcatatcaggg

SEQ ID NO: 1422 - DNA, 300 bp, Homo sapiens
cttgcaaagtatataatatctaagaggaaaggtttggaaataagctactgcattggtcttaagctagtccggcatgtgaagaaacaagaatttgcccagaagaggactgtggagaaacctctgaggcctccttccagagtaaggccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtg

SEQ ID NO: 1423 - DNA, 300 bp, Homo sapiens
ctgacatgactaccttagggatagagctaagggataataacttgcactaaatacatttaaatacttgattgcatgagtcagtttattgtagtttttgatttctgtaaaataagagaaacttttgtatttattattgagtaagtgaatgaagctatttttaaataacgttagaagaaagccaagctgctgctgttacctgcagaactaacaaaccctgttactttgtacagatatgtaaatattttgagaaaaagtacagtataaaaatagttattgaccacatgctaccaggctctgcag

SEQ ID NO: 1424 - DNA, 300 bp, Homo sapiens
tgtattcagaagaaagcaaggatagaatgagtataactctttaaaatttggaggcaaaattggctgtgagttgccatggagataggagcaatggatgtccaaggtctgaggaaatagaaactgttcgaaataattgcagagaaagcttgccaacggtgataagtaggtttgtctagcagcactgatgcgtcgtggaagttgatggtcatgaacatacagtgtgataacctatctgccctcttgaccttttctagtagtgctatgtcattttggtactaaggtaggtgaattttccaagtg

SEQ ID NO: 1425 - DNA, 300 bp, Homo sapiens
ctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgct

SEQ ID NO: 1426 - DNA, 300 bp, Homo sapiens
aaaaggagccagaacttgatgattttgaaaattctcagcctttctggttggcagagggtgatgaaattgagacacggcaaagatcaattcaagagccactccggggagaatggcggtctaaagataaagccaagactgtgcctttaaagcctgctgttaagacctgagaaggtagtgccttagcatcctcttcagtcacactcaaggcctctccgtcaaacaatagggcttctagcctttttagcaggagcccaaggtagaggtagaagagttcctcttggagagatctatgggtatagc

SEQ ID NO: 1427 - DNA, 300 bp, Homo sapiens
cttacctcctagaacattacctcctagaacactgtgtgccctgcagagccatcgacctttattataggccacgtgccctcggaaacttgggacagtactgatgcgttctgttgagtgcgtttggcatgtgggaattgtgatggtgcacagtgtcttggccttcactgggttttgtaggcacactaaggtttccatttcattcttcttcagttgccctggcccagcctgggtctctgggtagagcacctgcaggggcagtggacggcctgggctcagggtcggtcagcacctgagaccagc

SEQ ID NO: 1428 - DNA, 300 bp, Homo sapiens
agaagctccactggcacttttgtattcacaactaccgggtgcgataaggcagtgagggttattatgataccccttttcacaggtaaggaaacaaggctcagagaggttcaacaacagagtcataattcttcttgttggagaattcattttgttacatttcattcccaccatctgcagtaagggagacccattaaaatatagtatcctgatttttaaagagaaggtaacattaaggccaggaggtttgggatttgcccaagttcactgtgggcttctggactcccatgcccaacagcctcc

SEQ ID NO: 1429 - DNA, 300 bp, Homo sapiens
cttgaacctgggaggcagaggttgtggtgagccaagatcacgccactgcactccagcctgggtgacagagcaagactccatctcaagaaaaaaataaataaataataatttgtgtatgtgatgactgactctagtcattatggaaaataacttttggcagtttagttcctacttgttaacaattcctctttttaagagaggtactacatttgatttctcaatttctcagtttgttttcaatacaaacagcaaccactgaaatgcagaaaatggtaatcaagtgtgatgtttctataaaaa

SEQ ID NO: 1430 - DNA, 300 bp, Homo sapiens
cccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtc

SEQ ID NO: 1431 - DNA, 300 bp, Homo sapiens
ggttattgatcattgcacagggctgttggcaagtttggtgtgcaaggtttggatagtgcctggttttcactagggttttctgaaaaccagcagaaacagggggcctgaaggttgttagagtaatgagcttgcagccaacatattttagctctatcaaaaaatgcctgttagtgctcacgggcatgtactgcgagagagatcttgaatgcatcactttggtatcctaagaagtgtaatttttttccctcgtcatactgggctgtgtttagacctcgtataatacataatgaatagaaacag

SEQ ID NO: 1432 - DNA, 300 bp, Homo sapiens
agtttccatttagtttgattttaaaagctgccttttgaatatctaataccaattataaaataaatatgtgtaagtaaaataaaatggtaacttgttttttataagaggggaagttggttggttttataaattaaatgaacatttatgcggtcggttatttttacgtaaaaatagttgttatattctagggtaacagaaatttagaaacctatttttctgtagaagaaaggtgttgctatctgcttttgatttctcagatatttgcttctccttagaatgctatgatcagatttttattag

SEQ ID NO: 1433 - DNA, 300 bp, Homo sapiens; identical to SEQ ID NO: 412

SEQ ID NO: 1434 - DNA, 139 bp, Homo sapiens
gtggagctcacctatttggaatatggggcatttgttttttccactgcaatgatttcagtctggtttcatcatgttggaattcgatcacaccattttcaaacaatgttaacatagtccagcttttgttccgtttagggga

SEQ ID NO: 1435 - DNA, 239 bp, Homo sapiens
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgg

SEQ ID NO: 1436 - DNA, 300 bp, Homo sapiens
ccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagt

SEQ ID NO: 1437 - DNA, 300 bp, Homo sapiens
  misc_feature (1)...(300): n = A,T,C or G
gcaaaaacctacatacctgttattcctgtttgtgctcctcgcaatcctttaagataaggggggcaggaattaatatctccattttacaactgaaactgaaaattagaggacttcaatgaatgaaaaatctgagtagcttatcctaccaagtggcagattagttcatgattccttattaagtgataggacttgccaaacaccaggaatctggggaagaagtgtactcaaagaagtatgcttggaccaatctgaaaaaagaaaaanaattnagttcaaactgattgagtaacnattcacagt

SEQ ID NO: 1438 - DNA, 300 bp, Homo sapiens
gcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtggagatgtggtttctcca

SEQ ID NO: 1439 - DNA, 300 bp, Homo sapiens
ggggcagtcaataataatagggaggatagaaacgtcagcatggcattccagatgagaaaactgaagcaagttaaactttctacatggtaaccgtgattatgtagttgatatacaaagtattgactgtgggccttcaagaagaggttaaaatacattcattatattaacgagtgcatcttacaaagatttctttcaaaaagtacttgaagtttttttgctttaaggagtaaatctcaatcatctggaaatttaacttctgtggaatacctctttacatcttaaaggaaatgttaatgcatt

SEQ ID NO: 1440 - DNA, 300 bp, Homo sapiens
aagatgtttgattcttcagataacttttgaaatgtgctataaagggcctagtttaaaaggaacttcttttgaaaagcaattaacagttgataaagggttaaataaaaattatctagtaaggaatttcttattggaatgtaaacgtggttctaattttaaatagacagtgatataaagaataaaaagtaaacagtgaaattgagttctccagggaaaaggcagacctgtttagtaaaaaaaggatgcttttttcagtgatgtctttttttgagtgcatatgtgtgtgactcttgaagaaat

SEQ ID NO: 1441 - DNA, 300 bp, Homo sapiens
atccaatatttattgagtgtctattaggtgccaagcaccttaataggtcctatggatttgaaatgccgtccctgtcttagatctcacggtctactggaggacacagagaagtaagcaggcagttgcagtacaatgtaacactgagtgctgtctgtgtatgatgctgaggagggaggttagcctgagccggggaagcggagcttgcaatgatcggagatcgcgccactgcactctagcctgggcaacagaacaagcccctgtcttaaaaacaaaacaaaatcttcagagcaggcttaaaaa

SEQ ID NO: 1442 - DNA, 297 bp, Homo sapiens
  misc_feature (1)...(297): n = A,T,C or G
ttttgcnaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagt

SEQ ID NO: 1443 - DNA, 300 bp, Homo sapiens
actgaactaatatcaattttaaataatattgctattcagcttcaaaagacagagcctccagcatattattattattatagtaatctgattctttagaattcagagaactcacctcattagtgctcccttgctctatctggccctgtgggaaaatacccttgcatctttctatgggtatggtccactgtatcccatcatgactttaacatttttgaagtattggtcttttaaagtaagcaaacaaattcccttgttacatcaaattcaaatacagtaatgcattacaggacaaattaaagg

SEQ ID NO: 1444 - DNA, 300 bp, Homo sapiens
gcctgtcgtcccagctacttgggaggacaagtcatgagaatcgcctgaacccaggaggcagaggttacagtgagctgagatcgcaccactgcacttcagcctgggtgacagagcaagactccatctcaaaaaataaataaataaaataaaataaaatataaagtttgctccattgttgacccattgctgctgataaaagtgtatactggaatgcatgtaaaccatatatttaaaatgtataggctgggcacagtggctcacgcctgtcatcccagcattttgggagaccaaggcaggtgg

SEQ ID NO: 1445 - DNA, 161 bp, Homo sapiens
gtgtgttctgtgggagggtgtctgtggggatgtgactatcagggtgggcctgtgctggggatggggcaggcctgggtctggagaggattttgtgtgaaagtaaatggggtgtttgaggcgtatgggtggctgttggtgtggggaggcatctgtgtatggct

SEQ ID NO: 1446 - DNA, 300 bp, Homo sapiens
taaataagttgatattaatgatataagcatcacacaattttacattaagaaatactgtgcaggccatgcgtggtggctcaggcctgtaatcccagcactttgggaggccgaggtgggcagatcaccggaggtcaggagttcgagaccagccttgccatacatagtgaaaccctgtctctactaaaaatacaaaaattagccgggcatggtggcaggcacctgtaatcccagctactagggaggcttctgaacccaggaggcagaggatgcagcgagctgagatcgcgccactgcactcca

SEQ ID NO: 1447 - DNA, 251 bp, Homo sapiens
ggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgagaaaaaaaaaaaaaaaaaaaaaaaaaaaaaaaaaaaaaaaaaaaaaaaaaaaaaaaaaaaaaaaaaa

SEQ ID NO: 1448 - DNA, 300 bp, Homo sapiens
ctggaattagtggcttgctgataatctcattttataatttgttcagcaatccagcaagaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatac

SEQ ID NO: 1449 - DNA, 300 bp, Homo sapiens
atgactgagtgtataccctagttaaaatgatcaggggagacttaactgaaaggggtaattgagctagatttgaaggatgaggagtagcagactagtcaaagaaagggagagaagaacatacctaaacatctgatcaccagtgactgagaaagttatcaggatcaagtggaaagagaaaggactagcagagttacaggttagagaaacaggtaaaggctactatggacggcataatagttgcatcccatgttttgtctcttaagaacagttgcaaactattgaaggttttaaagctgtgtg

SEQ ID NO: 1450 - DNA, 300 bp, Homo sapiens
attgtcttgtgttatggtgcttcagcattggattcagcagccagcttcctagtacgaaggcaacgattacctccacagggtcccttccattgtcctcctgcatcattttcctccaacttgaataaatgttctacccacctttctcctttattttctctaccccctgtaccccgctccctctcacaattaactctacagcagaatgtgaattctctgattttagaataactattttatggtaacttcaaatatatcctagttgtatccacattcagcttgggtaggtaccttcatagtagc

SEQ ID NO: 1451 - DNA, 300 bp, Homo sapiens
caaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggc

SEQ ID NO: 1452 - DNA, 300 bp, Homo sapiens
aaaacacatgcacacatgtttattgcagcaaaccaccatggcacatgtatacctatgtaacaaacgtacacattctgtacatgtatcccagaacttcaagttaaagaaaaaaagaaaaatatattagtttagcaacattcaaccttatcctatataaattatgctaagaactttgttagataaattctattataaaaggtcctagctagtagtattaaatttgttgttgttgtaatttatgtacaacaaaattcacccattttaggtatacagtttgaatgctttttggtaattatataa

SEQ ID NO: 1453 - DNA, 300 bp, Homo sapiens
tgagtacttatgaaaaattgtgagaaattcattgtgtgggattttcaccattactacatgtatttggaaataaaaattgtatgactatgtatatgaaacttgttcatgttctaaaaaataccctccatttataatatgtttttaaaatttgccactgagaagtacaaatttccttcttatttcatcttagttatcaacccagagtcactggaggcaatgcagtgtagtggttaagcgtgcagattctgaagttagacaagatttgggttggaatcctgactctgccacttactagctggg

SEQ ID NO: 1454 - DNA, 300 bp, Homo sapiens
acctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattgga

SEQ ID NO: 1455 - DNA, 300 bp, Homo sapiens
  misc_feature (1)...(300): n = A,T,C or G
ccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcataaaaggannnnnnnnnncaaggnttctacaaggnngn

SEQ ID NO: 1456 - DNA, 300 bp, Homo sapiens
ctgggtcatgaaataacagattaaaaatgttctctggtaaaagaattaaacatttctgtaaatggaaggaaaataaaaagatttcagagagtctgatcaataatagcttgtgggtcctagtgagtggagcagtgtataaagaggtaaggtttttgagggaaaaaaatactatgtcaaatggggggtgaatgataaaaatcgctctcattttcctttttttcacctttcatcttcatttatggaatttctatacaataaatatgtttggcatttaataacagtgcctctcccccggaatac

SEQ ID NO: 1457 - DNA, 300 bp, Homo sapiens
acgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaa

SEQ ID NO: 1458 - DNA, 300 bp, Homo sapiens
gattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaa

SEQ ID NO: 1459 - DNA, 300 bp, Homo sapiens
gtattcatgagaggcaagtgataggttactagggatggattgtgtgggagaaataatgcagaggaaatgatgatcatctccattgaatgacagctgttatatagcaaagataaatgtaaaattagtcttattcttggaagtggaagacagcagttatcagagaggagaatttaatcaaaagaatcagaatagcatggtcacaggccagattcacattgaagtatttactctatattttactgctgttacattcaaaatgtatcagaagtctcatggttcaattaataaagtgttattcgc

SEQ ID NO: 1460 - DNA, 300 bp, Homo sapiens
tcattgtgtaataaaatggcagtttccaaagatggatgtctttagtttttaaatgacatgttgatttttttcatgatatctgcaaatatttttgtcttttttgacctcagaacaaatgtaaagcattgattggagcacacacaaaagttaggaaatatgctgcttggcaactgagtaaaagtaaatatatagtctcttaaacttccaaaaaagtatacaatagtacaggatgggttctattcacaagctttctgtctgtaaccgtaaaagatatcactatctaaaaataatatcagaatg

SEQ ID NO: 1461 - DNA, 300 bp, Homo sapiens
ctgggtctcaggcctttgaactcaaactggaactacatcactggcgctcctggtctccagcttgctgactgcagaccttgaaacttctcgggctccattaacctcttttatatatagagagagatacatacacacacacacacacaaacatacacacacacacacattggttgtatatctggagaatcctgattaatatacccgataaattcaaaacaaaacaaaacttgaaaaaaaaatttttcaggtgaatatttgttttttagcatctgagtttcagtccaaacagggaaggaaaga

SEQ ID NO: 1462 - DNA, 300 bp, Homo sapiens
tgagacagagcagccccagaacacacaccggggagtacaggagcctaggccacgtacccaacattgcaggcagagaaaaaagaaagtgtattccatgtaagcaaatgttatttggacctttctctctgtctgacctaatcatggctcacagaaagtaatcatactcctaataatacatcaacttatctgatttatccacacaatcacgtagattaatgtatgcttctatttcctggtcgctttagcataatattgatcataaattgataaataggaataaaacaatataattagattaat

SEQ ID NO: 1463 - DNA, 300 bp, Homo sapiens
caaaaacaagcaaaacaaaacattttaattgttatgcatagtatatatgtgcatttttgttaaattaagacttataatctcataatgatcatgatttcccccaaatgctgatgatgaccaaatttctatttctgtcccagaccttgaacccccagcctaaaaatcagattgcatattggatgtttcttcctggaagaatgtcaaactgaacaagtctgaaactgatctttgtgcatcacaacccagccaaacctgttacttctcctacattccctttcttggtgattggcttgtccaccc

SEQ ID NO: 1464 - DNA, 300 bp, Homo sapiens
agttgtattaggatctttatgtgtggccaactcattaaattttcagattaactcagaaatattgttcctttattttgcacatgaggaaactgaggctcatatgtttttttcttctttattttttatttttagagacagggtctcgtttcattgccctggctggtctcgaatttctggtctctgggctcaagcaatcctctcacctcagcctcccagttacttggaggatgaggtgggagaattgcttgaacctgggagggggaagttgcagtgagccgagattgtaccactgcactccag

SEQ ID NO: 1465 - DNA, 300 bp, Homo sapiens
gtttactttgttgtctttggccctttatgcaatcagtgtaaaaggactagccgtttctggccctacactaaagcttatttatatttaaatcagtgattccaaactttaaatgtataacatcatgttaattttgtaacatcaatggttttctttaaaatttcaagatatttatcttgttacttgtattggacagttctaagaaatcttagagggataactgtcttacctgttttttaaaaaagatcagcttgcaatcttctgcttcaaccatatctgtattagaatacagtattatttcta

SEQ ID NO: 1466 - DNA, 300 bp, Homo sapiens
gatcaatccaagctcctaaacatggtattcacagtacagtcctaaaaacaccatccccaacttgctgtaaacccaaaatggcgggggcctcccagatatcctatgtctgtgcctttgtaccagctgggccctctgcctgcaatgccatctccatctcttccatccccttccaggagacgctagcactcactctctcctcctctacataccatcattcctcctcctgaagagctactctccctaactcacgtgtcacaacaacccacctgccattatcctcctcttcatcttcacaccggt

SEQ ID NO: 1467 - DNA, 300 bp, Homo sapiens
gacagctgaggcccctggaaggcagatccaactcctcctccagcgacaccactggctccttcacagcttcactccaagaaacttctagaccccccagggggtgtctcaagtgaaagtctggccccacatctacccccaaggatggcactggctaggactgcttcaggtctcggttaacctaggtcaaagtgtccttgggcgcaagtctgagttaggctgcagaaacacctgctacctcccccaggttcacactgacagctgccgggcctgggtcaggcacagccagtgctcaccttcatg

SEQ ID NO: 1468 - DNA, 300 bp, Homo sapiens
cctagttaaatcacaacaagttagtaatccataaatgatgtgtcctgtttctctttagtagaaattatatttttggctaccagttaagaaacttgtactcctttgtcccttatgttactataaactcaagatgatgagttttgtggtatttgacttcataggcaaaatcaaaatttttactttgttgctattctgttttatgaaataaacttctgtctatgcatttgaactaagtttcagcaaattcaatctaaattgaataattccagctcccagttttatcctatgttgctcataaaa

SEQ ID NO: 1469 - DNA, 300 bp, Homo sapiens
  misc_feature (1)...(300): n = A,T,C or G
gtcaggctctgctggacactgcatgtccaaacgtcattttacccatgtgccagcgacaaggtagattcgcttgtaccaattttgcacataaggaaacagccttagagaggttaggttgcttgtgcaagcccagggtaggtggcacccagtctgccaatctgcaacgcactggtatcttccagccagtagaccttgctccctgggtgcccagttctggatctcaggaaaggcggattaaggctcctaatggcgggacctgggtggggatttgntgncctntggtggcanaagggacatcac

SEQ ID NO: 1470 - DNA, 300 bp, Homo sapiens
gaggattagccatgctggggtctcttggacaaaaggctggtactgattgaaaaattccctgagtatgtctagaagtgtcaggctcctctggaatcagttacagtgggattggctgcttaggtataatctttataagattaaaaattatagattatttggcagcttgtttgaaagtgttggtcccaagaaaaagttctgctgtgtgttatggcagaattattaaaaaaaatacattcttaagttgaggtttctaagtaggcttttgtaaaaacaggcaattacttgctggaggcagttaat

SEQ ID NO: 1471 - DNA, 300 bp, Homo sapiens
attcgatttgggtcgcaattacacagacattgacgggcaactggagcctcccagggactcctgcacgagagggagttactgaagtccctgcagagtgactgttttcccctagtcagtgcctccttttcttcaggtctcaaggacgggatgagcttgccttggaaagctttgagggagtctcgtattttaccttcatagcaaaagttgtttccccacttctctccaccatttcttatttcttcctgacagttgttctggcacatctcttgatcgattgtagtattttctttctttcttttt

SEQ ID NO: 1472 - DNA, 300 bp, Homo sapiens
agttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactg

SEQ ID NO: 1473 - DNA, 148 bp, Homo sapiens
catccctggagcagcttccaacactacttcagggtggcagtgtttggggcactgggcgagcctgccggcctctagatggcctcatctcttccttccacaaactgtctagaaccaataaaaggaaacctgccaaaaaaaaaaaaaaaaa

SEQ ID NO: 1474 - DNA, 300 bp, Homo sapiens
tgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaag

SEQ ID NO: 1475 - DNA, 300 bp, Homo sapiens
ctgaggttgttttcctgttgttgttgttgtttttccttgagaggagttgcaagacgtgggaggctgtgggcagggttccacgggagaaggaggatgctgcatgtctgggacttgtgaggaggaagcactgaagaaatctatgtggcacacggaggtgttttcaggtgttgaaccatagggaggtctacgtgatttcctcattaggaggattagagagggcagagtcaggaaaccaatagaggaggcctggactaaatggtggtagtggatatgtctgaggctggggatcaggctctggtg

SEQ ID NO: 1476 - DNA, 300 bp, Homo sapiens
catcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccgg

SEQ ID NO: 1477 - DNA, 300 bp, Homo sapiens
ggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctct

SEQ ID NO: 1478 - DNA, 300 bp, Homo sapiens
ctggaaggggcagagcccaggacagggctccatgtccacaggacggcgaggagcgaagaccatggggactgagtacacagatgaagacacagaagcatagagaggataagtaatcactagcaagtggaagaaccgggattcagatccagaacaggctgactccagagtcactggctgtcatgtagtttcctcaactactgcctcagctctacaatcccagagtaaagctcttctccaaatgaagagccaggaagaggtagaggtggcaggaattaaactttgtaaagccatgtccctggg

SEQ ID NO: 1479 - DNA, 300 bp, Homo sapiens
cctaggctttaccctcaatactgcttctgcctgaccaaactgtctctctcctgtggctctgtgtgatgtgacttgtcctcttctccaaggcagtattactcataaattcttctttagcggtactgatctatctgtgtcatcgctcagtcaaccacatatattaagacctaggcacagaacaattctatttctataaaattctagaaaatgcaaactaaaccataatgacaaaaagaatattagtggtttcctagggatgggatgtgggcaaagagagacgaaagaaggagggattaccaa

SEQ ID NO: 1480 - DNA, 300 bp, Homo sapiens
gaaggaagaaaatttgggactttgttttaaaagtggaatactatcttcttaaacaacttgtgtttaaaacaagccccaatccacacttgatcttcttaagctaggaaaagtgagctcacactgagtgctggcaggatgctccatgtgcatcattattttgtttaattctcacaataactctctaaatcccttttgaggataaggagactggggctgggagaagttatttcaaggagtaaataaaaaattcagacccacttgggttttatgccaaaggctctgtttttacaaatacacaat

SEQ ID NO: 1481 - DNA, 300 bp, Homo sapiens
aattcggcagctccctcaaagaaaggagaactaggaaaatgttttcgccatctcccaaagatgataggaaagttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagaccc

SEQ ID NO: 1482 - DNA, 300 bp, Homo sapiens
ctgtagtcctattttgccatatgacatgattgaaatcaacacctcttagaaatagttttgctgcctcataattgattaccatcatgataacctgtagtcagtgtgaaatagagataaaaattaatgtacttagttaaatgcatatgaaggtctaatcttgttccagagttactcttactggattatttttagatttttattaacattactggtctctaactttactcagtctggataagaaaaagaataccatgcaattgttaactatttgatgtttactagattaactattaatatatt

SEQ ID NO: 1483 - DNA, 300 bp, Homo sapiens
aatgtgtatgcggggctggtgggaacagcccgggtggcgggggtggatccctggtgtgagcctggcttcctgtctgctccaaggggcgtggaacaggacggactcaggtccaaatccctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgcca

SEQ ID NO: 1484 - DNA, 297 bp, Homo sapiens
  misc_feature (1)...(297): n = A,T,C or G
gggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcggtggcagcgatgacaacatcgagtccatggagcgcttcgacgtgctgggcgtggaggcctacagcccgcagtgcaancagtggacccgcgtggcgccgntgctgcacgcctncagctagtngggcgttnctanatgnaacngccctattta

SEQ ID NO: 1485 - DNA, 300 bp, Homo sapiens
taggatctttatgtgtggccaactcattaaattttcagattaactcagaaatattgttcctttattttgcacatgaggaaactgaggctcatatgtttttttcttctttattttttatttttagagacagggtctcgtttcattgccctggctggtctcgaatttctggtctctgggctcaagcaatcctctcacctcagcctcccagttacttggaggatgaggtgggagaattgcttgaacctgggagggggaagttgcagtgagccgagattgtaccactgcactccagcctgggac

SEQ ID NO: 1486 - DNA, 300 bp, Homo sapiens
agaaagagttgtgttggaaatttgactttggctaacccagaattgtatagtttctatatttttatttgtttttaatgttaccagatggtggcagtagaggtggcaaccttatagctccatctggcagccgggagcttattttagtcaacacaaactgtaaataccataccatagttatgttttacctggaagtcggacttagttccataaactgatcattttctgtggcttgtagtgttcaaattgtataatattcctcataaaataatatagaaatacagaaataaaagttataataaa

SEQ ID NO: 1487 - DNA, 300 bp, Homo sapiens
ttttttactatgtaccataatgtcccattcatgagaacctagaagtagtttttctcattagcgaatgctagaattttattttttttcacatagtgaaaaggtgaaattggtctgtcttcctctttactttagctgctagtaaggttgaaacaacgatggtgcccaaatttaacagttaggtgacatcttcttctacgtgtgctaagattacccagacttcactttacccttatttcccactgactttgatccctttacttggttttattctgtagtatggattttttgcatcttttcagt

SEQ ID NO: 1488 - DNA, 300 bp, Homo sapiens
gcaacgtgtgcggtcgggcgattccggagcccctgcgtggaggaactgctgggcgggaggagacgccggcggctcgggcgatggctgaccgcacacgttgccaccctgaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcacaggatgagatcagcaacctggtgaagttg

SEQ ID NO: 1489 - DNA, 300 bp, Homo sapiens
ccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcac

SEQ ID NO: 1490 - DNA, 104 bp, Homo sapiens
ggaagagggaagaagagaagctggttatttctagaggatgtcgtaatctacatcacaggcagaactgatggctcagtggctgagtggccagtatattgtctttt

SEQ ID NO: 1491 - DNA, 300 bp, Homo sapiens
ctggatccagtccaggccagagcctcctctgcagagaaggtactaggtgcccatgcacagggtgactgccagcctcgtggagtgggggcagtggtgtccctgcgggcgggcttggtcttctgaggccatgtcagtgccaccccagggccgccctccatggcagtgtggggccaacaagcctgtcttcccatttttctgagagaggctggaaatcctgttctttttatatataaagtgtttccttttcaaaatattggcaactaagtaaatccaaacaaagtatgggccaaatcatggcac

SEQ ID NO: 1492 - DNA, 300 bp, Homo sapiens
gaccaaggagatgtgagtgaaaatgatgcaggctgcttccaggtgtgaccagtaagatacttcccacataatcttcctactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaaatactagcaaatttttaagaaggaagtaattccagtatttcacaaacccttccaaagaatagtaaa

SEQ ID NO: 1493 - DNA, 298 bp, Homo sapiens
  misc_feature (1)...(298): n = A,T,C or G
gaacctttgaatagtggttgtacatacagtttttcagagctggtgtttaataacaatatttttcattctaatattacattattctttttatcatttaggtctttatccgtcagtgtttttagagaactactgcacttgaccacaaactgataaatacttggtactgccccatctcactgttctgtttactttgtcttaaatatctcttttttttttcccaggcagctagtacacnactgaatcctttaagctttcanngngaatttgnnaanctcaggattgaccttttacaagcctt

SEQ ID NO: 1494 - DNA, 300 bp, Homo sapiens
gaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacagccaggctggtcttgaattcctgacctcaggtgatccacctgcttcggcctcccaaagtgctaggattacaggtgtgagccaccacgcctggctaattttgtatttttagtagagatggggtttctccaaaggctggtcttgaactcccgacct

SEQ ID NO: 1495 - DNA, 196 bp, Homo sapiens
  misc_feature (1)...(196): n = A,T,C or G
ggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttnnaannagggnctncntnngnccccnaggggg

SEQ ID NO: 1496 - DNA, 300 bp, Homo sapiens
ttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaa

SEQ ID NO: 1497 - DNA, 300 bp, Homo sapiens
agcaaccctagcaatagactgactctactacaaaacaatttggttatttctcttactatttctctattatatctgttgagggaatgttatcatgagcacaggtattagtcctatgcttttaatcggtttagtggtttctttgtgtctcattttattcatttgtaatttttttaaagactataaaacttccacagtttctttagatcattaagttatatgactctttttcatgggggtcagttaacaatacataagaaaacatttgttctaggataatatatgacctaacagtcttttgtt

SEQ ID NO: 1498 - DNA, 119 bp, Homo sapiens
gctagttcgagttttttttccttttactctggtattgacacattttctgtgatcattgttaattagtgacatagtaacatctgtagcagctggttagtaaacctcatgtgggggaggtg

SEQ ID NO: 1499 - DNA, 300 bp, Homo sapiens
gttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaag

SEQ ID NO: 1500 - DNA, 300 bp, Homo sapiens
atgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagagg

SEQ ID NO: 1501 - DNA, 300 bp, Homo sapiens
caactcctgagacatacactcattgatgattcatcacgaaatgtttaattatattgagcatgacgctaggaccaggaggacatttggagaccgtattacccagaccttactttcatgtgaaacctttggaaaaggcacaactaaaaaactggacagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtga

SEQ ID NO: 1502 - DNA, 300 bp, Homo sapiens
gttttttaaagaacttgataaatttaccttaaaatttaaataaagtatactgaataactaagtcaacttagaaaaaaaaaagtgttatctaagacaagttacaaagccatcaccaaagcccatgatccggcagacgactacaagcatagggtcagatccatctataaatgagagcctgacatacttcatctatagcaaacatgggagacaaatcagtggtaaaatgatacagtgtttgggaagtgttatttgaaagatgggcttatttaatgtatacagatgaactcaattcctctgtaa

SEQ ID NO: 1503 - DNA, 261 bp, Homo sapiens
aaaaagaaaaaaaaaattagccaggcatgcgaaacgctgaggtgggaggatcagatgagcttgggaggttgaggctgcagtgagccttggtcatgccactactgcgttctagtctgggcaacagagtgagaccttctctcaaaaaaaaaacccaaaattgtaaaattacttctatagctatattttatgataaagaagtgattgtttctcaaaatcgcattttaaggacgttttatggtacttgttggaattgggacttag

SEQ ID NO: 1504 - DNA, 300 bp, Homo sapiens
aaggtgggtggatcacaacgtcaggagatcgagaccatcctggctaacatggtgaaaccctgtctctactaaaaatataaataaattagccggacaggcgcctgtcctcccagctactcaggaggctgaggcaggagaatggtgtgaacctgggaggcggagcttgcagtggcaccatcatatagctcactgtagcctcaaactcctgggctctagtggtcttcccacttcagcttctggagtagctggggctactgcacctggaattgtcttaatctgttttaatactattaaaatttt

SEQ ID NO: 1505 - DNA, 300 bp, Homo sapiens
aattttccttatatgttctttgacccttgaattacttagaaatgtattttttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtgggtgaatcacctgaggtcaggagttcaagaccagcctggtcaacatgacaaaa

SEQ ID NO: 1506 - DNA, 300 bp, Homo sapiens
aaaaaaaattgtggtgattcacacctgtaatcacagcactttgggaagccgaagcgggagggtcctttgaggccaagagttcaaggccagcctgggcagtataatgagaccctgtctctacaaaaaatttttaaaagtaaagaaattttaagataactaaatactacatagtcatatattttaaatatttattacataaaggtaaaccaaatagaagaggaaataatgttatgccctacttcatatgaccaaaaactggaagatagtgtctgaaaatgaaaatgattgtattgggaaggt

SEQ ID NO: 1507 - DNA, 300 bp, Homo sapiens
atgacttcctagctttacccggggttttttctgcaggtggagaagggtggagtcctcccagatggttctttctttgctcccctaacagcctttaagatgtggctacttgtttttcccaccgtttaacaccctccaacttcatttggagcacgggttcctcaagggatcctgagagctgggtgctgggtgctggtttggagaggcaggatgatgcttctcccggctggggagagcagagcaggaaggctggttggcgccatgaggaaagagccacgaggttttagctcccgaaccgactcg

SEQ ID NO: 1508 - DNA, 252 bp, Homo sapiens
cctggctaacaggtgaaacccggtctctactaaaaatacgaaaaattagctgggcatggaggccggcacctgtagtcccagctactcaggaggctgaggctggagaatcgcttgaacttgggaggcagaggctgcagtgagccgagttcacgccactgcactgcagcctgggcaacagagtgagactctgtctcaaaaaaaaaaagtgtagaaaaacttgactttaacttcaaagtttaatttgaaagttta

SEQ ID NO: 1509 - DNA, 300 bp, Homo sapiens
caggactcaagatgactttctaaggtgatttggggatgcagtgtatgcatttttttactctttttgaaaaaaatcttttcttcgcctttggagtgtaacatttggatagttttattcagcccataataggaccaaagggaaggggataaaaaaaaattctttaaagtacctcagataaaaaggttttgtgaagaaaaggactcaaaatcctaggttataccaagactttatgttcattttgaattttctttattcatttttttcctctctgtgtatagaataatcaggagatattggtgg

SEQ ID NO: 1510 - DNA, 300 bp, Homo sapiens
gggacattaccagtcatgcaaaccaatgtgcaaaatgcaggcgttgctgggagcccagaaggcctactggccagggctgtcgatgctgaatgtgcagcctgatgccagggggtgggccttgagtgctgcccagccaggaactcctcagcgcccagaataccaatgaccctcctttcccccagctccagggcctctgcttccctctcctttcccaggctctctttgcttttccctcctccctcctgggactgtaggcaaagcccctggcacggacagtgggcaggacagccagatgcctag

SEQ ID NO: 1511 - DNA, 300 bp, Homo sapiens
attatttaaagcttattcaatttaaaagactacttgtaattccggacttattctttaaatagttggtattaaggtttcttttgtaaaataagaggtggtagtatttttcaatgcccttaattaacaaaattaaaagtttgaaaaccatatgttgattctccctcattttaaaaaattttgtaattccactggtccacaaaaatcccaattgaggagagctctgggaagagcacattctgtcaatgggtctcaacattttggtctcaggaccactttacattcttatttaggaaatgacct

SEQ ID NO: 1512 - DNA, 300 bp, Homo sapiens
  misc_feature (1)...(300): n = A,T,C or G
cttggatgtatggtttaatatgtataccttataattctgcctctagccaaatgctatggttgcaaaatgtggcatctgttagtttttattgtctgtgtcttctttgtttactataccttgggtaattttgtgttaccaaaaaaaaaaaaagggacgggtanggtnaaacccccaaaaaagncaatncnngnttttancctnaaanncnaatntcaanggtnatnnccaacnatngggnttttttnaacnttnaaannctttangcnccntatnntggccnttnnnaantttgggggttgg

SEQ ID NO: 1513 - DNA, 300 bp, Homo sapiens
cccactgaaaactgctgtctagaccaacttttttttctattattttttttcttcttatagagatgaggtctcactatgttgcttgcccaggctggtcttgaactcctggcttcaagtgattctctcaccttggcctcccaaagtgctgggattacaagcctgagccacggcacccagtctcagaacaactgctattggttcatttaacaaactccattacaattttacttttccgtctccttttctagactgagtctctgaatcatttctcccatatattctccatacctagaaaacacc

SEQ ID NO: 1514 - DNA, 300 bp, Homo sapiens
cgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaatggaaacaagcc

SEQ ID NO: 1515 - DNA, 300 bp, Homo sapiens
ggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaa

SEQ ID NO: 1516 - DNA, 300 bp, Homo sapiens
cccagccataatggagcctgaaatcaggaattcatgtttcaaggttacatgtacaaatgtatgccctctcagaacaatggccattttgagaaagccagtgagagacagccagaccaggtcctctggcctagcacccaccagtgcctgccagctcagcccaagtctcctcacctaggatagcttgatggaataacaatgtattttaattttctgtagacctaaaactgctcttaaaaagtctattttaaaaatccatcattaaaacacagactttctccataataagaagttggaggggct

SEQ ID NO: 1517 - DNA, 247 bp, Homo sapiens
  misc_feature (1)...(247): n = A,T,C or G
tgctattgtaataataacaataaagagaaattagaagtgggagtcagggtagaaaaaaatgcaaaggccttggtccctaggagaccaacactccagctgagctggccttagccccagccccttctaatttctctttattgttattattattattttctctgctattgtaatatttttttgttaattaaatgttttggtcaaaaaaaaaaaaaaaaaaaaaaaaaaaaaaanccngncccntaaaaaa

SEQ ID NO: 1518 - DNA, 300 bp, Homo sapiens
gtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaag

SEQ ID NO: 1519 - DNA, 300 bp, Homo sapiens
tcatttctgatgctccatgatagagttgcaaagcatgctttaaaaaatgcaccttattctgcattatttgcaagtttacttgtggtgtgaatgttttttctactatttctactattagatgtgaagaaaagtatacttggcttaaaatgtgtcacaccatgacaattagtcttctaatatttgcctcatttatataaaatataatacatgtttgtcagcatgtaaaggtcctgggggccttgtacctagagttaaagcaggcacaaagcagccatgacattgtgacaagatataccatgc

SEQ ID NO: 1520 - DNA, 300 bp, Homo sapiens
  misc_feature (1)...(300): n = A,T,C or G
gggacgtccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggctctgcccccatgacccaatcagctccaaaggccccacctcctaatactgtcaccttgggggtgagaattccaatgtgaatttgcagggggaggngnggnaaangnnaatttcggggccataccacccttcaccacaccc

SEQ ID NO: 1521 - DNA, 300 bp, Homo sapiens
tgaaggacctgcctgcggctgctttacagtttgtttgtttttttttaaaataagtagaagatatacactaaagtaatgataaatgtatagtatagtaaatacacaaaccattaacagttgtttattttcaagtatatgtactgtacattaattgtgtgtgctgtacttttatacaactggcagcatggtaggtttgttcacaccatcttctccacaaacctgagaatcgtgttgttgcactgcaagtcattaagttaggaattgttcagcttcattataatttgtgggaacataagatgt

SEQ ID NO: 1522 - DNA, 300 bp, Homo sapiens
ccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcc

SEQ ID NO: 1523 - DNA, 300 bp, Homo sapiens
gaagaagctgcagaagaaatgaagaaagtgatgatgatttagattttgatattgatttataagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggc

SEQ ID NO: 1524 - DNA, 274 bp, Homo sapiens
  misc_feature (1)...(274): n = A,T,C or G
ccttgtggtagttaccacaacacatgcctcattaagaaacagcaaccatcagagggaatgcctgcctccctgttaccagctctgcagatgtgcacatatcttcctgtcgtaagccaatgggacttaaaccttacctcttgtgttttggagactatctttttttttttttttttngaaaaagggnccccnngggtngctaaggcngnaggncagggggggnancngggntnanngaaccnttnnccnanggggtnaangaanctntcnngcntaa

SEQ ID NO: 1525 - DNA, 300 bp, Homo sapiens
gaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagat

SEQ ID NO: 1526 - DNA, 294 bp, Homo sapiens
gctacttcataaaaataatttttttgaatcatatttgggaatctagattttagatgataatttttgcctatggctactttagcttgcattgtgtaaatggctgctagggcctgcgaaatagattttatttttggagggggatttgtttttcaatacaggatgatgaaagagatgaaaacttttctaatatagtacaataattggctgtggtcattttaaagggatcagttgcatagcatatagtagatgctcaataaatacttagtgtatcaatatggcttctgttaaacattg

SEQ ID NO: 1527 - DNA, 300 bp, Homo sapiens
ttttaaagtaaggatttgtctctggagtttaaatagaactacagtcaacttacatgaagaattagaaaaagtaagcccttcatattttgtaaaacacatttgcaggcatcatctcatttgatcccaatggaagccctgtgaagcaggcaagatttggacaagtttcttcattttatagatgaggagattaagacttagggtggcatctgtaggtgacatccccactcctagcacaatcagtcttttcctggcagctgggcagacactgaaccaactcagagagtgaggccgctgctcaag

SEQ ID NO: 1528 - DNA, 300 bp, Homo sapiens
aagtgatttcctctgcttttgtccaggcgcgccaaagaacgtggcgcttagtcacttcagattcccttctgtctgtgatcccctctgagaaataaagccataaatatgctgagttctgttgacattcacaccggaaatagcacagagctccaagtattgtggtctcctttccgattttattgctaaacagcaagaaaaacagcagaggggctttcctggcgagtcagagaaatgcaacgtggttttttgtgtgtttttttttctccgcaagacagaggaaactatctcttcacaccattg

SEQ ID NO: 1529 - DNA, 300 bp, Homo sapiens
gctgggagtataggctgagttaggaagattgcttgagcccggaaggcagaagttgcagtgagccaagatcgcgccactgcactcccaactggacgacaaagcgagatactgggagtataggcattcgccaccctgggcaacatagcaagaccctgtgtctacaaaaaatttaaaaaaaattagcctgtagccctagctatgcaggaggtggaggtgggagaattgcttgaacccaggagtttgaggttacagcgagctgtgatagcaccactgcactccagcctgggccacagagcaaga

SEQ ID NO: 1530 - DNA, 300 bp, Homo sapiens
taaaaaaccaccttttgttcgaaactccctggagcgacgcagcgtccggatgaagcggccgtccccacccccacatccttcctcggtcaagtcgctgcgctccgagcgtctgatccgtacctcgctggacctggagttagacctgcaggcgacaagaacctggcacagccaattgacccaggagatctcggtgctgaatgagctcaaggagcagctggaacaagccaagagccacggggagaaggagctgccacagtggttgcgtgaggactagcgtttcgcctgctgctgaggatgctg

SEQ ID NO: 1531 - DNA, 300 bp, Homo sapiens
ccaacatggtgaaaccccatctctactaaatataccagaaattagttgggcgtggtggcaggcacctgtaatcctagctactcgggaggctgagacaggagaatcgcttgaacccgggagggggaggttgcacttagccgggatcgtgccgttgcactccagcctgggtgacaagagtgaaactccatctcaaaaaaagatgagatgaactcctaggttcaaatgatcatcctgcttcagcctcctgagtaactgagatacaggcacgggccaccgtgcccagcttgtatactgcacttt

SEQ ID NO: 1532 - DNA, 300 bp, Homo sapiens
atccaactgtggcttctcccaggaccattacacttgtatctaaatacctacttgacatcttcttttggatactgaataaagatcttgaacaaacaaataaaaacagtaggttgttgatgcatgttactttgcccaatagatatattctatcagaatgtgatttgtatatataatatgtttacatattaaattttgattcaattaaaattctccacaggggagattctgtggtaagttctttcgtaaatgaagtaattattctagtgatttaagttcatgttacttgtactttatgcttta

SEQ ID NO: 1533 - DNA, 298 bp, Homo sapiens
  misc_feature (1)...(298): n = A,T,C or G
gtcagatggtagaaaatgaaataattaaatagataccatttgagttctgggagccaggtgaagaagtgtttgtttgtttttgagacggagtctcactctgttacccaggttggagtgcagtggcctgatcttggcgcactgcaacctccgccttctgggctcaagtgattctcctgctccagccttctgagtagctggggctacagacgtgtaccaccacacctggctactttttgtatttttagcagagaggggatttctccatgttggtcangctggntttgaactcctgacctca

SEQ ID NO: 1534 - DNA, 300 bp, Homo sapiens
gcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacaggtagtgggtgtggccgtgtgtgcctgggcctgggcatgcagacgtcaggtgggggccgggagagagggatccaggggacccggagcctctcctgct

SEQ ID NO: 1535 - DNA, 300 bp, Homo sapiens
gcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacata

SEQ ID NO: 1536 - DNA, 293 bp, Homo sapiens
  misc_feature (1)...(293): n = A,T,C or G
cagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaaaacagaaggaacatttgctttattggttacttactagtttagcctctaggttatggcacagcatgctaaaaaatcatgtgtttaaaagtaaatgttggtaaaatgctggcatctggtcctattgngttgatgcattttcacttctg

SEQ ID NO: 1537 - DNA, 300 bp, Homo sapiens
gaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaaaaaaaaaaaaaaaaaa

SEQ ID NO: 1538 - DNA, 300 bp, Homo sapiens
  misc_feature (1)...(300): n = A,T,C or G
gatatgctttagaattaaggtgagtggtattatctctagtttgagacaaagagaagcgaagtaacaaaaggccacataagtgataaatagtggacctggagtttaaacctgggatccccacctaaatcagaaatacaaaatcaaccacttttttgatgatccagggtctatgtatatttattacatgtatgtatatatgtatatatatacggcatgtgtatatatgtacatncatacnnatagatgtgcttgtactagcgtttttcccaccaggatagttagcctttcttcnccccttgc

SEQ ID NO: 1539 - DNA, 300 bp, Homo sapiens
cccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagag

SEQ ID NO: 1540 - DNA, 300 bp, Homo sapiens
gttacctgtgtatgactgaagtacatattcgttatctgcgtgagacagtacagattggtgtatagtattttacagccacttcattatatgctatttccgtgtactggcaaaaaagagaataaaacttcctaggatataagtacctactgctgttttggtgcatgtccagttaggcttttctctttttatttgtttgtgtacctgtaactccatataagcatatataatcatgttacatatgtttaaaaggcgtcattttgcaatgcagttttatcactagttttttctctgtcaagggat

SEQ ID NO: 1541 - DNA, 300 bp, Homo sapiens
gagagacagtgagagagacacaccatggggcctgatatggaggcacttacgtccaccaatgctgtaacatttgcattcgttaacaccctttcattaatttattaaatcattctccagtgtaacttctgtagaattcccagtttttgcttttatgaaattctgtagttgatgaacctcagattttacaagtaattgaacttaactacaggagaaggaggagaagaaggtggagggaaaggacaagaaaaaaaagcaagatataactttttttggttcccctcttttaatattttttctaaa

SEQ ID NO: 1542 - DNA, 300 bp, Homo sapiens
ctcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcgtcagtttttctacctctaaaggg

SEQ ID NO: 1543 - DNA, 300 bp, Homo sapiens
gttaggttggacacagaaggggcaatcaaatttctgtattcagatacctcttaaaggtacactgtgccaccttgctgcctttgattgcaaatacaaagttaattttcaaaaaggaaaaacaaaacagctctttttcctaaaacacatgttgtacttcagacctaaaattctaagtcttatttgtttctcacccatgagttagatttaggtaatagtattagtagagtccttagagaatcttaagaggtcatttactccacctctttcattttaaattggggtatccaaagcctgaagagg

SEQ ID NO: 1544 - DNA, 300 bp, Homo sapiens
tgcactccagcctacatgacagagtgagaccctgtctcaaaataataataataatgaactgagactcagaaaagatgtttgttcagggttacaaagctcagacaggacagggcagcattggaaaccaaaattggtctgactcctaggctcatgctgtaaatcacggtgcaaggcttctactatctatgtttttcctaaaagaatgtataaatgaaaagatggttaacatattaagcaaaatatgttaaacgtcaaatgaactgtataaacgataaatgctggagagttgaggtggcaaag

SEQ ID NO: 1545 - DNA, 245 bp, Homo sapiens
atcgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaa

SEQ ID NO: 1546 - DNA, 189 bp, Homo sapiens
ccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggcttttttttttt

SEQ ID NO: 1547 - DNA, 300 bp, Homo sapiens
gaccctcatgccaccagcttctgctccagcctttcttactcattaggctctagtctcacttcttattttttaaattgtgagtaattttcatgcttggtagttgatttcttttccatctctgtatgcatacttcctgcacctagtaggcacttgatttttttttctttgaatacacagcagatgccatgtaaactcattagtacttgcctcagaacactgaattcttacctgtgttaaatgcatgaatacattaaaaactttttagttttacttagaagtatataaagtgtaaactaatca

SEQ ID NO: 1548 - DNA, 300 bp, Homo sapiens
gtccaggccaataatcagttggttaagtgaaaaaagtgtttaaagtgaagaattataaagaaagtcattatggatctcaaacttttactttaattgaaaccataaaaacatatattcactcaccaatgttttatgcagggttaatgccttctctttaaaattggacttctgattggatttctacctcatttttcttatgtaaacacttatagttcacttttgatatttatgggttttgatttttgaaacaaagggaaaatgttaaaacatatactgttcagtaatgccacctaatccatg

SEQ ID NO: 1549 - DNA, 300 bp, Homo sapiens
gttgaaggtatgtgtcagttttaaccaggtgttgagttatttgatcactcctccaaagattatttaatagtttcaataatatctaatgatgtgtgggaaaccgtagaatttttcatacaaactgggacaaatgaacatgcatactattaaaatacttcctacaataggcataaaatgggctttcttaggtgaaccaggaggtatagttagcctaatcatatgctatgattattagtaatggttttctgtgttttatcattcatatttgtaaatcttttttgaatgactacttggaaatga

SEQ ID NO: 1550 - DNA, 300 bp, Homo sapiens
atttatttgccctatttcctccatgtacggagacattacagcaacagcccagtcagatttttttcatgctatcttttagtcagatttaatttaatgtgtatttctagtttattgcttctgccatgttttattctttatgaagatccccgagtattgagtgtgccagttaccagattctctcccagctctaaattacctcttcattacttgatctgcaatattggagcctaaccctttaggccaggggtgtccaatgtcttggcttccctgggccacattgaaagaattgtcttgggccaa

SEQ ID NO: 1551 - DNA, 300 bp, Homo sapiens
gcaggtcccctcccacatctaatccaccactaaggcctgcttcttaatagctcttgttcggctttggttgagacagggttttgctctgccgcctaggctggagtgcagtggcgtgatcactgcagcctccaactcctgggatcaagcagtcctcctgccttggccttccaaagtgctgggattacaggcgtgagccactgtgcctagcctgaatagctcttaaatctatccacttttcttcctctgcacacctgacaccctagtcctgctgccctcttctccacctggacaacctcgccc

SEQ ID NO: 1552 - DNA, 300 bp, Homo sapiens
gcgtcgctaaggtataaaacttgaaccatgattttacatttccagttctcaaggacaggctttgaatttaatttgttgttaagagtaattagcaattctagggaaaaaaaagctatttttattttctctacctcctaacacaaaaggtaacattcatcttctaggaagggaaactcttgataactctgtgtctttctaggtcagccacagactacactaagtcaccaactccaaaggggaaatttggctttttggtgagtacttgtgctagagaacagtagaatgcataatctggtcagc

SEQ ID NO: 1553 - DNA, 300 bp, Homo sapiens
cttagaggccttaggcaggtctactgggtctcccaagctgagacctgttattcccactttgcagacagaataggtcctaagaggtcatccaagaccacacagactgcacagaacagctgaggtgggaaccggggacttccttctcatattttttgaatgaattaatgaatgagggattgtgagaatggggctggcctgtcttatgcagcctctccgagagtggcccaagaactctgaaatggtcctggaagtagagagagaaaatggaaattgacagtttaggactcaacagccacaaag

SEQ ID NO: 1554 - DNA, 300 bp, Homo sapiens
gatacatccaaatattattcatgttatagtaaatcagatgaagccttgagcttctcagcagccacgtaaggcttaaatatgagggaacaggggctcttagaagtgaagtgacttctgaaagatgcacagagaattaggaaagagtctgaattcaaccctggaaccctgactttcaggtgagtgcctggcccactaaagaatgacaaagccatggggagtggcatggaaagcatgagctttggagttagacaggcctgggtgtgaatcctggtcaccccagttctgttaaagacctcagaa

SEQ ID NO: 1555 - DNA, 300 bp, Homo sapiens
gctttatctctaaattagaatcacaaatgcgtaatcttttcagggtaaaaatgtgtcatctttaaagtctgtttcagatatattttaaattactattttaaatgaattcatatggaaaagtcgtgggagcttaaggccttgtttaaaagggaaaaaacaactgagtctttttagattaatcaaaaactatcctcttcctttggagaggagagagtgtttgtcacacgcggaatgaagtgccatgttctttgaggcacgatttgtatgccatttggaggagggagtccgttcaagagaatg

SEQ ID NO: 1556 - DNA, 300 bp, Homo sapiens
caagattgggctatggaattggaaggcctgttttggagtactctaaattaaaaaaaagttatatttgtaaaataaccaccacaagattgcctgattcacagttcttctgagtattggcgtaggtaattatttaagatgtttgataaattgtaaaatgctttttacattttttaaggaatcaattgaactactggaaaccagtatgtagtattcttggcaggtctaggtttcataatcctaatttctttgcagcccactattcagaaatgtagtgattaacagagtcaagaatgtttcagg

SEQ ID NO: 1557 - DNA, 300 bp, Homo sapiens
gtgattcctatttcaatatgtgaaacacttaaccaaagaatatatttcgatgaatcttaaacttgccttaaaaacagaagaggttaaaaagaatttagaaaaaataaagttttagagtgtttgagaatgtgtatataaaatattttcaaagccataatatggatgctcttatggctcagaagcatgcctactagaacacgtctcggaatgagagatgtttaattctgtcacctcccagaaagttttgcagggtttctcacttgaatttgcttccctttgcaacctcttgtcctgaaggcc

SEQ ID NO: 1558 - DNA, 300 bp, Homo sapiens
  misc_feature (1)...(300): n = A,T,C or G
gcgagggcctggcccccagggcggccacaccagaaggtcggagaaaggcccaaggcggatgccacgcccagcagtggtgagggacccacagattttggaaacgacctggacacactattgggaaggagatgtggacggcctgtctcctcctgcagggcccaccctaagaatgtatttttaaacacatgaaataagtatttttcactgataaaaaaaaaanaaaaaanaanttnnnccntttaaanttntngtgggntttttnacnnanntncaaactngnaagaanttcntngtggattt

SEQ ID NO: 1559 - DNA, 300 bp, Homo sapiens
agtaaattcagtgtttctgttgccgaagagtgtttattggttctttcactttcatttcatagggccctttcttctactggcattctcactttgaattactaagaagtttcttctaatatccctctatctcctttttctttctagttttagataaagctgtcaaaagaacagttatcatagaaatagaaacatttaaattaccggcacgatagcttatttcttgctgcaaccattcagaatatctatttgtcactgccttgggtgctttgaagtgaaactgtgcttagatataaaaagttt

SEQ ID NO: 1560 - DNA, 300 bp, Homo sapiens
ggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacc

SEQ ID NO: 1561 - DNA, 300 bp, Homo sapiens
gctgcctgtggcatagccactgctgtacgtttttggttgtttttaagaaactcgatgaagaggggtgtcattctgggctcggggtggttgccaatttttcaccagaaagggagccaccccttgcaaccacttctgtctccgttagccccccctctgccctcctccaagccaaagcgtggcctggcttttgtcttcccatttagttttcctcttttacccttccttttgtgcttaatttattaaaatagttgctgtataatttattttcataaactataaaaaaatactaaatggttaaaa

SEQ ID NO: 1562 - DNA, 300 bp, Homo sapiens
atctgaacccatgaagttgagtaaaaaaagcaatttgcagaaggatacatacaaaatgacaccatttatatagtagactgaaagcatgcagaacaatccattgttgtttacgtgtgtaacagtcataggaatgacaaccactgccttcagaattatggcgacctctgcgatggaagagaatgggatcagagaaggatacacaataggctttaactgattttgtgattattgatattagaaatgtttaaaattaagatattaacatttcatgaagctgagtggtgagcacaccagtgttat

SEQ ID NO: 1563 - DNA, 300 bp, Homo sapiens
tacatatttgtcataattacaataaaatacaaagagctattttggaactgggcaagctgtttctaaatgtatatggaaaaataaaaatgtctccaaaaaatccctgcagagggaaactagcccttccagatataaaatatattatagaactgtgtaattaaagcaatatggtactggtccataaaagaacataaaaccaaatagttcagtagactcaaaatgcaagcgttggtgagggtatggagaaaagggaacccttttacacttggtgtgaatgtaaattagtacagacattgtgga

SEQ ID NO: 1564 - DNA, 300 bp, Homo sapiens
gtttactatttattgaatgatgagccatactatttaaattaacaaaattaactgacttaacgaaattatctccagaaaaatactcttggaaaaaagtcatcaatgttcgtataattctgatattttaaaaaatcttttagattaaaacaaagggtcaaaacctccatagagtcaatgctaaatgggtgaaaatgtgacataaaaatgccctgtgttcaccagattgtcatatactttatgtaactcacctcagttattattatgcctactacacagatgaaaagactgaatctcaggaaa

SEQ ID NO: 1565 - DNA, 300 bp, Homo sapiens
atttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatctt

SEQ ID NO: 1566 - DNA, 300 bp, Homo sapiens
atttagtcactagctataatacatttagtgaacaaatgtagtcttgcactaaaattagagaatacctatccttttcaagaatacataaaataatgaccatatatataccacagagtaagctgcaaccaattctagataacttaaatacagaccatgtttggaaatttaagaaaaaaaaacacatttataacttgtggatcaaaaaagtcatagaacttagacaatacttggaactgaatgtaaatacaaatgctattaaaatttgtagtatgcagttaaacaggacttgtatacgcattt

SEQ ID NO: 1567 - DNA, 300 bp, Homo sapiens
gtttaatctctttaactatcaaattgcaattttttttttgccttgcaaataaacaaattacaattgtcatttactggtgagacaatgagaaaaagacaccctcaaacactgttggtagaacacaaattgttaaaatctttctaggagtcattttcaaattatgtatcaatgacctaaaaatatttatgtctcctgttcttatacttccagaaatctattctacagtaataaccggagataaaaacctttacatataaacatgatttattatactgaaaagtcaaaacaacataaatatta

SEQ ID NO: 1568 - DNA, 300 bp, Homo sapiens
gtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacct

SEQ ID NO: 1569 - DNA, 300 bp, Homo sapiens
gtgattaggagtgacagagtaggtaaagcagacatcgtctctgtaataaatacacatggtgataagtgctctgatgaagtaaaatagagcactgtggaaacacagaggagggggtggaaaaagtcagggaagtctgttcagaggaagtcacatgtgaagttagtgaagtggggaagcaaatgggtgcggtgggaaagagagtagttcctgaaaagggaacagcatgtacaaaggcctagaagcaaaacattgtatgcacatagtaactgtttaattggatatgaattttaaaaatcacat

SEQ ID NO: 1570 - DNA, 300 bp, Homo sapiens
gccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgccagtggccaggcctatgtggccctttctcgggcccgcagcctgcagggcctacgtgtgctggactttgaccccatggcggttcgctgtgacccccgtgtgctgcacttctatgccaccctgcggcggggca

SEQ ID NO: 1571 - DNA, 300 bp, Homo sapiens
ataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctcttt

SEQ ID NO: 1572 - DNA, 300 bp, Homo sapiens
gctatgtgttctgactttgttgattcaaataagtaagctaaatcaatttaagccattaataggtttataaagttatttgctatgtgttgttcttacatcattgattcatgtaagtagacttgtgtgacagctaattcttaaaaaattatgaagatgttagacttcttttgatatatatatgttgattgtatgaacagattgacatcaatatacttattcattataaaagatttgagtgggaactcaccaaatcccacaccaaaaaaatttaaaattttaccatagtaaaaaaaactaaaa

SEQ ID NO: 1573 - DNA, 300 bp, Homo sapiens
gcacaattggtattcaaacccaagtctgtttgactcccaaacccatactttgaacctgaagtctgtactgctgaaagtttctccttattgaagaatttatattttgcattaatttatgtcttcagaattatacaaagtattgggccacaccaaatttgagtctggtatagtagccttcttgtaaaaaattatatcatataacatttttatgactgtgaagacctcttaattcttcaggaaggagggccctttttcaaatcagacatcctggggtttttactgaccttatttcattctctg

SEQ ID NO: 1574 - DNA, 300 bp, Homo sapiens
gtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttg

SEQ ID NO: 1575 - DNA, 300 bp, Homo sapiens
atgacatagtggatctgagagcacttacagcatttctgcaccatgttcagtacttgaatctgaatctaaagagagggctttattggatcactattctgggataatattgaaataacaactaataacaataacaacaatttttgttttgtgaaaaaataatacaaccaaatgaaaatagattaatcaaaacagtgaaaaccctgtccccttttctgagcttatgaaaagagaacctaattagtaggcattctttttatagctaatgtgctaattgcctcagagataacacctgtgtaattt

SEQ ID NO: 1576 - DNA, 276 bp, Homo sapiens
atcattctggatttaagttgctttgtctcttgattgctcatgaacattcctatgtgagtaaatattcttcccaatgtgatttttttcttgttgttaaagacaggctctggttttatcgcccaggctggagtgcagtgacataatcatagtataagcatagctcactgcagccttgaactccagggctcagacaatccaccttcctcagcctcccagggtcctgggattacaggtgtgagccactgcactctgcccccaacatgatttttttttttt

SEQ ID NO: 1577 - DNA, 300 bp, Homo sapiens
ctctgttcagaagcccctgattttgctccagcagcactctcaccctttctagtgagtaagtacactggattttaaatccctagcacctagcactgtgcctgggcagcccagcataggcactcaataaatatgtgaatgaatgaatgtgtctgtctgtcagtcagtcagtcagtgtttatgggatctgagtgtattcactagtagattctatgttcttacttggcttcaagaacctgtgaatgaataaggatcaccactgtaaactaaaaacaaaattttaagccatcagctgactgaaga

SEQ ID NO: 1578 - DNA, 300 bp, Homo sapiens
aaacaatataactcaaatgcctttctacaggactacaaagctgtctgtatcaggttatggagttaaatcataatttctggatcatgatcttaaacctttaattggttccatttctactttactctttactaacaagtatcctgatggcctgaaaatccatgttgaaatttgaagtttgaattttccagatcaaatatgaaatttattttcattttttaaagtacaaaatatcagttgtataatcatggtaaaacataaaattttgctataaaagatttttaaaggctatttgattaaaac

SEQ ID NO: 1579 - DNA, 78 bp, Homo sapiens
ctcagaaccactctgtcgtttttaagcagggtcacacactctagctcactgggtccattttaatttctattaaacatt

SEQ ID NO: 1580 - DNA, 300 bp, Homo sapiens
gccaggctggtcttgaactcctgacctcaggtgatttacccgccttggcctcccaaactgcagagatcacaggcatgagccaccattcgtggccagttgttagtttttgagatagtgtctccagtttacagatagggagattgaggcttagaggaggcacatagtggcagaactaggatttgaatccaagtctgttttccctccaggacccaagcccttaaccactgtgcatttttaaaatagccagaggaggactcatgaccaccacctggggatgtgagcaaagccagagtccagaca

SEQ ID NO: 1581 - DNA, 299 bp, Homo sapiens
  misc_feature (1)...(299): n = A,T,C or G
gaccaacctggctaacatggtgaaaccccatctctactaaaaatacaaaaattagctgggcgtgatggcatgtgcctataatcccagctacttgggaggctgaggcaggagaatctcttgaacccgggaggtggaggttgcagtgagccaagatcacaccactgcactccagcttaggcaatagagcaagactctatcacaaaaaaaaaangagagagagagananataaagaggtntnttgggacanttanncatntttcctacattttctctttttttcaaagcccanaatccttgc

SEQ ID NO: 1582 - DNA, 300 bp, Homo sapiens
tttaaaaagcattttattatgtattatgaaatatttcaaacataaaaagatgtaaagactatctaccaatgactccccccttaataaaacaaattaacctgaaggctgttttgtgcccctccttgattgtgcattcacctcccaacccctcgctccttgggcaactgttatctttgttatttgtcattgccttaacattagatttttttattactgcttttgtaattctaatgatatcaaatggaaaaaatattttgaatgcaactcctcttttaatttgctccaattttatctgtattt

SEQ ID NO: 1583 - DNA, 300 bp, Homo sapiens
gagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctca

SEQ ID NO: 1584 - DNA, 300 bp, Homo sapiens
ggaagagctcgtcttggagtccaagcttttgccacttcaattgcaccagctccaggaaccatacaaccatcttcaatggcatttttgatagcacgaagtccatctcttatggcatccttgacttgtgtgagagtatgcttatttggtcctttaaccaacaaggtaacagagcaagggttaacacactcctcaataaaagtgaacttttcttcacctaatgtatactcatacacaagaccagcatgtcccaagcaatctacagtgagatcttcaaaagaattcacggccattccaccacaa

SEQ ID NO: 1585 - DNA, 275 bp, Homo sapiens
  misc_feature (1)...(275): n = A,T,C or G
ggtaaagcttcattcagtatccattcacccaatactggtttgattctagggcctaggaaaataggactgagcaaagcccttgtccagatggaacttatgttttagaggggaaaacaaaccataaaaaggtaaacagtataaaatcaggaaaggataaatgtatatgaagaatcaaaatgaggacggtgatggggataagaggggaaggntttnnatnacnncnngntnngaagngnaantttacncnntgtcgnnntnttntgnnctaccatggt

SEQ ID NO: 1586 - DNA, 300 bp, Homo sapiens
atgggagccatgggcagtggtcctggctggtgaaatgattctagccacgtggcccacccagggggcaaaacaatagaaaccttcagaaatgaaacgtcacctggctgcaagaagatagtcccacaggcgccctagagatggggatgccaagtggcttctcgggaagctgtaagaatccacagggcattgtaagatggagggaaatattaagttttcttcgtaaagaggtgaggggggcgagagcagcaaaggacactggaaaatgagaagcatggatgggaagtgttgcattgagcataa

SEQ ID NO: 1587 - DNA, 300 bp, Homo sapiens
  misc_feature (1)...(300): n = A,T,C or G
gaccaacctggctaacatggtgaaaccccatctctactaaaaatacaaaaattagctgggcgtgatggcatgtgcctataatcccagctacttgggaggctgaggcaggagaatctcttgaacccgggaggtggaggttgcagtgagccaagatcacaccactgcactccagcttaggcaatagagcaagactctatcacaaaaaaaaaaanagaganagagagagataaanaggtatatnggnacaattagtcntttttcntacattttctntttttttcaaagcccaaaatccttgca

SEQ ID NO: 1588 - DNA, 300 bp, Homo sapiens
aatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacag

SEQ ID NO: 1589 - DNA, 300 bp, Homo sapiens
ctggagcattctaaatgtatcactaaatatagaggagttctaattctgacaggaattctgtgagggcactggtagtatcctcatttaacagatgaagtaatttgagatctctgctggaaggtgatggagctgtgatttgaaccctggtgcctgattccaaagccatggctaagaataaataattcagtccactaaaatacctaactttggcaagccttggaaacagagtgcagaagattaatacagattgcccaggccagtacaagcagctatacagagaaaataagtaggtgctaggat

SEQ ID NO: 1590 - DNA, 300 bp, Homo sapiens
gccctctgcttcctggctgaccttggtgtggccctctgatggcactatgtgtcctcttctctgagctttctgaggatgacaagccgtcttttcaatgggactcccttccagacctgttggtctcaccatactggaatcatcataaagcctgtattgtaaaacatcattggtgtctaaagtttgcacaatgctatggcccccacattaagggagtctgggtgagatcacttcattgcccctacttctctgaccagaaaacacaagagttcatgggagacaataataacaacaacaaaaaca

SEQ ID NO: 1591 - DNA, 300 bp, Homo sapiens
gggaattctctgccttttggggaacagttacagaggacctactaaacccttggctggtgccaggccccgagaccacagagataacctgggacccaggctctgcccatggggagctcccagccctgtgaggaagacaggccatcctcacccagcacatcctactgtacccgaagagagggcgcagtgactcattttttgccgttggcattaggtttaaaagatggttgaacgtccacagaaggaaaaggaattcctggcagagggccctgcctgagcataggcagggaggctgagcagcca

SEQ ID NO: 1592 - DNA, 300 bp, Homo sapiens
  misc_feature (1)...(300): n = A,T,C or G
cttgagaatgaagaacccgcccaggaagagccagaacccatcactgcctcgggttctttgaaggcgctcagaaagttgctgacagcgtccgtggaagtaccagtggactctgctccagtgatggaagaagatactaatggggagagccatgttccccaagaaaatgaagaagaagaggaaaaagagcccagtcaggcagctgccatccaccccgacaactgtgaagaaagtgaagtcagcgagagggaggcccaacctccctgtcccgaggcccatggngaggagttggngggatttcca

SEQ ID NO: 1593 - DNA, 300 bp, Homo sapiens
gtaaattcctgggttccaggctcaagccttccactgtatgctccatgttaccagctatgccttttgaacgggagatgttgcataaataattgttgagtatgcactttagattctttgctaacatcacatttggtgaaactataaaataattcccatgaaaattggattgcttaatatcataactgatatttaataatatttaatattgctctaaaatttctggctaaaatgaaaatattcaaccatcaggaaggagaaacaaaactattactgtttgtaaacagtttatcatcagtactt

SEQ ID NO: 1594 - DNA, 300 bp, Homo sapiens
acctgtaatttcaacatttgatgagtcagagaaaaaaaggtttcctttgggtcttatttgatcactattctgttaattttaagcaagcttgtagtaaattgatctatttggatataaataggttacatgattatcagtactagagacccatgtatcctatttatttacaaaagaatattaaatatcctattttaatttttatattacagcctattttgattttttagataaaagtctagagcttttattttaatgaatgctaagagatcagaatgcactggcattctctgatttaatagt

SEQ ID NO: 1595 - DNA, 300 bp, Homo sapiens
gttaggtccattttgatgttacaggatacttgtaagtgactttttgccattctcttttgttacccatggcctttgtcacccccttgaatatctcttttactcagttctcactttctgttgttgacatacttgttgacatgtcccaccagtccatgaaatgaaataccatatcttccttgtgttgatattacttttgtgagtatttaagacatatataataaacaaatgtaaaactttggaaattgattctcttctcattaaaaaacatttaaagggaacatttagaatatttgtttacat

SEQ ID NO: 1596 - DNA, 300 bp, Homo sapiens
gaaaaaacaaagtaataacttaggccttgatcaaggattttagcacctaatgtttgctaagcttagctgtctggtgcagaaatacaagacataaatattatttcgtagacagttattatttccttactgtgaatttagcagaatttatagaagtcttttgggtagtaagctttggttaaattatttgtttttaaaaaatcgcagttcatgaaacatttctacttattaaatacaatgtgaatactatatctattcttgctactggtcataattgttagccctctcccatgcctcttctcc

SEQ ID NO: 1597 - DNA, 300 bp, Homo sapiens
actctggcacagccagagtcattggtctttcaagcagtcattcatatcagcgactttagaagaactgaaagaataggttgatactgaacccactcccagagccaggtagctgaaagggcactgtgattgttatcttactaggaacacgtggagtgggagtaaggcagttttctgcagaaaagagggattctgggcagacaaaaactacatatgcactatgttttgttttgtttttttgtttgtttgttttaaattaaaaccagaaaaggcgaagacttggagaatgctcaaaattttttt

SEQ ID NO: 1598 - DNA, 300 bp, Homo sapiens
gtaagccatatagtctgtccagaccactgaattcctttgttgtaggctgaacagactacaacaaatgggtgtggtataaacatagaaccagtccaatctggttcagctttgttagtaacaaaatgtaacaaaatgatgagtcgtttttcagtgcaatggacccccagggtgcaagtcacatatcgctggagcattaacagatgaacaaagcatgcccaattcataacccttgggtggaatgaaaaagtcaactacaggtagaacccaagtactcggatcaaggaatggggactatgctgg

SEQ ID NO: 1599 - DNA, 300 bp, Homo sapiens
  misc_feature (1)...(300): n = A,T,C or G
agtggctgggaccgcaggcgcgcgccaccacacccaactaatttttgcgtttttttgtggagacggtgttttaccatgttggccaagctggtgtcgaacttctgacctcaagcgatccgcccgcctcggcctcccagaaggctgggattacaggcgtgagccaccgcgattggccgcaggatcatagttcactgcagcctcgagcagccacttccggggcagctcctccattctctgagtttgagacttgctctcatctcagatcccttcagagctctnctggctgaacgaccttgggaa

SEQ ID NO: 1600 - DNA, 278 bp, Homo sapiens
  misc_feature (1)...(278): n = A,T,C or G
agattncccccntnncctncnnccnnggncacnaaangggaantntnnnnnnaaaaaaaaaaaaagaggtgggtggattacttgaggtcagggtttgagatcagcctgaccaacatggtgaaaccctatctctactaaaaatatagaattagacaggcatggtagcgcacgcctgtaatcccatcttcttgggaggctgaggcaggagaatcgctagaacctgggaggtggaggttacagtagccgagatcgcgccactgcattccagcctgggcaac

SEQ ID NO: 1601 - DNA, 300 bp, Homo sapiens
actggttaaatagcccttgatgacttttcatgtggcatgagagggatatgcttataaagcttaattctgatattatcctcttactacctacagtatgttttgcaaaaatcagtccacttagcaaactaatctttgtaaagcagtcagtttcagaagatactttttatcaaaaaagatggcaggtttaacattataccttttggtttttgcccaacatttgatttaatctaaagcaagaatataaaataattttaagaagcatataatttcttttgataaaaagtaacaaaaatttaatgc

SEQ ID NO: 1602 - DNA, 298 bp, Homo sapiens
  misc_feature (1)...(298): n = A,T,C or G
tttggtcagttgcaccttctgggtcactggtagcgcgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagacaggagcaactcggnggnnngcggnngncantttgatttgngncntcnncggcagncncatccnccgaatcac

SEQ ID NO: 1603 - DNA, 300 bp, Homo sapiens
caaagatctaatgagtcacaggatgggggatgaaattgggaaaggtctggattagcagagttgctgcagaaagaagtagaggggaatatcttagaaggcacttggacagaatgggggtgatataaaagatgtatgctgtcatttttgttttggctcctagaaaatatagcagaaagtgagaatttgtgccatacatcctgttctgcaccttaatatggaagtttgcctttccacacgagtcttccttcacaattaacctctaattttttttttgcagttttctccagattttggaagatt

SEQ ID NO: 1604 - DNA, 300 bp, Homo sapiens
atataaaactgaagggagagactgggagagagcttcacagaagagatttttgggtcagatgctgaaagactaggaaaatgtagtgcagagatggccggaggagagtctggagttccaaatagttgcctgctagggaaggcagggagaggctatgccgtgaaggatcctccatacactttaaggattttgggttttactctgtatgtgatttggagctcctgaaggatgttaatgaaaagagtgataggattggatttgcttttggaaagatctccatggtagcacgttctaaaatgggtt

SEQ ID NO: 1605 - DNA, 300 bp, Homo sapiens
ctttagaggtaaccagtatcatgactttaatggtaattatttatacaatttttaatataactttgtcactttacgtgtattcctaagcagtatgtttacttttttcgcctcattttaatctttatgaatcgtgtattctttcttcctttgctcagcattatgttttgaagagttatccatgtagttatgtgtagttttatttcattcatttttgttattatgtattatccctttgaattaaatgtgccagaatttattcatccattctgctgttggtagatcattgagttgtttctagta

SEQ ID NO: 1606 - DNA, 300 bp, Homo sapiens
gcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccagtgcattctccccctgacacagagaaggggccttggtatttatattta

SEQ ID NO: 1607 - DNA, 300 bp, Homo sapiens
gttctgagcagttagtacgtggcagttgtattattagaggaagcctgtcttgtttttttttaaataagctgatagagtgaggattcttttaatcaagactgtttgggattgaattgccactcctgcttaccagagtgtaggcagtttttcttaaactttccaagaagactggtgtcctcatctaaaatacgaaatgcttacagtaattgcctcatggggttgtttggggtgactaaatgtagtaggatttactacatagtaagttctcaatacattgtagctattattattagttcggta

SEQ ID NO: 1608 - DNA, 300 bp, Homo sapiens
ccaggtctctccactgtcaagttactattattccctttataatttgcagtttaagatgaaatgcactagttttagtgcttcatctgtaaaactacttttttatgtgaatttattttttaaaaaatgtctgtcactaaagagaaaatcatcatcgcttggcatggataaaaacactaactgccaaagtcattaacttttggccaaataccaaagccagctaaagtcacagggccttggcctgtattctttgttaaaaagagattaacaactgtcgggtgataaacataagatataccagca

SEQ ID NO: 1609 - DNA, 300 bp, Homo sapiens
cctccctccgcgagctggacgctccgcagcccgcccgccagccggcccgccggccgccgcaggaatccctggataaagaccagctcaaccatcgctgagaaaacagacctaggcttcccagggcggttaacccgccggcctctgggcagagactaaaagacaaaacaaaataaaacaacaacaaaaaactcccagtgtgtttcctactcttctttgtcttggaggaaagcaaagggagagaaatggacttcaccagtggtctttggcttcatcaattcacaggaaatggcatcaagatgg

SEQ ID NO: 1610 - DNA, 300 bp, Homo sapiens
cttcttctcaactctctgattgcttatataagtgacgtcttctgaaggaaagttcagcattttttctcagatatgataataatatatgctaagatcttggccaggcacggtggctcacacctgtaatcccagcactttgggaagccaaggtgggcggatcacttgaggtcaagagtttgctgccttcaaatcaatcattacttcttagcacctcttgaaatagaaaataaaaaatttggccaggcggtggccaggcgcagtggctcatgcctgtaatctcagcactttgggaggctgagg

SEQ ID NO: 1611 - DNA, 300 bp, Homo sapiens
tgcacactaacatggcacctgcataaaaaccacagacaggtaactttagggacttcacagtggactcaagcagactgatcccagattgtaggtagaagtgtgtttgcaaaggccagaggagctgttaggacataatgcgatggagacaatttgcaacaatcactgaatccacgtttctgctgtttaagggtggctgaaaggatggaggtatagcttgtaatgcaaaatatacgcagaggttcatagtgaagctgaggaggagggccttcaaaagttaagtgggagatgtttaggtcagta

SEQ ID NO: 1612 - DNA, 300 bp, Homo sapiens
ctggaattagattgtgtagggccgacattggatttattttaagtacaataggaagccactggaatgtgataaccagaggcttgatgtaatctagtctaatctattaaaggattgctgtctagtttgtgataaatggagccttgaccttggtgtcaagaaattgtccttgataccagcaaggccaatttggaggttattgccattctgagatgagaagcagtaatgacttggtgtttatttgagatagaaagcaagtaaaatagaaacattttctggtagtagaggcaagaaaacttggtg

SEQ ID NO: 1613 - DNA, 300 bp, Homo sapiens; identical to SEQ ID NO: 471

SEQ ID NO: 1614 - DNA, 300 bp, Homo sapiens
tctaaattcatggattatatttatatatgtccttaatcctcactcacattggccctacaggtagattcattgctcactgtcagttctcttgctgaagttttcctatttttctcttgatttgctgaaattccttctccagtagtttaatcaaaagggactaaatgaaaaaaaaaatattcagttgttgcaagttcaaaaaggtttttagtctttgtgtttgattgacagctttccagcatataaaattcttaggccacactttctttccttgagaacttcacagatgtcacttctgtctct

SEQ ID NO: 1615 - DNA, 300 bp, Homo sapiens
tctaaattcatggtttatatttatatatgtccttaatcctcactcacattggccctacaggtagattcattgctcactgtcagttctcttgctgaagttttcctatttttctcttgatttgctgaaattccttctccagtagtttaatcaaaagggactaaatgaaaaaaaaaatattcagttgttgcaagttcaaaaaggtttttagtctttgtgtttgattgacagctttccagcatataaaattcttaggccacactttctttccttgagaacttcacagatgtcacttctgtctct

SEQ ID NO: 1616 - DNA, 300 bp, Homo sapiens
cagacagtggccccggctgggagtggtttttgtttgtttgtttgtttgtttttaacctcatcaatgttataacaaaacaacgctgaatgaaacgatcctattgacgacctgctgtgaaatacaggataataactacccaaaggagggcagtgtgaaagtggaatcacactgttgtaaaggtattttattgtgggaggtggtacagtattaatctaagaagaccagtaaagacgaatattgtaatccctggagaaagcaccaagaaaataaaacaaatagagcttttcaggaaaaaaaaac

SEQ ID NO: 1617 - DNA, 300 bp, Homo sapiens
gaccacctacggaaaactgaggcccacataagctcgattggttgtacctccaacagatatttattaagcacctactaaatactgagcccattgcaagcaccagggaagcctctgtgaacagcacaaggtccctgctctggagattctgcttcagtggtggagacagaaaataaacagtttcccgtcaccaattttccttggaattggacagatggcagccaccataatgatactatatgtgtccaagctaaacaaaatcattcacttccctgattttgataagaaaattcctgtaaagct

SEQ ID NO: 1618 - DNA, 300 bp, Homo sapiens
atttctagctataaagaattaggttgttaggttgaataattgtaaagcctgtgcccgagccgccagttggcgatgcaggtggttgaggggagatgtgggtggtatataagaagcaaaggactctcagcccctgatgtgccccgcgtggtcttcttagggaggctcaatgcataaagacagaataaaatgggatcctccacagagatttaatctgtagaagatcaaacacctgttgcctggtcaccttagtctaaaaagtagtggagttttgttttgttatttttttaaagcatgattcta

SEQ ID NO: 1619 - DNA, 300 bp, Homo sapiens
gtgagatacctgcccctactttgccttcttccatgattggaagcttcctgaggccaccccagagtcagaagccgctatgcttcctggacagcttgcagaaccagtattcactgactgctgaaactagagcatcactgagaagcaagagatagactgacctaactagagggagagctgccatccaggatgatgccaccatcacaggaggtgagaaggaacacagcatcttctgcaaatgctacagtaaatagggacggggtgcagcaatgtgaggaaagtggaatgaacttggactttgaa

SEQ ID NO: 1620 - DNA, 98 bp, Homo sapiens
actctctctacaactgacagagtaaatagacaaaaaatgtatgggggatatggaatattttatcaacacaagtaaaaagcttgatctaacaggtggtg

SEQ ID NO: 1621 - DNA, 300 bp, Homo sapiens
gctggcaataaataagatatctttattatgattatgttaatagttaaaatttgcatgttttctagatagtctgttaacaggataaaaaaatacaaaaaggcgagcttcttaatgattcagctgaattaactataaaattaaaatacctgctaattattatcttctaaaataacacaaaatatattcaatacgcaatacaaacctcagtaatccaattctcctaatatgcaattatttataacctctgaactaagaggaagtggtttgactaaacagagaaataacaatgtttttatccta

SEQ ID NO: 1622 - DNA, 129 bp, Homo sapiens
gtggcatttgatgctgtgggttggagcccagctttggggtcagacacacctgggtttgaatcacattgctgccccttccaggctcacatcattttatttcttttttctttttctttttttttttttttt

SEQ ID NO: 1623 - DNA, 300 bp, Homo sapiens
aaaggctatctatattagctggggttccccccaaaagcaacattggataaggactcatgggcagatactttcttctggaaaatgatcccgtaggatatgggtagaaaaagaaattgggaccagaaagaatgaaacaggaaagaaagaaagcctattgaaggatataaaatttctgtaaacaactggagcttagtcccactgaggccccctgaggaactgcgcagaatgtaagacagaggaggaaatatttagccaccagttcctatctcccattggccaacttgatgctgagttcaggag

SEQ ID NO: 1624 - DNA, 300 bp, Homo sapiens
gggattacaggcgtgagccaccgcgcccagcctcatatcccccatttcaaacacgctgtaaacaatgctcaattactttcctcttaagttgaaaccaccaattactggggaaaggggcagttagattttattggttgactttgtgtttttactaatccttgttgaaaagtagaggaattggtttagttgagaaaacaaaatactaaaaaatctgccactagactttttaagtcaagagtttgtataaaatgaaacatatctactatctaatctataaaatttagaatctttttaattcta

SEQ ID NO: 1625 - DNA, 300 bp, Homo sapiens
cattacatgattctgtcttaacgaagatagaagcattttattgcataagttttcttctgtgtgtgggaatcatatgtgggtgtatatatgtttaaggggtatgcatccgggtagacgtttgtgtgtggacatgtgtgtacaggtatataagtacatgtgtcatagccttggtacaggtctcatagccttgcagcactgtgttcctggcgggagtggcatctgtctgcatgtctgaaaatgccacgtgtgcattctgctgatcaccaaggttcgtggctgtaggcatcctctcttcagtgc

SEQ ID NO: 1626 - DNA, 300 bp, Homo sapiens
gctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaag

SEQ ID NO: 1627 - DNA, 300 bp, Homo sapiens
cagggatccacttgccttaatttgcacagtgttcttataaatcaacagaaagtacacataacagaaaaatttaaaaggttagggatcatttaggaaaaaatgcaaatgccaacaaatgtgagaaaatgctcaatcttacttataatttaagaactacaattcagccaggcgcggtggctcatgcctgtaatcccagctacttgggaggctgaggcacgagaattgcttgaacccaagagggagaggttgcagtgagccaagatcatgccactgcactccagcctgggcgacagagcaaga

SEQ ID NO: 1628 - DNA, 300 bp, Homo sapiens
gtgaggcatatttgctttaacatgcgcttattacagaagttatgtttactgtagaaatttctggaaatacaaatgcaaaataaaacacaaatctctgtcattctgcagaaacagcattcttttgaccccttttgttttattctatagatgtatatttttgtgtttacagaaacttgatcatattattttataacttgctgtttcatataaaattatcatgaacatcttttgtgtcatgacatgtctcttcttttaatgagtgcatagtcttccaaactacaaatcttccatactctgttt

SEQ ID NO: 1629 - DNA, 300 bp, Homo sapiens
ggtaagtgcttagaacaatatctaacacatagtggttgcccagtaaatgtgagctgtgttgattttgagattataactacaataagaactttttcaaattgatacatatttagccgatataatctaattttttaagatggaattattctagttgttggatttacacactgtagcattatttttgggaactaccaaattattccagtttgtcatcataaagtagttgctaaagcaataaaaagtgaaatatttattcatgaaagagtagttcatgtcattaagtgtatgaatggagtgatt

SEQ ID NO: 1630 - DNA, 300 bp, Homo sapiens
aaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttg

SEQ ID NO: 1631 - DNA, 300 bp, Homo sapiens
ctatgatctagatctagtataactcttgttgttttatatattttattacactggaacagctcgtgccctcggtctcttgcctcggcacctggatggcttgccgcccacatattggaacttcattgtggaagttactttaggcctgacagtgaaggagtttcctctagagagagtttctgttaacttctgatctgtgttcttttgtaaagcatgtctcttgtaaacagcatatagttggtcttctctgccctacagtttattctaatgtccctatgtctctaaattggagtgtttagtaca

SEQ ID NO: 1632 - DNA, 300 bp, Homo sapiens
attcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcaagccttgccagggcccaggcttggca

SEQ ID NO: 1633 - DNA, 300 bp, Homo sapiens
ccccattcaagtttcaccagttttctcaatcacattccacaggcaattttaattcacatgtattatttagttgtcacgtctctttaatctccttcagtctgcaatagattcttagtttctcttagattttcatggactttgttacttttgaagattatcagcagttattttgtatctctcagtttgggtttatctgatgtttctgcctagattcaagttagacatttcaagtagtactgtaacagaagttatgctatgttcttttcattgcattctatcagattacatgattttgattca

SEQ ID NO: 1634 - DNA, 300 bp, Homo sapiens
accatgttgcccagtctggtctagtctgttttaacaagttgttgctgtgtaatgatatatgtgtggtgttaatttgcttgttcctaagtttaaatgaggtagagcattttatgacatgcctgttctagtcttttgcttatttttctaattgccttttctttttcttaataatttcagttcttcatatgttcagcatactagtcctttgtcaatttacatgtattgaatatatatactctcccattctgcggcttattgttccattcttcatgaacatttgtaattttaatgtcctattta

SEQ ID NO: 1635 - DNA, 164 bp, Homo sapiens
cggcacgagcccaggctggtcttgaactcctcagcttttactttagcttcccagtgtgttgggattacaggcatgagccacaatacctggccaagtccttttttttaatcaaatgacttattaatacacagtttctttgccagcttttgttccctttagtgaga

SEQ ID NO: 1636 - DNA, 300 bp, Homo sapiens
gggaaaagaaaaatagtagtagaagaggaggagccattactttcatttctgttcattctgaagaaacagagatgactctttctgtataactcaaattcttaaaagaaacccttgatatatagtgtcaattatatgaactctacctcagggtacctaaaaaaagaatgtttggttacccgaatgagggggaggttttcctttagagagaagtattggggccaacaaatgaaaaaggaatagtttgaacaccacattttgcaactcctaatgaaataatggatttaaagaattatcgatggc

SEQ ID NO: 1637 - DNA, 300 bp, Homo sapiens
aagaaagggaaagtaggaacagggagcagagcaaagcataacttgctgtgttccagggatttaaaaataaattactgtcaagagcaatataagggtcatgggtttgatcaggaactttttgtaaatgaaaaagttcacaatttggaaaaaacagtgctagatgtgttatggaaattgttatcacaaattattccactgaaactcaagtatataagacaacaatatattgctgtgaaatcttaattttgacatatggaaggtaaccaaaaataagaaccatacctttttgcttgaagtgca

SEQ ID NO: 1638 - DNA, 300 bp, Homo sapiens
ggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaagg

SEQ ID NO: 1639 - DNA, 300 bp, Homo sapiens
gatggggagccattgaagggttttttgagcagggaagtgacatcacctgggttacattttaaagattcactctggcagcagagtgagaaatagactaaaggaggcaggaggacacgagtgaaaacagggagctatagcaagagtctttgtggttgcccaggctaaagatgatgctggcttggactggtgtagtagtgatagacctacacaagtggtaggatcaaaacagattgaagctagagctcacaggaatttgctgccatgtgtgaaaaagaggatagaaatgactgctaggttgag

SEQ ID NO: 1640 - DNA, 300 bp, Homo sapiens
gctatttgtgttttgttgcactgttttttttgtttgtttgtttgtttatttggttggctttttggagagggaaatgggggtgaaatatttttttattggtgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaa

SEQ ID NO: 1641 - DNA, 300 bp, Homo sapiens
  misc_feature (1)...(300): n = A,T,C or G
gtctcatcctgaggccactttctagggccatttctggcaccagatgttttatttcagctcccccaaaagcaaaaccctgaggcagggatcttggttgaagtggggaggggatcccagaaagtggggtgagggtacggaggcatgaggtaggaaagggaagaaaggagataaaatgtgtgttaatgagcaggttagcactgtggaccaccacgctcaatcccactgagacgtgaggaagctgggaatgtatccaccaggccttaatttatcaagatgaggattactcctngaaatgttaac

SEQ ID NO: 1642 - DNA, 298 bp, Homo sapiens
gcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtgaagacgatgaagaggacgaggaggagggcgaggaggacagcagcaactcggaggatggagacccagacgcagaggcg

SEQ ID NO: 1643 - DNA, 277 bp, Homo sapiens
  misc_feature (1)...(277): n = A,T,C or G
tagttttttgttttnnnnnnnnttttttttttttgtatattgatgaatgagatcttacctattaaatatattattggattatggttcctgaaggtcattaaagtttgagtgtgtgtgtgtgtgtgtgtgtgtgtgtgtgtgttttatgacttaaatatctttacgtgtgttttttagagcttggttctttaaagatttggagaagatatgtaaattaccaaggcacttggttcttctgttttatatactaataatcagggcctaagttaaataaaaa

SEQ ID NO: 1644 - DNA, 300 bp, Homo sapiens; identical to SEQ ID NO: 489

SEQ ID NO: 1645 - DNA, 300 bp, Homo sapiens
atttgctctaaaggctgagaataccgatactttcccactggaccccacaggtaggtcatatttcccagcttcccttgaagctagagaggccacgtgtctgagtcctggtcagtgatgttggggaagtgaatgtggaactgctaagcctggagccggagcaaccttcctcctgcagtccccggaggatggtggaactcttacacggaaggatatgcgttcctggaggcatgcgaggcaggcaggagccccacagctcccctccacaccaattcatctgcacaggaatatgggattgcgaat

SEQ ID NO: 1646 - DNA, 300 bp, Homo sapiens
ggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgtt

SEQ ID NO: 1647 - DNA, 300 bp, Homo sapiens
ctaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtacaccggatatgggctacttgtgactagacttttaaactttgctctttcaagcagaagcctggtttctgggagaacactgcacagcgatttctttcccaggat

SEQ ID NO: 1648 - DNA, 300 bp, Homo sapiens
aaaaggtggccatgtgagaaggactcagcaagactttgctggctttgaagatggaagaatgtggccaaaagcctagggatgaatatggcttctagaatctataataaacaaggaaacattatttcccagagcctctagaaggactgcgttttgcttttgcctcggttttagcccagtaagacccattttagacttctgatctttggaattgtaggttaatgcatttatattattttaagccactaatttctggtaatttgttacagcagccgtaggaaattaacatgtaggaaaataaac

SEQ ID NO: 1649 - DNA, 166 bp, Homo sapiens
ctcagctgaaattcttttccctatctagttttgttaaggaattcaacacatgccagttaagctgtcataaatgaaataatctacctcgaggctgtattttaacagattattatatcgaaagaaaaaaatgaatgtttataaaataacatttctttttttttttttt

SEQ ID NO: 1650 - DNA, 300 bp, Homo sapiens
ggaaccaggggctgcagaaccagcccctccccaatgaggaccccctctggacgcccctccccatggagaacaccaggagccacagaccccagaccacagagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggcttaa

SEQ ID NO: 1651 - DNA, 300 bp, Homo sapiens
tgaacttgttcattttgttttgcttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctg

SEQ ID NO: 1652 - DNA, 300 bp, Homo sapiens
ggttcagagaaaagtaggcagagaaaggcagtttaggaggtgacacaagagggaagcctaaggagagagaactggatggagcttcccaggtgatgacagggttgaactccagggctatacccagctgagcaaggagagctttgcctcttcaggagactggaagttggggaagactccaacaggcttgtggtcagaagctcaggagactgggaaggaaaagtgaatttctgaggagtcctagttcatttcattaatttgttcaattctttaacgtatgtttattatggacctactatgttg

SEQ ID NO: 1653 - DNA, 300 bp, Homo sapiens
tagacagccatgttgctcacacaaagcctgtttgctggtctcttcacacggactcgagtgaaaatacacacgcacacacacacaaatggacatttaccccactcctgcttttgtgctattgtggtcatgcatagtatttcttttttgctgttgtttttcttgttgttttcactgtcatacaggtatttatgatggaaacagaatcagagtctgaccttcctgacttgaagtacaaggtttctggggtttttcattcgtgttttatgtgttttttaaaaaattatttgtgtttttaatcga

SEQ ID NO: 1654 - DNA, 300 bp, Homo sapiens
agacaagccagatcaccaagatccccattctgaaagaccgggagcctggaggtgtgacccagcagggctgttgtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttga

SEQ ID NO: 1655 - DNA, 300 bp, Homo sapiens
accacgcccacctgtaaccattatttttaagattgctaccattggatagttctgtcattgtccaacttttggatatttaaaattgatccctgtgtggctaacagaattaatgtttccaaaaatgttgaaaattatatagttctcttaattccccacctctaactatatttttgggttatttctttaggaacagatgcccaggagtcatattactgagaatctagaaatcttttgcaaagttcttgttatattgccaaattgcttcccaaaagggttgttctaaaccataatttcaccagc

SEQ ID NO: 1656 - DNA, 300 bp, Homo sapiens
gagaaagtaaagtccctttataatggcatgtgaaccagacaatttagtagccagggttgtaaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgccttgtaagaggtagcactagtaagtaacagtgctcaaattcaactaggtctttcagctttttatacaatactgcct

SEQ ID NO: 1657 - DNA, 300 bp, Homo sapiens
gtgatttactttctcattcaaaatacatattggatattgtatctaattttgtattggtaattttgggttatgaaaccccagatttgaagccccaaattgtatagggttcaatgcccataaaacccagatctgcccctgcttagaggccggcccctctaggagacagcatgtggggccacccagagatgcaggactcttctgttctgccctatcgcagcagagaggccatccctggagctggaaggtgcagactgggaattgctccttctctgaattgctagctcctgctaatgcctgcat

SEQ ID NO: 1658 - DNA, 300 bp, Homo sapiens
gtggcccaaggggcccacaataaataacacagtcactcctattggtacagcaatgccaagatttagaagttatttcataggagctgggacaaaggtcaaacctctctttgggcaagaccgtattctttattgcatagctttgaaaagagattttgtattacccaaacatttattttaaaaaggcacccccatatatccatcactcgaactgtacatttctaaatgtacattgacctttggtatattagtctagcaatccagattttgcctcttgttaagcgtatcagggtcctggcagga

SEQ ID NO: 1659 - DNA, 300 bp, Homo sapiens
agacactgaaggaaccaataaataatcctgcctctattaatgtatttttatttatcatgtaacctcaaagagccttctgtattgagtaagcattctatgtctttttttaattgtacttgtattagatttttaaggcctataatcatgaaatatcactagttgccagaataataaaaagaactgagtttaattatgaataatatgtaagctaggacttctactttaggttcacatacctgcctgctagacgggcaacatgaagtaggacagttctgttgattttttagggccatactaaag

SEQ ID NO: 1660 - DNA, 300 bp, Homo sapiens
tccccatctccacactccctaccctctgtcccctcaaccctgctttatttttttatgaagaagagagatgacattatttggattttgatattaaacagctaggttatcttaggtaaatacataagcttttgtgggccacagtttcttcatttgaaaaatgaagttggactagttttgcagtgcttaactgcacagagcattagaatcacctggggagacttcataaactacacaaccaggggtgtacctgagatcaaatgaatctaggccttctcaactttaatgtgcagacaaatcacc

SEQ ID NO: 1661 - DNA, 300 bp, Homo sapiens
  misc_feature (1)...(300): n = A,T,C or G
ttgcaggatcccatcggntcgtccccatctccacactccctaccctctgtcccctcaaccctgctttatttttttatgaagaagagagatgacattatttggattttgatattaaacagctaggttatcttaggtaaatacataagcttttgtgggccacagtttcttcatttgaaaaatgaagttggactagttttgcagtgcttaactgcacagagcattagaatcacctggggagacttcataaactacacaaccaggggtgtacctgagatcaaatgaatctaggccttctcaact

SEQ ID NO: 1662 - DNA, 300 bp, Homo sapiens
atctatatctattaatatttttctgtagatctatacctatcatatccatccatatgtttatattatatttacctaatctatttaatctatatcatgttatgcacatatatatgaaacatttttgagtggaaaattttatggaaaaagtattctatataaggtggattagtaatcctcttttgaaaaaaaattctagttcttctcaattgtgaaagatatgtctaagctttctaacaaaatgaactccaaacagtcttagatgtctgcctctttttaatcatttagtgaaataattggttt

SEQ ID NO: 1663 - DNA, 300 bp, Homo sapiens
gttggtgtgtgtctgcatgtccaaatctccctctcctttctcttataaagacataggtcattggatttagggcccatcgtaaatccaggacaatttcatcttgacatccgtaactgattttatctgcaaagtctctatttccaaataaagtcactttctgagatttcaggtggacagttatttgcggggatagtattcaccccactagattcagggttgtgggaagtgttgcttactaaactctggttcacggagctgccaaagaaaagagatttatttttaaacctaggagagaaggca

SEQ ID NO: 1664 - DNA, 300 bp, Homo sapiens
caggctcatctccaactgacctcatgatccactggcttcggcctcccaaagtgctggagtgcagtggtgtgatcatggctcactgcagccttgacctcctgggctaaagcaatttgccttcctcggcctctcaaagtgctgggattacaggtgtgagccactgcacgtggcctctttttagtttattttttccaaaattattttgaaaagtttcaaggtggaatgtagtgacaccatcacggctcaccgaagacttgacctcctgggctcaggtgatcctcccacctcagcctctcaagt

SEQ ID NO: 1665 - DNA, 300 bp, Homo sapiens
gttgatctctcatcagtgtttgacagttaatcactttttcctccttgaaatacctctttgaggcttccaagacaccacacacaactggtttacctctctctgtctctctcttttttgtttcctttgctgactctttctcagcatttctgctagggttcagtccatggcttccttcacatttctgtctcactttctcccttaatgttgctatctagtcttttaattttatttatttctagttttaaaatttaattttaaaaacttaattttatttaatttttgagacacagtccttgtagt

SEQ ID NO: 1666 - DNA, 300 bp, Homo sapiens
aaaattatcaaaccatcctttgctggcattaaatattcaagttgaagatccttcaccttcctttaatcctatattagagtctataggtgtgtctttcttatagcaatcctgcactcacataaaaactggattttcaatataagatcaaaatgtatttcacaaaaaatgcatctttatatttggttacatttctcctgactgaatggtgccatgtacagtctgtgtaagttatagaaaacgtttgccaactcgtagtctaccattttggtatttggtttctatttggttcgtctggtcttt

SEQ ID NO: 1667 - DNA, 300 bp, Homo sapiens
ctgagacatgagaatcacttgaacctgggaggtggaggatgcagtgagctgagattgagccattgcactccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggcc

SEQ ID NO: 1668 - DNA, 300 bp, Homo sapiens
gtaaagtgtactgattgagaactagagttgtggggtcagacagacctggcttcaaatcctcctcggccacttacagctatgtgatctctctgagctcaggtttctcatctgcaaagttgggttaataatacaagttcttgctcattgttttgttgggaggagtgaatgagataaatcacgtaaagcacggaccacagtgactggctgataataagcctcagtggatggtcgcccttagaattattttgtaaccctttgcttttgaggcagctggtgagctctgtagcctcagagattact

SEQ ID NO: 1669 - DNA, 300 bp, Homo sapiens
ggatgggtgccctggagccaggcaaggcaggaggccccagaaacttggtgggggagataacggaggggatggagcaggaggaatcctgaaaaccggactgggagagatggggccgagtggacgatgcccagtaccagcgggcgtctgagactgaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagagg

SEQ ID NO: 1670 - DNA, 300 bp, Homo sapiens
ctaaagccggctatgggaagccatgtcatacttggctaccttcctatgttccttctcacagcaaaactcttggactgatcatttgaagtcacccctctgtgtcttcttgtgaaatggcttgggcgtctctgggctctgacttgctcatctgggaagagatggggtagagggagttggattataaatcatgcttcactcagtcaacagaatgctactcaggcactaaaaatgatggcgtagccctacgtattctgacatgggaagatggccacaatatcttattatgtggaaaaaactagt

SEQ ID NO: 1671 - DNA, 300 bp, Homo sapiens
aaaatgctttcctatacatcatcttaccacagtatcgtgagacagtcaggaaaagtagacaaatgtcattaacttcattttaaagatgaagaaactcaggcacaaaaacagttatcaaattgccaaaagggcacatagttttagaaatgggactgaaatccagctttcctgactcaaagtcctatgttaatccaccagtcatttattgagcttctgctatgggctatgtattgtgctgaatgtagaccaacacagaataattcctaaatcttacagactttttcatagtaccctgtctgg

SEQ ID NO: 1672 - DNA, 300 bp, Homo sapiens
tataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgcaaatgagaacagcgcctcctctgagctgc

SEQ ID NO: 1673 - DNA, 300 bp, Homo sapiens
cttgcttgaaatacagaatgtccagatctactgagtcagaatttacattttcaaaagcttcctacgtgactcatgcatattaaagtttgggaagcactgacttagattaccttttgagaattccagatgggtcagaaaccagacagaaatactcagtagtgagaagctatggtgtatcagaagctgttaggcatttcatggtttggtagtgagcaagacagatagttttcctgtattcagcgacttagtctagagagagacaggatggaattaagtgtttaggtgctagccaaaagtaaa

SEQ ID NO: 1674 - DNA, 300 bp, Homo sapiens
aaatcagttattaaactttatgtatatattttagccagagcttaatttttatgaagataaagacatgaagtttaacaatggacaacagttagtacagctaattgtgaggtcaagtaattgttagacataggggaaggctttgttccacaatattatatggaccactgaacaagaatgacagccctttgttatcacttggcatatgaaaagtgttgtgtgcatagtttgtgttaattttttatgtgcataaaaatgtgattttaatttatatgctctgaaggataattcagggtatagtta

SEQ ID NO: 1675 - DNA, 300 bp, Homo sapiens
aatccttcttgggaaacatgttattgtcctcattgtccagattagaaaactgagtgtaaagtaagttaaattatagtcctaaggttgaatgctaataaagacagaatacaagtccaatatattggactcaaaagccctcacttaactatggtctccatgggcttcccttggctctctctgcctttttttattttttcttattgcttgaggccctttctggaaggtaagtctggattatctacttcacactgttttagagaagacttgtggtttccatttaccccttactccctccgctcc

SEQ ID NO: 1676 - DNA, 300 bp, Homo sapiens
ctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagt

SEQ ID NO: 1677 - DNA, 300 bp, Homo sapiens
  misc_feature (1)...(300): n = A,T,C or G
gttacaaacagtggaaaacagacattttcagatgtttgcacaccatgcaccatgcaaaatacaaaccagctgaatcataaaaacaaatgactagttactgggagggttttctctctttctcattatttttacttctaccaaagtaatgtgcacatactggtaattttattttattttaattttcaccaagctagctaattttctttcttttttttttgngnaggngggctgtcggccttttgtcgaggntgatctccaactcctgncctcaancannccttccncttgggcctaccagag

SEQ ID NO: 1678 - DNA, 300 bp, Homo sapiens
ggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcac

SEQ ID NO: 1679 - DNA, 300 bp, Homo sapiens
ggctgcctggggaaggagaaatctgagccaagacctgacaaatgaataggagtaagctaaggaaagtgactggggtgagtgagttccaaatggagggaactgcatgtgcagaggcctggaggtgaggggaacctgggcacattccaggagctgaagggtttgttgtggctggaacataaagagccaaagggggccaagcagtgcttcacacctgtaatcccagcactctgggaggccgaggtgggcagatcacctgaggtcaggagttcaagaccagcctggtcaacgtggtgaaaccct

SEQ ID NO: 1680 - DNA, 300 bp, Homo sapiens
aggcatttcaaactgaacacatctgatacagaacttttcatttccttcccaactttgcccacgccagcctgctcctccttcacgctttccacttagtatatgatcccactattcactcagtctctgaagcttaaaacctaggattcatccttgactactgtattctttacaatctactcctaatgcattagcaattcttgctagctctaccttcaaaatatattctgaatagactatttcttgccgtttcccttgcctccccatttcccatctgcaccccttctctcctccccaaatcaa

SEQ ID NO: 1681 - DNA, 300 bp, Homo sapiens
aggatgtctgctggacatccaagtggctgtgtcaagtagtcatctgtctatttgtgtctgaagtgcccaggagaggcctgagcttggagcttacatctgggactcattgctaagtaaattatatttatgtaatgggaaaggatgaaaacccacatgtaggatgagagttggccttgagcctttagcgttcccgtagtttcttttatttatttatttatttattttgagatggagtctcactgtcgtccaggttggagtgcagtggcgcgggcgcgatctcggctcactgcaggctccgcc

SEQ ID NO: 1682 - DNA, 300 bp, Homo sapiens
ttcttgaggagctgagccttcgctcctcagatcacaggctcacatgttgaagctggcagtgctagagactagttcctatctgtgtgacagcatttttaatttaacaggaccgcctttgatgttcccaaatatttataggcagctttagatcatttcagtgtgtgctttctttttcttctctctctctctctctcttttaactggagcaaaagttcttcctcatgcaacagccttccttttatcctgtttagtttatttttgtttcctttgcagctttggcgaaggctgtctggctgcatt

SEQ ID NO: 1683 - DNA, 300 bp, Homo sapiens
tgaagccaggaaagggggtgggctagggggtgctgttttaggtagagtgatgggaacagccccactgagcatactttagccacatgagtagctggaagaaaagccttctaggaccagggaacagcaagtgcaacagccctgagacaggatgggcttgtcagtttgaggagcagtgggaggcctgaaccaggttacatggggcccagccagtatggccacgactttgtgttttatccagagtacaaaggagcctcactgagggacaagggaagtggcatgatgtgacccgcatattaagag

SEQ ID NO: 1684 - DNA, 300 bp, Homo sapiens
gcggagaagaggggtagtggttggaaggaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacatggcgccatgagccagcctctcaggaaaagggtctcatgaacaaatgaggaaagcaagtagaggtagggcagggagggagaggcaaaggaat

SEQ ID NO: 1685 - DNA, 300 bp, Homo sapiens
  misc_feature (1)...(300): n = A,T,C or G
agcagtatagccacagcaccaacgaatgaggaagagcaaaatactgcatgacagctttgctaagaattctttcactttttttgtctatcagccaggagctagcaacttggcttatttggaaattttaagtgtacatatcctggctccttaaatcctttacagatttaaagtgcagtcagtggagggcgagtggtttcggaaaaaaaaaagaaaaaaagaaaaaaaaagaaaaaaaaaagattttttctttctntnaancggantcgnnatggggttggatnntttcaangggggggttaa

SEQ ID NO: 1686 - DNA, 300 bp, Homo sapiens
cccaaccccaggtgtgccgcgtgctgcccctgagagccctgccccgcgctgtgaccccggagatgcgcgccctggtggtagactggctggtccaggtgcacgtaggagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgagcccgccttcctctgcctcctgagcgcggactccttctca

SEQ ID NO: 1687 - DNA, 300 bp, Homo sapiens
ccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgt

SEQ ID NO: 1688 - DNA, 300 bp, Homo sapiens
agttttggatgagacttggtatggtccattctgggacaaaattcctctctctctctctctgcggacccgtgaaatctagaaaataagttatttgcttctaaaatacagtgatgggacagacataggatagacattcccatttcaaaagtgagaaattgggccaggtgcagtggctcacacctgtaaccccagcacctgtaatcctagctccccaggcggctgaggcaggaggattgcttgagcctgggagatcaaggttgtagtgagccatgattgcgccacctttattggaaactttta

SEQ ID NO: 1689 - DNA, 300 bp, Homo sapiens
ggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaatcaccacaaaacgatgggctgacagttactagagggttagtaacttatctttaaaagggccaggtagtaaatattttaggctttgtggccaaaagtc

SEQ ID NO: 1690 - DNA, 300 bp, Homo sapiens
acatacagtttattattcacacactgggggagggtgatgaataatgattatttaatgagccctcttcctagttttccctaagtctgcagaagacaaagatcctgtttccaggccatgaaaggactgaagtaaatattgtaaataagtacagctgacccttgaacaacatggaggttaggggttcagttgaaaatctgcatgtaagtggacctgtgcagtccaaacctgtgtttaactgctgaattaaaggtgcttccttctgctcattgatattacccatatttacaaacatgctagaga

SEQ ID NO: 1691 - DNA, 300 bp, Homo sapiens
caaatattaaatattcaatgaatgatagctgcctctacttctccttttgttgtttttattttccatttatgtagtcatttatttattttaatgtcttcgaaagtattgactttaacaagtactttgtgatgcatttattatttcatttgttattatttatgtatttgatttatttctttgtgaggtaggatagaatctcagtcagatttttgctgttaggataccacagactggataactacaaagaagggaagtctgtttaactcgcaattctagaggctggcgcatctaagagcatga

SEQ ID NO: 1692 - DNA, 300 bp, Homo sapiens
ctgtgttctctcaatgacagagaaatcactgtggtgctatgttggtggaacttgctaggaactcccctctatggtgctcaggaaagctgttcgttgagagatatctctctacagtaactctactatgaaaccacccaaggtgagggtaaggatgctgctgcttagaaagagatgcagacaaatgtactaatgaaggctcaacacagctctttcaaggcaagacaggtcaagaggacaaaaagtaaaagtatgaaaggctttaagaaatcaggtagatcgtaggtgtatgtgtgtgtgtgt

SEQ ID NO: 1693 - DNA, 300 bp, Homo sapiens
gagaggtaatgcttcattttgcatagttgggaatcaagataatctgtttttaataatacaagaaacaaaagcataactatattatttatattacaaaagcaatctttagaaaaactaaaaggggtatataagtattgagaggagaggaaaaggaatgatatggtatcatgaggtaatttttgatcaattatagtaggaaatagacaatatctaaaatggataaagggaaaatggcaatattatctttttattttatattattttaattttttaagacaagtgctcgctctgtcgcccatg

SEQ ID NO: 1694 - DNA, 283 bp, Homo sapiens
  misc_feature (1)...(283): n = A,T,C or G
aagtgactcaggttacttccagatggtgaggactttctgaagctgtcgcccttacaggccatgacttttctctagcactgtccagattgcaggtgtctttcctgatgcgatatggggctatcccttaccccaattcttatttcacggagaaaagaaaagcaattttttttttttttnnaaacanagtctnattttgtcnccnggntaaaggncagggncannatntnggttaanngnancntnngcnttnggggttaangcnattttcnngcntaancctccc

SEQ ID NO: 1695 - DNA, 300 bp, Homo sapiens
ggccactccgcctcttccctcccttcgtcccttcttcctctcccttttttccttcttccttcccctcctcgccgccaccgcccaggaccgccggccgggggacgagctcggagcagcagccaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcct

SEQ ID NO: 1696 - DNA, 300 bp, Homo sapiens
caattacaaaaatggcagcaggagattaattatgagatctacactgaaatgacttaacctaaaattaatgtgttggcagtttgcaatatgttaaattttggcattatctctcttttggcaatataaaaatctttttttaaaaaacatgacatttgaattgaacatgtgcagaacccctgaagtatgtctgagaaaccctaggttctgtggcatatgagatgaaaaccactgacaaagagaaccagatattacatatgttcactgcattttcacatcaagaaggcttgggaaaagggctag

SEQ ID NO: 1697 - DNA, 300 bp, Homo sapiens
cagttttgctgtacctcttgaaagttaaagagacatctcagcactttaggaggccgaggcgggtggatcacttgaggaataaccaggccatacggagttaggagctgaagggacacgatgagaagtgaccagaaggtaagagtgtgagccctctgtcacgcccagataagcgcaactagaggactccttggtctagtggtaacgccagtgcctgggaaggcacctgttacttaagcgggaaagggaatctccttttccctggaggaattagagaacactctgctccaccacttcttgtgg

SEQ ID NO: 1698 - DNA, 300 bp, Homo sapiens
gcttcttgtgttggaggaaacttcagatacttcatttactccagagtgcccagagattccccagtcggaaaggatagactgcacacctgaccaggaggtgaccgaggatatctgcagatggcaatataagtgctgctggtcgcctgtggcagatgccaatgtccctaggtgcttcttcccctggaactggggctatgaagccagcaatggccatacaaatacaagcacaggatttactgcccagttgaaaaggttgccatcaccatctctgtttggaaatgatgtcgccaccaccctttt

SEQ ID NO: 1699 - DNA, 300 bp, Homo sapiens
gccatacttcctgccttccaggaacagggacaccagtgtgactggagcacagtgagcagtggggtcggaccggacaccgtcgccaggtcctgtggggccttgttgctattgcaagggcttcggtttggactgagagtgagcagagaagcctgttagagagtttcaaataaagatgggacatgatctggctgatgttcttggaggacatgctgctgctgtgtctcatgagaatagactgaagcggggaagagtggaagtaggaaaaccagttgggaggctgttgtaacctaggtgagtgag

SEQ ID NO: 1700 - DNA, 300 bp, Homo sapiens
gatggacagtggcactcggtggcagtcaccataaaacagagactgctttggtgtgaccgacgttgaggtcccacctgccccactgtccatagaggccgtgacctttcctgcctccaggtaaacacataagtgcttcccgggctgacttccgatgtgtattaggatcccagtgagacttcttgggcggatgctgaaaacaagcttaaattctggccccaacaatacagagtgagccaagacgacatgacctccttcttcagagaaataaatgcctttctccaaagcctctagaactatagt

SEQ ID NO: 1701 - DNA, 300 bp, Homo sapiens
ggcattcacattttaatattccttggatgaacatggcatcatatgattagaaaaccaaaattcatttttgatggctgttgtggtcagatcgtgtcctctaaaattttatgtgctggaaacttaatttctagtgtcaacagtgccgagaggtaggggctttgggaaagtttaatggattaatgcccacatataagggcttgttggagggaatttgggctctttgttgccccttccatcctttctaccatgtgaggacgccacactcctcccctttggaagatgcagcaaacaaggtgccat

SEQ ID NO: 1702 - DNA, 300 bp, Homo sapiens
ctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtc

SEQ ID NO: 1703 - DNA, 300 bp, Homo sapiens
ggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttcttctccttttgctgattttttgacacatcattctaagcaaaatcatctcagcttcgtatatttcagcctgaagtacttcttaccaaagttgtttcatgtaacatttgttcaatatgttcgtgacatgtctctcagtaatgaa

SEQ ID NO: 1704 - DNA, 287 bp, Homo sapiens
  misc_feature (1)...(287): n = A,T,C or G
tgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtannnnnctgacctaaaggttttagattcnc

SEQ ID NO: 1705 - DNA, 300 bp, Homo sapiens
gggatcaagtccatcaggtcccaggaaaggcgtgaatgggagtctgaaggggagaaatggaactgcaaataattatttggaattatttatttatttatttatttatttatttattttttgagactccatctcaaataaataaattaaaaaaaactgctccaaacaaaaagatataacttactttagtgcataattctaaacggtgtttttgctataaagggcatcattgggataaatggtgaaacttgaatgggatctgagaattacatttaacttttctgtaactttgtgcttatttca

SEQ ID NO: 1706 - DNA, 300 bp, Homo sapiens
gtcagaggtcaacaatgagtatgtggcaataacaggattcaaacccagatctgttagcttccaaagtccttggtcttacatgctacccactagttccttggagggggctccggaccatggaggtcacacaccagtgctccgagtgtggtcctcacagcacctgcatcaacatgaggttgggatttgattaaaagtggatttctggggccacccacattctgaatctaaagttctgggtgtggttttaggaacctgtgcttttaacaagtacccttagtgatttatatacttactaaacac

SEQ ID NO: 1707 - DNA, 300 bp, Homo sapiens
gagcagtaaggtcaatttctagtctgctcttgtttccgacttgtgaaaataagctgttaatttacattgtccaggtgagggagaccacctggggagacagctgtttagaaacaaaaggaaagatggtttttgtttgtgtggctcagtttcaaagcttaattttccctttttttgtagtgagtttgtgatcccaagattttattttccttttacaatcacatggaatggcacccatttatttagaattgtttctctactgtctcctcacctgctggagactgtgagcagctttatggctct

SEQ ID NO: 1708 - DNA, 296 bp, Homo sapiens
attacaacaatatggatagtagggaggaggaaaacaagaggagaatgggatcaacagaaggcatatatggggagtgtctggatggctggaaaattccattttttgaccaagatgtggtaaacacggggagtaaagttataattttttctcttactgtgcttttaggttttgttgctttctgtctgtatgctgtgttccacaataataaaaatatttaaaaggcaaaaaaaagtaaaataatgaatataaaattacactgaaactacatattctcatagatagaattgtaattatta

SEQ ID NO: 1709 - DNA, 226 bp, Homo sapiens
  misc_feature (1)...(226): n = A,T,C or G
gaaacactgaaatgtatacttttaagtgggtagattttatggattgtgaaatacagcacaaagctgagaaaaagggaacagaaaattatcaaagtcaaaccctacacaaagttattagaagagaaaaacactacagaaagacacgctcaaaaaaacagaacaaatctgaaacatggtaagacccctctccacaaaaaananaaaaaaaaaangntttaaaaaacnt

SEQ ID NO: 1710 - DNA, 300 bp, Homo sapiens
agcctctgatcatcaagacatggcagaatacaaagacaagtcacaggctagctgaagatatttgcaatacataaatccagcaaagacttatatccagagtatataaagaagttctgtaaatcagtgagaaaaaagacaaaccccccaattaagaatagtcaaaagatttgaacaggcacttgacaaaaggggggtattgaaatggccaataaacacataatcattacttatcacagaaaagcaaattaaaaacagaaagagataccacaacctcctccccagaatgtctatatggaaaca

SEQ ID NO: 1711 - DNA, 300 bp, Homo sapiens
gaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttat

SEQ ID NO: 1712 - DNA, 300 bp, Homo sapiens
ctaaaagaaaatttatattctaatttttatttgttgcctatgtttcataatttttaatctaaggtctttttagaaatgtttgttagtccaaatgagtgctcacaatatggtaaacacatgggagatttctttttttttaaattttatttccatacgttattggggatcaggtggtgtttggttacatgagtaagttctttagtggtgatttgtgagattttggtgcacccatcacctgaacagtatatactgcactccagcctgggcaacagagcagactccatctcaaaacaaacacac

SEQ ID NO: 1713 - DNA, 300 bp, Homo sapiens; identical to SEQ ID NO: 520

SEQ ID NO: 1714 - DNA, 300 bp, Homo sapiens
cccttctgagcctgtccattcatcggtggttctgcccctactcccccagccctaaataccccagctgctgttcctccccatcacccagccaccggattctccattcacccctttctctcacccctggagccccgtgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggt

SEQ ID NO: 1715 - DNA, 300 bp, Homo sapiens
atgaccttctgcctgttctatctctgaggacagttgtgattggatttagggcccatccagttagtccaggatgatctcatctcaagatcctaaatctgattacaattgcaaagatcctttttccaaataaggtcacatgcacgtaagttccggggattatgcttgcgtgggacacatcttttttgaggccaccattcaacccactacaaaatccaactgaagcccagcgaagtggctcatgcctgaaatccccgcactgtgcgaggccaaggcaggagggtcacctgaggccaggagttc

SEQ ID NO: 1716 - DNA, 300 bp, Homo sapiens
ggagatttcaacttaacttgaccactgcactccagcctgggtgacagagcagagcaagactgtgtctcaaataaataagtaagtaagtaagtaaatatcctgtaggtatctatgtgactcaaggctagtcactttcctatctatgctccagttttctcatatttgagacaagagacttgattttagcataaaggtgagagttgaagtaatgagtgtgaaagaggaaagggagaaaacatacagagaagagcagaaaacacaagcagctggtaggcagagaatgcagaaattcaagttaga

SEQ ID NO: 1717 - DNA, 300 bp, Homo sapiens
cagagttttgagcagagaagtgacactatcagacttaagcattaaaagaattgtccaatgaatggctgtgctgaaaatatatttgaggtaaagtaagctagaggcaggggtattgaaatcaggctaagagatgtttgtggtttgaattaagtggtagcaggaggtgttaagaattagtcacattgtgtatgtattttgaaggtacaaccaacaggatttccaggcaagatagagtgtgatgtgaaaaagaaagaaaggagtcagtagtgactcaggagtttgtctgagcatccgaagtgt

SEQ ID NO: 1718 - DNA, 300 bp, Homo sapiens
ctgagacctcgtctctataaaaacaaaacaacaaaacataaacaacaacaacaaataactatgtgataagcattgggttaggcactagaaaatagtgctcaaacaacaacaacaacaacaaaacatgattcttgtctcaaagaatgcacaatgttggggaaagacaactaaaaagtaataaaacataaagtttgaaggatattatgatagaggaattataggatacgttcaatcatttgaaatttttgaatgtcatccttttgggtggagcaccgagagggtttgtgaaaaagcttcccc

SEQ ID NO: 1719 - DNA, 300 bp, Homo sapiens
gagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggaga

SEQ ID NO: 1720 - DNA, 300 bp, Homo sapiens
ggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggtgggtattttagacttcattctcctagctgtgaattaagggtaaa

SEQ ID NO: 1721 - DNA, 300 bp, Homo sapiens
gcacaagccactgtgcccggccaatactgcaaaatattttaaaaagttaaaattatctcttctggctggtcatagtggctcacacttttaatcccagcacactgggaagctcagtcagaaggattccttgaggccaggagttcaagatcagtctgggcaacacagaccccatatctccaaaaaaataaaaataaataaataaaacagttatcaggctgggagtggtggctcatgcctgtaatcccaccactttgggaggctgaggcaggcagatcatgaggtcaagagatcaagaccagc

SEQ ID NO: 1722 - DNA, 276 bp, Homo sapiens
  misc_feature (1)...(276): n = A,T,C or G
ggaactccaggcttgccactacccaaccccagcctggctctgaaaatgttaattgactgtcaggacggcttggtggggcgggggcgaggttgcagtgagtgagccaagatcacaccactgcactccagcctggtgacagttcgagattctgtctaaaaaaaaaaaaaaaaanntnggncctttaaanctntagggngncnnnttacgtaaatccanacntgataananncnttgatnagtttggacaanccacaantaagaangcntngaaaaaaa

SEQ ID NO: 1723 - DNA, 300 bp, Homo sapiens
acagagcgagactccagttcaaaaaaataaataaaaattaaaaaataaaataaaataaaaaatttactaggcatccagcattcattaaggagaataattcagttaaggaggaaaagaattctgggattctgggaatttccttaaccaataaagagtatgtgtgagaaacctactgctaacatcatacttaatggtaaaagtccaaagatcagcaaaaagaggatacctggtctaaacacttccactaagcattatactggaagttctagctagtgcaataaatgaaagagtacaaagtat

SEQ ID NO: 1724 - DNA, 300 bp, Homo sapiens
ggaagggaggtttaaggaagagactgtggacagaggtgttagggaaggtgtcagagaaggttaaggagccaacatggatcatgggggtggtacagtgttgccagggctggggaggattggctgcagtgtggggtacccagccgctgccatgtggagagggacctgtcactcctgctgtgaactctcccttcttctgccctctgacctcctgctggtgcctcccattggctaaacacagttgatggccagtgcactggggagctgttcttggagcccacaggcatctgcttcttggcacag

SEQ ID NO: 1725 - DNA, 300 bp, Homo sapiens
ggtgattgggctggttctgtaccgggtgtactccgtggggggccgtgatctggcaaagccttggaggtgggactgtggaggcaccattgattgaactgtgtcccctgcagttcacatgttgaggcccaaacccccagtgtggctgcatttggagtagggcagtaattatggttaaatgaggtcgtatgggcgggtgctgatccactaggattaggatccttataagaacctgccaccttctctctgccacgtgaggacatgggtagaaggcggctgtctcccacccaggaggagccctta

SEQ ID NO: 1726 - DNA, 300 bp, Homo sapiens
caaagctgttttataaattagggagaagagtgaggagagaggaataggatagacgaaggtagagagagggagcagtggagaagaaaacctcagagtgaggcaaaggaagaggtgtgaaggggaaaagaagtggcgatggcagggaagagcccctggccatgagagagactggggggagtgggaaggaagggaagttatggggcagggggcacagagcagagaacaagagagtaaggctagagagatgaaagaaacagtgagactgagctaagaagagcgatctcacgcttaagagacaga

SEQ ID NO: 1727 - DNA, 300 bp, Homo sapiens
  misc_feature (1)...(300): n = A,T,C or G
cccctctccacattgacctctagagtggcctgtccaactcctaagtccaaccttcccacaccggacagaaagctttttactggccccgttgctcccgggtgaggcctaaacacttgatgatgatgaagatgaagatgtgatgatggtagccatcacacagctctcccatgtaaccctcacgacaaccctgcaaggcaaatagcatcaccatccttatttggcaaatgaaaagctgatggctcagagaaggtaaatgacttgcccaangngactgagccagtattgccacanacaggctcc

SEQ ID NO: 1728 - DNA, 300 bp, Homo sapiens
ctccattgtgaagatccaggcatttttccgagccaggaaagcccaagatgactacaggatattagtgcatgcaccccaccctcctctcagtgtggtacgcagatttgcccatctcttgaatcaaagccagcaagacttctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctg

SEQ ID NO: 1729 - DNA, 300 bp, Homo sapiens
gatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaaga

SEQ ID NO: 1730 - DNA, 271 bp, Homo sapiens
  misc_feature (1)...(271): n = A,T,C or G
agacaatcccaaatatttggagattgtcttaactggtttagtgtagctataaaagaatacatgaagctggataatttatgaagaaaagaggtttatttggctcacagttctataggctatacgagatgcatcatgccaccattttcctggagcccttcaggaagcttccactcatggcagaaggtgaagggcagccagcatgttcagtgatcacgtggtgagagggaaggcaagagaganaanagggaggggncacgctctattnagtacc

SEQ ID NO: 1731 - DNA, 300 bp, Homo sapiens
cagttcacagtattaccctcagtgcaccagaattcctttctatccatatactcaccagcacttgttactgaactctagtttttgccaatttgatgggtgtgaaatggcatcttattgtgatttttaatttttctcattacttacaaagttcatcatgtctcctagccctttgggtttcctgttcaatgtcaatttcctatttatgtattggcccacataaaaaatattgcatagtctattttaaaatgatttataggggctctttacatattctgggtactaattattccttatgtgtga

SEQ ID NO: 1732 - DNA, 295 bp, Homo sapiens
  misc_feature (1)...(295): n = A,T,C or G
ctggacgcctntaatgcganaanngnccccngtttaacagaccngcaaatccgggngcggaacangacccnngggtttcctnttgntccctngttngggggcggtggntggggctgtncggccaannangganttgntttttttangntttaaaanangattttaaaantcannnnnnngtttttttttntttttttttttttttaattctgaaacagacctgttttgtaccgagttatttttgggataaattttactggttgctgttgtggagaaggtggcgtttccacctttt

SEQ ID NO: 1733 - DNA, 300 bp, Homo sapiens
atggggtatagatggttttccccctgtgtactctagtaaatttctatgccatttctcctatcgatctgccttttgtcagttgatttttcagcttaacttcagagagcaaaggggaaggtggccaagtgcagtgtctcatgcctgtaatcccagcactgtgggaagctgaggcaggcagatcacttgaagtcaggagttcaagaccagcctggccaacatggtgaaaccctatctttactataaagaaaaataagtcgagtgtggtggtgcacacttgtaatcccagctactcaggaggct

SEQ ID NO: 1734 - DNA, 300 bp, Homo sapiens
gggggttcccaatagtagaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatacacatgcacacacacatacacacactggcccctgtttttctgtggtg

SEQ ID NO: 1735 - DNA, 300 bp, Homo sapiens
gcttgatcgtctgggcctgtgtttcagctgggataggattctcaatccttcttgttcaaatccgaagtccagaaagctctgaaaactgaaagttttttcataatttatttcactgtaaaacctgaattgaactgatatttatctcactaaaaatgattattcatatattttactgtaagaatagtaaaattaccaagtaatatcccagacctagttagataaatgcactattttcttttaatttcaaaacaatcttaattctgaggcacatttggctgacagcatttcagataagggatt

SEQ ID NO: 1736 - DNA, 300 bp, Homo sapiens
tcctattttacgtggttgttgagaggatccgatggaatgactagctgaaagtgtttgtaaaagtcaggataagtaaagcaatgctgcaggaacaaacaatccccaaatttcagcagcttactacaaaaaaatatgtatttctcactcatgttcatgtccaatgtgtgttagcaaggagatactgtctctcacagtcatgcaagaccccttgctggggaagctgcacctccatatatgcttctaccatcaccagggcagaggagagggagcatggtggatcatacactggctcttaagact

SEQ ID NO: 1737 - DNA, 300 bp, Homo sapiens
atttcctgaggtctccccagccaggctgaactgtgagtcaattaaacctctttccccaataaattacccagtctcgggcatgtctttattagcagtgtgagaatggactaatacaagtaccattaataaatttcacaacgtagattaaatgtgcaaattccttgaaagacacaaattaaaaaatgacctgagaagaaaagaaacttgaatagatctgtatctattaaagaagttgaaattataattagaaaccttttgaacattagaactccaggccccttgttgtgaattctatcgaac

SEQ ID NO: 1738 - DNA, 300 bp, Homo sapiens
gcctgtagtcccagctatctgggaggctgaggtgggaggatcatctgagcccagtagattgaggttgcaatgaatcatgattgtaccactatactccaacctggacaacagagcgagaccctgtcgcaaacaaacaaacaaataaataacctgggcaacagagcgagatcctgtctcaaataaataaacaaacaaaagtagcagattagctgggcgtggtgttgcatacctatagtcccagctgcttgggaggctgaggcagaggatcacttaaacccaagaggatacagtgagccatgt

SEQ ID NO: 1739 - DNA, 300 bp, Homo sapiens
gtttaagtcttgtagctgtatagcattccattgtataacttataatttatttatgggttgtactattgatgaacatttgagtagtcttcagtttggaactaccacatatggtgctgttatgaatacttttgcacaggtatgtgaacacatgtacacattgcagttggtatatatacagtactgaattactggcttataaatatcattaaattttaaaaacaaaattaattgccacaagcatattattgtatctttgaattttaaaccaaattaaaaattctatgagttgttgaatattat

SEQ ID NO: 1740 - DNA, 300 bp, Homo sapiens
taaatgttgaaattaactagacaaagtagttgaagtcctgatgaaaagattgttcagttcttcttctcctgtagctcagaacctgtttggatcatacatttaaatgtagaaatataaagcttttagaagaaaacataggtgaaaacctacaagacaaaacttggtgaagagtttctccatgtgatgcaaaaacatgatccatagaagaaagaaatctgtaaattggactttatcataattaaaaacatttgctttgcaaaatgccctgttaagatgatgaaaaaacaaactacatactgg

SEQ ID NO: 1741 - DNA, 300 bp, Homo sapiens
caaataggagatgggttttttttcgggggggagggaaggaacagctttgcattaacaactactgagaattatacatttaaagattatcttcaatgtccaataacccttatattcaatactgaatttatttccacttctcgccttcatttttatttgttacgtattctcaaagttctctcctagtagaagaatgaaccagaaatgaacataagcatgtcggaattcacgtatgtggcagactgtattttccaaagatggccacaacaatatttctcattccacatggtctgctggaacctt

SEQ ID NO: 1742 - DNA, 300 bp, Homo sapiens
  misc_feature (1)...(300): n = A,T,C or G
aattcacgaggtggaaataggaaaagctagatgtgagcagccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccanagtgtgctggtcaccaa

SEQ ID NO: 1743 - DNA, 300 bp, Homo sapiens
gaagagctgaagagaggaggtggcaggactaactaaaagtgggacagtcacttgttatagtgaaggtagaatggacagaattgggcaactaattaagagggagaaccctctaggagaacaggagaacgcatccaaacctggaaaaccaggaagagaagatccttggtgagaagcagtcaatgagtttgctttgggatatgttgagttcccaaactcatcatgaggtgaggcttccaggtagcaaatgaatcacttgagaccaggagttgaggagcagcctggacaacatagcaagacccc

SEQ ID NO: 1744 - DNA, 300 bp, Homo sapiens
caaaaagttaaaattttatttttctctcatgtaacattttggataatttgatgattccctaatgttgggacccagtcttttctgtcttaggctcacaactatccttgagcctgtgtcatgggggatgactctgaagctgcgtgcaccctgttcattcacattttcttggcctgaacttagtcactaggctattcctaactgcaagagaagctggaagatgtagtcttccttctgaccagccatgtgctcaaccacaaattgagtttcagttattggagggcagaaagaatagatatgggg

SEQ ID NO: 1745 - DNA, 300 bp, Homo sapiens
aagtctcactctcatttgtgctttctccatcccatttcccttccccttttaggcaaccattttagctgacttcttgtttatcttgccagtgctccttcatgcaaatatgggcatatattctttcttcccccactttcttgcataaaaggtagtgtatcatgtatatactgttctgcaccttgatttttttcacttgacatgtcttagaaatctttccttatcagtgtttatagaccatcctcattctgttgcatagcaaaggtgattatattcctgttacctttggggttatggcccatc

SEQ ID NO: 1746 - DNA, 183 bp, Homo sapiens
ctactgagcctggcttgcaactggggtgagctccaccttgaacgtcgatcctcctgcctggtggagccatcccagctgatgccacatgaagcagacacaagctgtccctactaagctctgctcaagttggatattcatgagtgaaataaatgactgttactaagtaaaaaaaaaaaaaaaaaa

SEQ ID NO: 1747 - DNA, 300 bp, Homo sapiens
gagaaacactcagggcctgaaccaaggaattaactgtgattggagaggagaggcagcagccacagaaggcacaaagaaggtggaatcacccaaacatttgtcagattgaggggtgagggggcatgagaactccaagattacactcaggtttctgtctttggtgcctttaaaaattttaaccaaagttgagaatttactgtatgctggggactctataagaggctttatctttattatgtctgttaatccttgcaacagccctgtgagaggtatttttgccctcatttgatggatacctga

SEQ ID NO: 1748 - DNA, 300 bp, Homo sapiens
atatgcacattgtaccaatggcagacttttggctttgatattgttctataattatgtaagatgttaccattatgggaaactggaggaagggcatatgggacttctttgtactgctttttctattccctgtgagtttataattattttataataaaagttcaaaaacacttattggatggacatcacagaacataatagaagaaagaatcagtgaattataggtctgtttaatagaaatgactcaaactgacacacaaagcaaaaagaatgaagaaaacagaacacagtgtctgagacttt

SEQ ID NO: 1749 - DNA, 300 bp, Homo sapiens
cctgcctcccattctatgcaaagtcatccctccgggcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcat

SEQ ID NO: 1750 - DNA, 300 bp, Homo sapiens
ggaatacttcccaactcattttatgaggccagcataactcgtatcaaaacctgacaaagtcattacaagaaaagaaaattacagaacaatattgttagtgaataaagaagcaaaaatcctcaacaaaacattaacaagtgaagtaaacaatatataaaaggataatactgcatgaccaagtgggtgtggttaataatttcaggaactcaacatcagtttaacatttaaaaaaatcaacataatattattaataaaataaaggagaacaataatatgatcatctcagtgtgtaaaataaaa

SEQ ID NO: 1751 - DNA, 300 bp, Homo sapiens
ctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgac

SEQ ID NO: 1752 - DNA, 300 bp, Homo sapiens
gttaaaagaataaaaaagaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaa

SEQ ID NO: 1753 - DNA, 295 bp, Homo sapiens
gcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgtgg

SEQ ID NO: 1754 - DNA, 300 bp, Homo sapiens
gaagagaactatctaaatgagtaatggtcaagaaattttaaagcataatgacatgaaacaaacaaccggtccaggaagctcagagaatacaattcatgacaaacaacaaaaatacagcaccagacatagcatttcctatatgtagaataaaagaaaataaaataaatcaataaatagacaaagagaaaatcttgacagaatctggaatgaaaactacattccttgtagagaaaaaagagcaaggatttcagcccacttccagtaagaaaccaggcaagaaagaagagagttgcgggaaat

SEQ ID NO: 1755 - DNA, 300 bp, Homo sapiens
aataattatgctgaatgaaagaagccagacagcaaaaatttcctactgagtgattccatttatataaaaatctagagaatgccaattagcctttagtgaaataaagcagaacagtaattgcctgtgacagggtgggaaagatttggactggaagcagggattaccaagaggggtgagaaaacttttgaaggtgatgaatatgtacattgtcttcattgctttgatggttttacaggtgtatatgtaattcaaaatgatcaaattatacactttaaatatgttcagtttattttatagaat

SEQ ID NO: 1756 - DNA, 294 bp, Homo sapiens
  misc_feature (1)...(294): n = A,T,C or G
atatgctgaggtcctggcctccagtacctcagaatgtgactgtatttggagatggagatacagccttcaaagaggtgagtaagttaaactgaggttgttaagatgggcccgcaaccaatctcaccggcatccttagaagaaaaggagttggagacacagagagagaggctagacacaggcacacgtgaagggacggtcaggggaagcggcagcgagagggtgctgtctacagccacagagaggcccctgangagaccaacgctgccggnaccatgatactggactganttaccg

SEQ ID NO: 1757 - DNA, 300 bp, Homo sapiens
tgattctggaacagagtgcacaccaggagaatctaagaatttgggtcaaaaagaaaatggcaattacatcatattctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttg

SEQ ID NO: 1758 - DNA, 300 bp, Homo sapiens
ccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcc

SEQ ID NO: 1759 - DNA, 300 bp, Homo sapiens
cccatgtcccgcccgctcgtctgcctggctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttga

SEQ ID NO: 1760 - DNA, 300 bp, Homo sapiens; identical to SEQ ID NO: 548

SEQ ID NO: 1761 - DNA, 300 bp, Homo sapiens
ctaaggaaagggcctagggccaaggcaggctaaatgccactcgggtctttgttattgggcttttattattctgttggtctgttccaccaccccagtggatgttaataggccaaattttgtaaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctg

SEQ ID NO: 1762 - DNA, 300 bp, Homo sapiens
ggaagtacaaattaagatcacagtgagataccattatccacttgtcacaatggctaaaataaacaatagtggcaataccaagtcctgtgaaggatgtggagaaatggatcacttatacactgctggtgggcatgtaaaatggtacaaccagtctgaaaagcagtttggcagtttcttataaaagtaaacatgtaattatatgctgtggtctgaatgtcctccaaaaatttatatgttgacacccaaaccctcaaggtgatggttttaggagggtaggccctttgggagattagtttctga

SEQ ID NO: 1763 - DNA, 300 bp, Homo sapiens
gctcaaacaatctgcccacctcgtcctcccaagatgctgggattacagtcatgagccactgcagccagcctacatttttaaatggttggaaaatcaaaagattatttgatgacatgtgaaaatggtataaaactgtgaaatctattgtccataagtaaagttttctttgaacacatccatgctcactcgttaacttattttccatggctgctttcatgctgcaatcttgtccctgcccttaaagagctaagggtctagtagagaggcagtaatggtgtgagataatggctaaatggaagc

SEQ ID NO: 1764 - DNA, 94 bp, Homo sapiens
  misc_feature (1)...(94): n = A,T,C or G
cccctccagcccccaaacatagcttcaaaaccttccttgctatttgttcttnggnnggggggnntttttaataatcgctnncncgnccccnnac

SEQ ID NO: 1765 - DNA, 300 bp, Homo sapiens
agaaggcaggaatgtcaggcctctgagcccaagccaagccatcgcatcccctgtgacttgcatgtatacgctcagatggccagaagtaactgaagaatcacaaaagaagtgaaaaggccctgccccgccttaactgatgacattccaccattgtgatttgttcctgccccaccttaactgagtgattaaccctgtgaattaccttctcctggctcaaaagctcccccactgagcaccttgtgacccccgcccctgcccaccagagaacaaccccctttgactaattttccattaccttcc

SEQ ID NO: 1766 - DNA, 300 bp, Homo sapiens
gacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcat

SEQ ID NO: 1767 - DNA, 300 bp, Homo sapiens
gagaactccaaatagcccaagagggtggtgcacccccaacttcataagggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaa

SEQ ID NO: 1768 - DNA, 300 bp, Homo sapiens
ccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactact

SEQ ID NO: 1769 - DNA, 300 bp, Homo sapiens
agagaactagtctcgagtttttgacagataatagccaccctaggaggtgtgaagtggtatctcattgtggttttccatttttctgatgactgagaatgttgagcatctttccctgcgtgttgtccatttgtgtatcttctttagagaaatatctgcttacgtcctttgcccagttttaattggattgtctttctgttgctgagttgtcggaattggttgtacatcctccatactgagtcctcatcagatacctgatttgcgaatattttcttccataccatgagttatcttttcactttc

SEQ ID NO: 1770 - DNA, 300 bp, Homo sapiens
ctagaattctgttactgtcaaaaacgttttcaaaaatgaaggcaaaataaagactgtttctgagaaactaaatcaaaggtaattttattacctgtagacctgtctttgggaaacattaaaggatgtttgagggcagcaggaaaataatacaaaacttaagtttgggtctgtacaaagaaaatcagcttttctaagatcaagccagagttgcttctcttacaaccttacggcgctaatgcattaagttgaagtcgactgccaaagaggcccagcagagggcagcacccccatcattttttt

SEQ ID NO: 1771 - DNA, 300 bp, Homo sapiens
gcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctgg

SEQ ID NO: 1772 - DNA, 300 bp, Homo sapiens
gtttagggtcagatccatgtatttgtagcttggaggtgagcccaggggttcatacacaactttgctccctactgtctgtgatccctctgccactttctggttccttggagctccctttcatgatcctcctgtcagaataccagggctttaatttgcccactctctgccatgcacttctcatgactgcatctgcatccagggccaagcggtaggaggacagagggagcctaaataaacaataggatttgtttcacagtcttgaagctacagcttctctggtcagagaaaagaattcaaagc

SEQ ID NO: 1773 - DNA, 288 bp, Homo sapiens
taattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgcttt

SEQ ID NO: 1774 - DNA, 300 bp, Homo sapiens
caacaaactaggaatagaggaaactatctcaacataatagaagttatatattaacaacccacagcagacgtcacattcaatggtaaaataccaaatgctcttcctctaagatccaggaacattacaaggatgcctaactttgccacttatattcaacatagtactggaagtcctaaacggagcaattaggcaagaaaaagaaataaaaggcatccaaattggaaaggaagaggtaaaattatctctgtagctgatgatgtgatcttattttaaatgctgtgatcctaaggataccaccaa

SEQ ID NO: 1775 - DNA, 300 bp, Homo sapiens
ctcctgccctccctggggtggttctgtcttttgcaaaggtggctgcatccttaggggaaggtgaggggagaagcagggagcatggagagaagtggctttcgattttctctctccttttggggagttcctccttatgtggctggtctggtgcatagtgtgatgtattcctgtacgcaacgttgccctgacagccagtccaagctgagtctagagctggcaaggtgagctcccagtagtaagagggtgtgggcggcaagccacccaggcaccgaggcaagagacagaggacacgagctgttc

SEQ ID NO: 1776 - DNA, 300 bp, Homo sapiens
cttgagagaatagatctagatgggtggggcacggttctggggaatggaagggccaaagaggaaagtgggcaatggtggggttgagaacgcagcttctggactcagcaggcctgggttcaaactctgttaatcactcctgttaatcccagcgctttgggaagccaaggagggaggatcacttgaggccaggagttcaagaccagcctgggcaacataatgagattccatctctacaaaaaataaaaacaattagccaggtgtggtggtgcacacctgtagttccaggtacttggaaggctg

SEQ ID NO: 1777 - DNA, 107 bp, Homo sapiens
  misc_feature (1)...(107): n = A,T,C or G
actttaaaccctacctgtgtgattcagtagggtttgagaattacgtgtgatactggggggnntgggngnnttnntngnnagnnngggggnnttnntcnttntttttg

SEQ ID NO: 1778 - DNA, 300 bp, Homo sapiens
catttcttgtctttattaatttgacttctctagggacctcatttaaatgaaatcatacagaatttgaacttttgtatctggataaaaaatatatacagcattttgctgactgtaaaatgtatttttttgggccgggtacggtggctcatgcctgtaatcccagcactttggtaggctgaggcaggtggatcacctgaggtcgggagtttgagaccagcctgaccaacatggagaaaccccgtctctactaaaaataaaaaattagccaggcgtggtggcacatgcctgtaatcccagata

SEQ ID NO: 1779 - DNA, 298 bp, Homo sapiens
  misc_feature (1)...(298): n = A,T,C or G
tttgggnatntgnggggtttttnntttttnttttnccnggtcngttanaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcaaagagattcttaaaagtatctgtgtgttgatcatcagttttacaaaaacacctatttggctgaaaggaataaaa

SEQ ID NO: 1780 - DNA, 300 bp, Homo sapiens
gatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtataggaaatcacatgtttattacccatgtatttgttgttggatgcttagtctgtttccatatctttctattgtaaatagtgccgcag

SEQ ID NO: 1781 - DNA, 300 bp, Homo sapiens
gaatggagttccacctgggctgttttattaactatttgcccctccgtttcttcatctggaaaacagaaatgataaccttactattaattgtgtgaccttggacaagttacaacatctccctgggcgcgattgtcccatctgaaggtcataatagcacctgccacagaggatggtagtaaggattaaattagttaatccatgtaaattacctaggtaagtgcctgccatatagcaagtgcttggtacttttttttaaaaatcactgttatgactattgcagacacctttgccatgattgga

SEQ ID NO: 1782 - DNA, 300 bp, Homo sapiens
gggggaaaatgacagaggaaaaagagaaaatggagcagaaaaaaatagtagaagaaataatagctaaaaaatttcagaattcagtgacaagtagaaatttacagatataagatcatatgctcaagaaacaccaataagaataaatatttaaaaatcccacgctggttcttgcaaacttttgaaaaccaaagttgaagagcaaatcttgaaagcaacaagagaaaagccatacagtaataatccagttaatggctgacttctcactggaaaccttgcagaccagaacggcatggaataaca

SEQ ID NO: 1783 - DNA, 300 bp, Homo sapiens
ggtggatgccatctttggcttcagcttcaagggcgatgttcgggaaccgttccacagcatcctgagtgtcctgaagggactcactgtgcccattgccagcatcgacattccctcaggtgctgggatccagaaggtggggtgggagagattggggccctaccctcctgactcttgcccacaccaggtctaaaataattttagtctagaggggcagaacacagctttctggacccccatcagggctggggaacagtgttcagaagtcccctttacatgttggccccatgaagagaccacggc

SEQ ID NO: 1784 - DNA, 299 bp, Homo sapiens
gacctcctgagggctgtgtcatgcgccatgatcagtcatatttggctcagaataaagctcttcaaatattttagagttcaactcttttcactgacaatagtaatgagattttaaaagatttttttaaaaaaggaactcaatggttaaaagtcagcttaattaaaagctaacatccaagatgtgtgtgtgtgtgtgtgtatgtgtgcatgtgtgtgcatgtgtgcatgtgtgtatttaaaagaccttcatgttttgttttgttttttttctctcccaggaccttgtctttttttttttag

SEQ ID NO: 1785 - DNA, 300 bp, Homo sapiens
aatacctgagactgggtaatttataaagaaaagaggtttaatgattcacagttcagcatggctgggaaggtctcaggaaacttataatcatggcagaaggtgaaggggaagcaaggcaccttcttcacaaggtggcaggaaggagaatgaacgcaggaggaactaccaaacacttataaaaccatcagatcttgtgagaactcactatcacgagaacagcatgggggaaatcacccccatgattcagtttcctctacctggtctctctttcaacatgtggggattatggggattataatc

SEQ ID NO: 1786 - DNA, 300 bp, Homo sapiens
tgaagactaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaataagaggggaaagatgtaaaagtcaaagaagatgaataagagagagaagatggaaaagaagatgaaggtggaaatga

SEQ ID NO: 1787 - DNA, 175 bp, Homo sapiens
  misc_feature (1)...(175): n = A,T,C or G
tctacttgtgtgtgtatgtgtgcacatgtgtgtatgtacaggtgtatgtatatatctatagatagatacaatacattctttagacacttttcaagattctttgctgtggtatattgtgctcaactcaggtgccaaaggagcttttttttttttttgnaaaggnattttnnnttng

SEQ ID NO: 1788 - DNA, 300 bp, Homo sapiens
gataatacttgtggatcttgatgctaaggagcctgctccttatgcatcaagaaacacataaccaggtacagaaactctgcagagtactcatgagtggcaggaggagctgtaccacaagaaggaagggctcagggaaggggacatgtcttactcacttgttagcttccacggatgggatgtggcagtgctcatgaaaggatcttggacaagtgtcgcagcagaacagccgtccccatttgttgcacacctcacatatatttgagttttccggctagaaggggagatgtagacatcaccggg

SEQ ID NO: 1789 - DNA, 300 bp, Homo sapiens
  misc_feature (1)...(300): n = A,T,C or G
tattactttattttattntattttattattatttttttttgggacagagtntnactctgtcacccaggctggagngcagaggccgnanctcggctcactacaagctntgcctcctgggttnacnccattntcctgcctcaacctcccgagtagctgggactacaggcgcctgccactgtgcccnnctaattttttgnatttttannanacacanggttncaccatattagccagganggtcncgatntcctgaccttgatnncngcccgnctcgacctnccaaagtgctgggattacagg

SEQ ID NO: 1790 - DNA, 300 bp, Homo sapiens
cggtgctggtgcggcgggggactgcggggccagcctcaggtagcagcagcagcagcagcagcagcagcagcagcagcagcagcagcagcaatgtttcacttcttcagaaagcctccggaatctaaaaagccctcagtaccagagacagaagcagatggattcgtccttttagaagcatctcagaggctctccagtgacgtgctgttaaaagtgctgaccctgggtcagaccctttgggttggcttcgtggctccacgacttactctctacccttggcagtggcgtgatctcggctcactg

SEQ ID NO: 1791 - DNA, 300 bp, Homo sapiens
cttgaaaatgctgcaaatgaccctctaatgatccctgaagatcaaaacaggggtaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcag

SEQ ID NO: 1792 - DNA, 300 bp, Homo sapiens
gcagcagctcccaggatgaactggttgcagtggctgctgctgctgcgggggcgctgagaggacacgagctctatgcctttccggctgctcatcccgctcggcctcctgtgtgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctg

SEQ ID NO: 1793 - DNA, 296 bp, Homo sapiens
  misc_feature (1)...(296): n = A,T,C or G
gtccattacaccgccagcagcaatgtcttcctcggccatggcagtgggtcacgggtgcagcagtgcaatgtcttcctcagccacggttgtgggtcatgggtgcagcagtgcaagaccttcctcagccatggcagtgggtcacaggtgtagcagtacaatgccttccttggctatggcggtgggtcacggacgcagctgaatcttgaacacacctgnncctctgcctccacctgactccgcggcggcaaggaatgaacacagttntctttttaaccaaaattttagatcatgatctt

SEQ ID NO: 1794 - DNA, 300 bp, Homo sapiens
ggaatgtcaggcctctgagcccaagccaagccatcgcatcccctgtgacttgcatgtatacgctcagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactaattttccattaccttcccaaatcct

SEQ ID NO: 1795 - DNA, 289 bp, Homo sapiens
  misc_feature (1)...(289): n = A,T,C or G
agttttcanttttggctgggcannatggtnagcgcctncagtnccannttcttgggagggtaagcccngttcaaggntgcagtnaantatnanggggccnctgcattccagcctgggtnacagaatnaaatcctggcncaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagac

SEQ ID NO: 1796 - DNA, 300 bp, Homo sapiens
ctgaattgtatccttgaaaaatgctatgttggaatcttaatccccaggacctcagaatgtgaccttacttattaaaaacagggtctttacagaggtgttgcagttacagtaaggtcattagggtgggccctaatccagcatgactgatgtccttaaaagggggactttggagagaaaaacatgctcaaggaagaggatgtgaaggctacgtgaagagactggagtgatgtgtctgctagctaaagaacaccaaaaatcgtcagccaccacctgaagctggaagaggaaaggaaagatctt

SEQ ID NO: 1797 - DNA, 300 bp, Homo sapiens
cacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggct

SEQ ID NO: 1798 - DNA, 300 bp, Homo sapiens
gtgacacccttgccctaaagcaggagtcccccctacctggggtccatggactccctgaaattgtatgcaaaatgttgtttgtacatgtgtgtctgtatgtctctgtggggaggttttatggcttttgtcagattttcaaggccttaacaaagttaaaggaccactgccctgaggttactgcactgaggccaagttaggatggcatcactctgtggcagctctccctggacttgccctgcctggaacagggtgatttgctggaatggagttaccactgagatgccaaaggttgctgggtct

SEQ ID NO: 1799 - DNA, 300 bp, Homo sapiens
ccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctg

SEQ ID NO: 1800 - DNA, 300 bp, Homo sapiens
atctgttcttgcatgtaatctactttttccatgagagcccttaacatattaatcatagttattctcagttccaaaatctgtgacacctagctgagtctggtctgatgcttgctttgttttttctcttgccttaaaacatagtatgccatgtgatttttgtgtagaaataggtgcattatttatcaggtaagaggaactgagataagtaagcagaggttttgtgttaatctggctaggagttggactgcgtttaaatttgttgctataggtgttggaggctataggtgttgctataggtgt

SEQ ID NO: 1801 - DNA, 284 bp, Homo sapiens
  misc_feature (1)...(284): n = A,T,C or G
gttttgcccctttttagcctcccagagcttcgaggactcaattcgaacccgaaatcctgccgtgggggaggggtggcagggagacctgtgcccggggaggttgntangcnnnaatctnggacttnntncngnccntncatgtanacagtgaaatgactgnanacntggtgacccgnngataccggnctnccnaggncatnatgaatngnatgcnctacnngcanacggnggacatnnggtctgtgggntgtatnatggcgnanatgancacaggnaanacgctg

SEQ ID NO: 1802 - DNA, 300 bp, Homo sapiens
aatacacaatttacatgtcagaggatggtagaggaattgtcacttatgcttcaatctgacttagtgaagcagtggggccgagaaagcaatcatatacgcatttgtctcacatgagcagaggaacagagggatgactttaagttctgtctgttttttgtccacaaggaattttcttgtgggcaaattgtgaggtctttgtagctatcttattttaggaataaaatgggaggcaggtttgcttgatgtagttcccagcttgacctcccttttccttagtgatttttggttcccaagatttat

SEQ ID NO: 1803 - DNA, 300 bp, Homo sapiens
ctgacaagtctgaaatacatattggagcctggtagactgaaaactcaagcaagagttgatgttaaagtcttcagtctgaaatttgtagggcaggagattaggctggaaactcaggcagaatttctgtgttacaatcttgaggcataattcttctccaaaaaaatctccatttttttctcttaaagccttggatgagccttggatgattggatgaggactacccacattatctagggtaatctcctttgcttaaagtaaactcactgtgttaatcacatcaacaaaataccttcacagcta

SEQ ID NO: 1804 - DNA, 300 bp, Homo sapiens
gcaaagttccattttgttgatctcgcaggatctgaaagactgaagcgtactggagctacgggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcga

SEQ ID NO: 1805 - DNA, 300 bp, Homo sapiens
gcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcga

SEQ ID NO: 1806 - DNA, 300 bp, Homo sapiens
agatgttcttatccccaagagctgtataattccagacagaggaggcaggcagacacctctatagaggacttagaaacgactgttgtgagacacattcagtgctcaggatggcaagtgtagtataccgttagaaagaacattcctttggggtgtggcctaggaagttttccagatttttcactagcgtacatctaaggaaaaccgtaaacacagagctgccctttattcctcccacaggaagaaatgtacatcttcatggagtactgcgatgaggggactttagaagaggtgtcaaggctg

SEQ ID NO: 1807 - DNA, 300 bp, Homo sapiens
caaggatggctcaacatacacaaatcaataaatgtggtacatcacattcacagaatcaaaaagaaaaaccacatgattatttgaatagatgctgaaaaagcatttgataaaattcaacatccgtttatgataaaaaccctcatcaaagtgggtatagaaggaacatacctctagataataaaggccatatatgacagacttacagctaacattgtactgagtggggaaaaattaaaggtattgtagggagaccccatgaaactattgctatggaataaaagatgaaatgctcctgattat

SEQ ID NO: 1808 - DNA, 300 bp, Homo sapiens
tttttttttcgtaaagacagcgtcttgataggttgcccaggctgctctgggactcttggcctcaagcaatcttcctacctccacctccccagttgttgcgccatggtgcctagccaagatgagactctcattcaaacagtcaaaaacccgacttaaagtagctcagacacacatagaatggattggctgctgttgtggactctccgagggtggctccatctgcaggcactgttggaaccagtacccaaggatgatgtcccagcatctgtctctccgggatctcacctttgtaccctgccc

SEQ ID NO: 1809 - DNA, 300 bp, Homo sapiens
ctgagactcagtttttcttggttcagggtcgtatttgaacagctctgttgtgaggaagggcttacaaaattgcaatataattgctttgttttgtttttcctttttgtggagaacggggtctcgccgtattgcccaggagttcgagaccagcgtggacaacataggtagaccccgtctcaacaaaattttttttaaaaagtagccaggcatgatggtgcacctctgtagtcctagctgcttgaaaggctgagtctggaggatcacttggacggacccacgagtttgaagctacagtgagct

SEQ ID NO: 1810 - DNA, 300 bp, Homo sapiens
actcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccat

SEQ ID NO: 1811 - DNA, 300 bp, Homo sapiens
gaacagaactaataggatagatgtatatatatgaaagggagttcattaaggagaattgactcacacgatcacgaggtgaagtcccacgataggccatctgcaagctgaggagcaaggaagccagtagtggctcagtttgagtcccacaacctcaaaagtagggaagcagacagtacaaccttcaatctgtggctgaaggcctgagagcccttggtaaaccactggtgtaagtccaagagtccaaaagctgaagaatccggagtctgatgttcaggggcaggaagcatccagcacaggaga

SEQ ID NO: 1812 - DNA, 300 bp, Homo sapiens
gggatcctcttaatacctctggtatctgatattcacacatcattttatttaatgattctagaggcttggaaggctgctaaaagtcattgttttcgcctttgagaataattaccatcctggaatccccagtttagcctgagaccacctaacttccccctactcaggattcaagccagttctgtccaaggacaaacccttgtgtcgaggcctctagaactatagtgagtcgtattacgtagatccagacatgataagatacattgatgagtttggacaaaccacaactagaatgcagtgaaa

SEQ ID NO: 1813 - DNA, 300 bp, Homo sapiens
ccgcgaggttttgttcctggaatggcattggtaagaagaggattggatttagaagaaataaaagcagttgttcacacctgtgctgtgtgctgaggccctgccctccccatgatgtcattcctcagaacagcctaagttggaggaattactaaactcatcatgacatgaggagctttcagaaaaccaacgccaagatccctcccagcgtccacatcgtcctctggcaggagctcctgcccctctgcctcccaccctgccccctacaccccctgcagacccatctccctccaccccctccca

SEQ ID NO: 1814 - DNA, 300 bp, Homo sapiens
  misc_feature (1)...(300): n = A,T,C or G
ccagaatgggtccatggctgctgtgaatggacacaccaacagcttttcacccctggaaaacaatgtgaagccaaggaagctgcgaaaggattgaagtctaagaattgaaaccctccanaccangtnatntnattgtaagcncaatntgagttgtgccccaatgctcgttancagctgctgnaacatanncntggcctactatanatnttgattcatgtttgacttntttcntcttatnnttcntttnagtatgttnnntncatattntatannattannttntnnagctatatatgatcc

SEQ ID NO: 1815 - DNA, 181 bp, Homo sapiens
aggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatc

SEQ ID NO: 1816 - DNA, 300 bp, Homo sapiens
gctcttttcaagttcaagataaagagaaatttttcctcaatcttgctaaatgacagctactgccattcaatggagatgtggctaacatgtcccctgcattacctctactgtatatgtaatcacttcctattaacgtattaatctcctccaataaaaactgcagcctcttaaggtcttggactgctctatttcatgattggttagtagagcatttctttcctataatccacactggcccctctctgtgaagaatgccctgtatgcaataatctgactgatatcacagctttacattattct

SEQ ID NO: 1817 - DNA, 300 bp, Homo sapiens
gttccctgctctgatcattcacattctgtgattacacaggctgtcatttccacagagagccatgaaacagtgaggagccattaggacattcccatgggtgtagctcacagttacaaagcacaactacaccctggttctccaggcctcctctttcctggcaccgcagaccagatggggtcctggagaggctctgcgtgcccttctggagcttcccatcactcctttctgcagatgttcatcttaacagcccctctgtgccactcagcccagtacccggctgcccggctgactggagatggc

SEQ ID NO: 1818 - DNA, 300 bp, Homo sapiens
ggggcccccacgcaaactcaaattccctgagcctcaagaggtggaggaagagttgaagaagtacctgtcgtagggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggatttggtttaataaaagttgaaata

SEQ ID NO: 1819 - DNA, 300 bp, Homo sapiens
gatcacttgagcccaggagtttaagtctgtattactggaaaggggtcccaatccagatcccaaacaagggttcttagatctcacacaagaaataattcagggagcgtctataaagtgaaagtaagtttactaagaaagtagaagaataaaaaatggctactccacaggcagagcagctccttggggctgctggttgcccatttttatggttatttcttgattatgtgctgaagaaggggtgggttattcatacctcccctttttagatcattatagggtaacttcctggcattgccatgg

SEQ ID NO: 1820 - DNA, 300 bp, Homo sapiens; identical to SEQ ID NO: 595

SEQ ID NO: 1821 - DNA, 300 bp, Homo sapiens
ctctcctgcatgggctttgcctacaggggtatgatgatgtatcttttcattcatcacccaggtggtatgactctccacttatgcctgggccttgatgaaacagaaattgtgacatatccctggacttggcacttaggtgatgtaactcacctttattgccagggcatggtatattatgagtattgtgacaaatctcttggcctgacacctaggggatgagagactcctgcctgggccctgcccacaggatgctttgtggcctgtcttctggttttattacctagaaagatgtgactttcc

SEQ ID NO: 1822 - DNA, 300 bp, Homo sapiens
gtggcacacacctgtggtcctagctactcaggaggctaaggagggaggatcacttgagcccaggaggtctaggctgcagtttttattgtctttaaattctcttcagataatttacccccgcattgcctacacagcacactgcagagtgctgggcaacttggtaattaaccctctaattgtgtaaactggaagcttcgtgaggttatggcttcattaccatggctacgtggctgtagccatgagtgtgcactccagtgtgggtgatggagtgagactctgtctcaaaaaggaagggaggga

SEQ ID NO: 1823 - DNA, 300 bp, Homo sapiens
gtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacct

SEQ ID NO: 1824 - DNA, 300 bp, Homo sapiens
gcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgct

SEQ ID NO: 1825 - DNA, 300 bp, Homo sapiens
gcttcgtgtgctactgcgaaggggaggaaagcggggagggggaccgcggcggcttcaacctctacgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctcttggggtcgggcaggtttcgggtgccccc

SEQ ID NO: 1826 - DNA, 300 bp, Homo sapiens
cacacacctgtggtcccagctactcgggaggctgaggtgggaaaatgcttgagcctggcatgtctagccttcagtgagccatgactgtgctactgcactccagcctgggcaacagagcaagactctgtctgaaaagaaaagaaaagaaaagagaaaaggaaaaagggcatttaagacatctcacctactgaacatcctagcttcgcctagcctaccttaaatatgctcagaacagttacactgcctacagtctgagaatatttacattaaatatgctcggaacacttacattggcctaca

SEQ ID NO: 1827 - DNA, 300 bp, Homo sapiens
cacacttggagctcatacaaactttttcccaggctattgtctgttcttcaagcccattcacctcccctaaaaatcatgtattcttcctcaaaaattgtctattatcttccacttccctttcccccatgaaaagtgttgaggcttattctgagccaatatgagtgaccatggcctgagaacccaatatgagtgaccatggcctgagaaccatctcaagagctccttcaacagttgtgactgagcttgtcaggttgcagtttggttttatatattctagggagacaggaattataggtaaaa

SEQ ID NO: 1828 - DNA, 300 bp, Homo sapiens
ggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcag

SEQ ID NO: 1829 - DNA, 300 bp, Homo sapiens
gccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtca

SEQ ID NO: 1830 - DNA, 158 bp, Homo sapiens
  misc_feature (1)...(158): n = A,T,C or G
gatctatctcttctccctgcccattaaggaatcagagatcattgatttcttcctgggggcctctctcaaggatgaggttttgaagattatgccagtgcagaanctnaccctattctnttagntcnctagncnnagantctttctttanggattctnta

SEQ ID NO: 1831 - DNA, 300 bp, Homo sapiens
atagagaggaacaaagataagaatgacagcagatgtgtggtcagaaattattcaaggcagaagacagtagaactgaaaaagaaagtaggtcaatctagaattctatacccaacacaaatatccttcaaaaatgaaggtgaaataaacactttttgatggacaaactgaagttgagagaattcgtaaccagcagacctgtagtacaaaaaatgttgaggcaagttttttaggcagaagaaaaatgatactagatagaaatttgggctgcacaaaggagtgaagaggcttccaaatggtaaa

SEQ ID NO: 1832 - DNA, 283 bp, Homo sapiens
  misc_feature (1)...(283): n = A,T,C or G
cccagctctttgggaagctgaggtgggaggatcactagatcccaggggttggagacttgcctgggcaacatagtgcaacctcgtctctaaaaatatatattttatagattagcccggcatgggtggtgcacgtctatagtcccagctactccagaggctgaggtgggaagatcccttaagcctaggaggcgaggtatcgataatctatnanagctccgttacactccaacntgggcttnngaggaangatcacgtaggntctaananatganggaggccattt

SEQ ID NO: 1833 - DNA, 300 bp, Homo sapiens
cctgcccctaggtgggggctgccttcagctccctgctgcgtgtgataacttgggtgtggccctcacagctgtgcagaagctattcccagagggttctggccccaggtaaacagattctgctctgggctcgccttgcctccatcccacagccctgtgtgctgtctgtggcacagcctagagcagcactgcctcgtggccctggcccttatgcggctggagctgatcctgaagtccagtgtcccagcggtcatggctggcatcatcaccatctacaacctggtgatggaagtccttatcccc

SEQ ID NO: 1834 - DNA, 300 bp, Homo sapiens
cccaaacctaatttaggagtaaattttttgtagcagatagccagatttcagccaatcacaggcttccagctaacaagactatgcccaaataaggcaaatgcctcatcacatgatgctcaaataaggcagccacctaggcgaggccaatcaggtaacttttctactttgcttaattgttcagcctgtacaaatttgctgcttatgactgctgagcagagctgtctaaacctcttctggtttggagtgctgccttatatatgaattgttctttggtcacataaaattggttaaatttaactt

SEQ ID NO: 1835 - DNA, 300 bp, Homo sapiens
tggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtccggg

SEQ ID NO: 1836 - DNA, 300 bp, Homo sapiens
ggccagtaggtgctaaggtgacaccaccccttcctccctctccagacccatcccaccaccgtgatttgcccatccccagcagcctcatcactgaccacctgtttttacttgcaggacccattccaacaatctcgtaaaacatggtggattactatgaagttctaggcgtgcagagacatgcctcacccgaggatattaaaaaggcgtaagtagttttatttctgtggtaatgcattttcacagtggtacattggtaattgagtagtataacttcttctattgcctatgaaaatggctttt

SEQ ID NO: 1837 - DNA, 300 bp, Homo sapiens
gagactccaggctgagctggctgaccgacccaatccccctacccgccctctgcccgctgacccggtggtgagaagcccgaaggtaacggtggggggagagaagggcacggcctctccccccacctagggctgtggtgctggtagccatgacggtggtggccgtggcgagatgccccctcagtgcatgagggcacatatcccggtggtgcctttaatggtgacagtctcaggggccagccaagcccccacccccaaggaagccactgtctgccgacccccagggccggtgcccatcgggtg

SEQ ID NO: 1838 - DNA, 300 bp, Homo sapiens
aaggcttagatcattgacttcagattttttgtcttttctaacaagtgttcaagactataatataaatttccctctaagcattgtttagccacatttcacaaatttggaaatgtttattcattttcatcttcattcagttgaaaatattttctaatttcccttttaatttcttcttttactcacttattatttggaaatgtgttatttcatttccaaatatttggggattttcaaatatctcctgttaacaatttctaaattagttgtagtcagagaacatattctgtgatttcaatgctg

SEQ ID NO: 1839 - DNA, 233 bp, Homo sapiens
ggaacgtcaggcacagggatgatgaaaggggaacaataagtgttaattacctacaggttgtgttggctccaggtttttggcattgtgcctagactgaataaaagcaagcagctccagcttcttggggctgctttctggccactagagccaggcagtcacctagttgctgttacactgaaaaaaaaaaaaaaaaaaaaaaaaaaaaaaaaaaaaaaaaaaaaaaaaaaaaaaaa

SEQ ID NO: 1840 - DNA, 212 bp, Homo sapiens
  misc_feature (1)...(212): n = A,T,C or G
ggaacgtcaggcacagggatgatgaaaggggaacaataagtgttaattacctacaggttgtgttggctccaggtttttggcattgtgcctagactgaataaaagcaagcagctccagcttcttggggctgctttctggccactagagccaggcagtcacctagttgctgttacactgaaaaaaaaaaaaaaaaaaanaaaanaanaaaaaaa

SEQ ID NO: 1841 - DNA, 300 bp, Homo sapiens
ggaacgtcaggcacagggatgatgaaaggggaacaataagtgttaattacctacaggttgtgttggctccaggtttttggcattgtgcctagactgaataaaagcaagcagctccagcttcttggggctgctttctggccactagagccaggcagtcacctagttgctgttacactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1842 - DNA, 300 bp, Homo sapiens
cccaagcaaggttccttggaagaagatgtctgcagaggagctggagaatcagtactgtcccagccgatgggttgtccgactgggagcagaggaagccttgaggacctactcacagataggaattgaagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccat

SEQ ID NO: 1843 - DNA, 300 bp, Homo sapiens
gctctcggaggctgtcttctgtcgccaagggtcccggaccgagtacacagtggcagctggcttagttggtggacggcctggggtaggggagggtggcaggtataagacttctgggggcaccccaagaccccagacacccaagtggcatcttgggggtgggtgggcagaggacggggtaatgtgaggacgaagcgggcacggagccagatggccagtctccaggcctggtccacggactggcagggaccccaggcacaagagctgccacccctctgcccggtttggaaaaaaacaataaag

SEQ ID NO: 1844 - DNA, 300 bp, Homo sapiens
gagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccc

SEQ ID NO: 1845 - DNA, 300 bp, Homo sapiens
ggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctga

SEQ ID NO: 1846 - DNA, 300 bp, Homo sapiens
  misc_feature (1)...(300): n = A,T,C or G
aaaattaaaaacacacaggcccaacaaactcaacaaacgctaagcacaagaaacatgtaggaaactataccaaggagtattataatcaaattactcaaaaccagtgataaggtgaaaaccttaaaagcagccagaggaaaaaggacatgcaagaagaataaagacaaaggtaatggcagactttttgcctgaaagaatgcaagtgagaagacaatatattaacatctttaaactaatgaaagaagancnactgtcaacctagaantctgtatgaacgtngnccaaaggnnttcaaannnc

SEQ ID NO: 1847 - DNA, 299 bp, Homo sapiens
  misc_feature (1)...(299): n = A,T,C or G
agacttttgaggaaattctttcttgacaaagacagagatcaaaccaaaaaacaaacaaaaaaacacacacagaaaaatgtgagtagggaagaaataggaaaaaggtaagaagcagaaatttttttttttttnaancggagtttcgntnttgtngcccaggntgnagngcannggcncagtctnggttnaccanancntccaccacccaggttnaagcanttntcnngcntnagcctcctgagtanctggnattntnggcncccaccaccacnccnggttaanttngnntttttagtaaa

SEQ ID NO: 1848 - DNA, 165 bp, Homo sapiens
gggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagct

SEQ ID NO: 1849 - DNA, 273 bp, Homo sapiens
  misc_feature (1)...(273): n = A,T,C or G
cagcaatgttttgtggcttttattgtacaagcttttcacctccttggttaagttagttcttaagtgtcttattcttttacgtgctattataaatggaattattttcataatttccttttcatggtgttaancattatncgnactcacntgcnactnaataantgcacnttgacnnttccagnnacatgaaacnattnannntnnnantcntacannaagnacnancatcnattngcntnttnctnatnngannntnntgnatntanaannccg

SEQ ID NO: 1850 - DNA, 300 bp, Homo sapiens
gccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatggggaagggttctaggccagaatgttcacatttggaagactctttcaa

SEQ ID NO: 1851 - DNA, 206 bp, Homo sapiens
ctgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggagcatggctgggagccgtgaggtggtggccatggactgcgagatggtggggctggggcc

SEQ ID NO: 1852 - DNA, 295 bp, Homo sapiens
  misc_feature (1)...(295): n = A,T,C or G
ttttattttgtcacccaggctgaaatacagtggcaaaattatacctcaatgcagcctcaacccccctgggctcaagggatcctccaaattcagcctcctgagtagctgggagtataggcttgcaccaccatgcccagctaattttttttttttnganctttngnattttcagtagngacanagtttccccatgtngctnaggctggngtaaaactccngggctnaagcaatcntcccacctgggccttccaaagggctggnattacaaggggnanccantgtacccagcaaaata

SEQ ID NO: 1853 - DNA, 300 bp, Homo sapiens
aattacaggcttgagccactgcaccaggccctaagagctctaaactttcttatcacacagtgaattaaaatattttggatcttaactatcccatattaagcgatcctttcctcaaatgaaagaaaatacttaattagaacatatatgtttaaactgatacagtaagttgtttgtaagcctctagaactatagtgagtcgtattacgtagatccagacatgataagatacattgatgagtttggacaaaccacaactagaatgcaggtgaagaaaatgctttatttgtgaaatttgtgatg

SEQ ID NO: 1854 - DNA, 289 bp, Homo sapiens
  misc_feature (1)...(289): n = A,T,C or G
gtggtaccttggctttaggttttcattcgcacggaacaccttttggcatgcttaacttcctggtaacaccttcacctgcattggttttctttttcttttttctttcttttttttttttnnngtggnggttggttttaaaaccccnnnancnnnaaaaccntttttnnaaanccntngaaanncnancnnggcnttttttccccccnttnnnccaanggnggnnttaaangnangnnnggcngggggaanntttngcaaccanggggnntgggggnctaancggtcaaaa

SEQ ID NO: 1855 - DNA, 300 bp, Homo sapiens
ggttaatttttgtttgaaatcatgcccagattcgacgtcaagcaattaaagaactgcctcaatttgccactggagaaaatcttcctcgagtggcagatatactaacgcaacttttgcagacaggtaagggattttattattacctttttctctaaatatatatcttctttctgaaatgttgactctgtttttaggttttaaatggggtgcaggagagctggaggtcctacctctgatagagattaaatttcctactttcattcagtagttaaagtgtaatgatttctggttatctaattc

SEQ ID NO: 1856 - DNA, 300 bp, Homo sapiens
aatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttat

SEQ ID NO: 1857 - DNA, 300 bp, Homo sapiens
tattggtttgtagaaatgctactgatttttgtacgttaatttttgtatcctgaaactttactaacgtcatttatcaggtcttttggagggattgttagggtttttttaggtttagaatcatattgtgagtgaacagagataatttgacttcctctttttctatttagatgccttttgtttctttttcttgcccgattgctctgggtaggacttcagtactatgttgaatagaggtggtgagagtgggcatccttgtcttgttcttaggggggatgctttcacctttgcccattcagtatg

SEQ ID NO: 1858 - DNA, 300 bp, Homo sapiens
ggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctg

SEQ ID NO: 1859 - DNA, 300 bp, Homo sapiens
gcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggactccgtcgtggccccctcggggctgacactaatggacagaggctctcggtgccgaaaattgcctgccagaggactgaccacagcctggctggcagctgctctgtggaggacctccaggactgagactgggctctgttttccaagggtcttc

SEQ ID NO: 1860 - DNA, 300 bp, Homo sapiens
cctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgccc

SEQ ID NO: 1861 - DNA, 300 bp, Homo sapiens
gggaccactggcctgcctgacctcaccccactaatattttttattttttgcagagacaggatatggggaaaagaaatcagattgttactgtgtctatgtagaaaaggaagccataagaaactccattttgatctgtattaagaaaaattgttctgctttgagatgctgttaatctgtaactttagccccaaccctgtgctcacagaaacgtactgtattgaatcaaggtttaatggatttagggctgtgcagcatgtgccttgttaacaatatgtttgcaggcagtatgcttggtaaaag

SEQ ID NO: 1862 - DNA, 300 bp, Homo sapiens
gctgggtgtggtggcacacgcttataatcccagctactcgggaggctaaggcaggagaattgtttgaatctgggaggcagaggttgcagtgggccgagatcgcaccattgcgctccggcctgcgcaacaagagcgaaactctgtctccaaaaaagagatgatctcactgtgtcacccaggctgacgtgtagaggcatgatcatagctcactgtatcctcaaactcctcctgggttcaagtgattgtcctgccttgacctgctgagtagccaccaccatgcctggctcaaaatggatttga

SEQ ID NO: 1863 - DNA, 300 bp, Homo sapiens
agaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatgctgttctggag

SEQ ID NO: 1864 - DNA, 300 bp, Homo sapiens
cccaaaaccatttattgaagagacaaccctttcctcattgtttgcttttggcattcttgtcaaagatcagttgtccataaatatgtggctatatttctgggatctctcttttgttcccttggtctacatgtctgtttttaatgggagtatcatactgtttctattactgtaattttgatgtatattttgaaatcaaatagtatgatgctgctagctccattctttatgcttgagagtgctttggctatttagggtcttttctagttccatacaaattttaggtttatttttatgcttctg

SEQ ID NO: 1865 - DNA, 300 bp, Homo sapiens
cagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagat

SEQ ID NO: 1866 - DNA, 300 bp, Homo sapiens
agacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcg

SEQ ID NO: 1867 - DNA, 300 bp, Homo sapiens
agcgtgtgcagcggcagctgctggtgaggcccaaggggctctgtctccagggagcctgcctcgcttttggagcagacaggcttggggagggcagtgatgtgagccagccccacccagcacccctcttgcccttcctgttttcctaggggacgggccgggccatatggggaggaagggactagaccaatgctgcttaatgttacagacgctgagcagcgagctgtcccaggcccgagatgagaataagaggacccacaatgacatcatccacaacgagaacatgaggcaaggccgggacaa

SEQ ID NO: 1868 - DNA, 300 bp, Homo sapiens
ggatgacagagtgagattctgtcttaaacaaaaaaccccaaaagaccatccagagtgcttgtctcggtagcatatatactaaaattggaaggatatggagaagattagtatggtccctgcgcaaggatgacacgcaaatttgtgaattgtttcataattactatttaaaaaaaaaaacctctgtaggtatttctccaaagaagctaagcagatgcccaataaacatatggaaagatgttcagcatcactaataattagggaaatgcaaatcaaaaccacagtgagatgttattttgcgac

SEQ ID NO: 1869 - DNA, 290 bp, Homo sapiens
  misc_feature (1)...(290): n = A,T,C or G
gaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgatggnccttatnctattgatgatncttacngacgatgatggctncnncagatccattcatganntgatnctaanaaatattacttggtattcanancgagttntaactgaaatctccttgnggagctcctgatnctggggg

SEQ ID NO: 1870 - DNA, 300 bp, Homo sapiens
ctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaaca

SEQ ID NO: 1871 - DNA, 300 bp, Homo sapiens
  misc_feature (1)...(300): n = A,T,C or G
acaccctggactcctgcaggggaggacacacggaggtggacaactgcagatacacttactcggagtggcacagctttactcagccccgtcttggtgaagtgagttttcctaagtggnctacaaatctattntaattntctttagactttatanntaactaactggattctgactataanttncaattanctatgantctactacttctactaatagaaagctattattnttcctcantnntaatntagttatgttcngatttanntgganatttacttcccctcctatttttttaattga

SEQ ID NO: 1872 - DNA, 300 bp, Homo sapiens
gtttgatcatttatgtacttgggtaaggtggtaactgctagatctctccatttgaagttgcttttaaaaaatttgttatttttgctactcgggaggctgaggcgggagaatcgcttgaacccaggaggctgaggttgtggtgggccgagattatgccattggactccagcctgggcaacaagagccaaactccgtctcaaaataaacaaacaaactaactaaagaagcctaacagtaaatggcagctggtgtgtatgtgaccctgttgctctgcttcctccagggacacggccaacacgg

SEQ ID NO: 1873 - DNA, 300 bp, Homo sapiens
acgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagat

SEQ ID NO: 1874 - DNA, 156 bp, Homo sapiens
  misc_feature (1)...(156): n = A,T,C or G
agctcgagtcaacgtccctgtcattggtggccatgctgggaagaccatcatccccctgatctctcagtgcacccccaaggtggactttccccaggaccagctgacagcactcactgggcgggatccaggaggacttaacnangntgtgnaggatat

SEQ ID NO: 1875 - DNA, 300 bp, Homo sapiens
gttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgcca

SEQ ID NO: 1876 - DNA, 157 bp, Homo sapiens
agcggccatggccaacttggaggtgaagaaagcattcatgggaccactgaagaaagaccgaattgcaaaggaagaaggagcttaatgccaggaacagattttgcagttggtggggtctcaataaaagttattttccactgaaaaaaaaaaaaaaaaa

SEQ ID NO: 1877 - DNA, 300 bp, Homo sapiens
aggacccaggcaaccctcaacaacctgcctgcgaagaaagctcccttggaaggggctgcgccagcacatttccctgcccctaatcacaaatgccctgggcccctccaccggagattcgcgttcagtaggtcagtgacggggccgggaatctgccatttgaaacgaatactcccagttatttgtttcatcaagcagatagaaaaacatggattccttagaaaggttctgcaactgaccattcattaactcctgagggcctcatgtcaggttccgtgcatgcactgagcacctactgtgtgc

SEQ ID NO: 1878 - DNA, 300 bp, Homo sapiens
gaaggggtttaaaaaggaaaaggtgtggaagagatgcaggagtggtgcaggtctgaatgtcttgttgtgatagttatattgagtaattgcccatctggaggtatggtttgtgtcatcttgacttcagctgggtaatgctaggctaactgttcgaaactccccccatgcaagaggagtctgcaactccatctctgcttggtttgtttcaaaactggcccctgaaatttctaagcaagtacgtaattagataagtgaacactgttcatggacatgcctggtgggaaagggagaaactaaggg

SEQ ID NO: 1879 - DNA, 300 bp, Homo sapiens
gccaattccaggccctcctccacgcagtgtgccaccaacagacttctctcaactgattgatagtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagttatgcctgacttggactcagaaccttggatagaagttaaaaaaagacatcatccagccccagtgaaattgagggaatcagtgtctgtccctgaag

SEQ ID NO: 1880 - DNA, 300 bp, Homo sapiens
agacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggag

SEQ ID NO: 1881 - DNA, 300 bp, Homo sapiens
gtggagcccaagagctctgggccgccaggaagcctccaatgctctggccacctggacccgccttttaaatgcgtattctgtctctttctaactcctttgtctccgcaggactcggggtatctgctgggtggtgtggggctggtttccccaatatctaagatcagtgcttggggcattttgcagatcctgcactggatggatcagcggacaacacacagaccggtaatctgggtcaatcagttctgccatcccacccagaacagaaaacagcatgaaaaactcactttaaccccctatgaa

SEQ ID NO: 1882 - DNA, 149 bp, Homo sapiens
gaggaagcatataccacagaacattggctggtcaggatatacaaggtaaaggacctttataatcgaggcttgtcaaggacataaatgtcacgtccagctctgatatgcttcgcactgagcacatcacatttaggacgttgaagattttt

SEQ ID NO: 1883 - DNA, 206 bp, Homo sapiens
gtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgg

SEQ ID NO: 1884 - DNA, 300 bp, Homo sapiens
gacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcagg

SEQ ID NO: 1885 - DNA, 300 bp, Homo sapiens
tgcagtagcatccatgagcatcagcagagatgcagtgggggtctgtttacttggtgataagttatatgctgttggggggtatgatggacaggcataccttaatactgtggaggcttatgatccccagacaaatgagtggacccaggtattttcacatacttttgaggacagcaaagatcacctggtggccatcaagcagaccatctggaggcaaaactccttatctgaggaattcagaagtcattagactgccctattatctaaagccggcatcttgtactaggcttctttaccaaaaat

SEQ ID NO: 1886 - DNA, 300 bp, Homo sapiens
aataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatagtatgtgatctgacttttcctttagcat

SEQ ID NO: 1887 - DNA, 300 bp, Homo sapiens
gctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttat

SEQ ID NO: 1888 - DNA, 300 bp, Homo sapiens
agtaatttttttagtttgtttttgagacagctctgtcacccaggctgagtacagtggcatgatcatggctcacagcagcctctcaacctccctgggctcaggtgatcctcccacctcagcctcctgagtagctggtaccacaggtgtgtacctggttaattttttggtgtttcttatagaggcaggatctccttatgttacccacaccggtctcaaacttctggactttaggaatcctcctgccccggcctctcaaagggctggacaggtgtgagccaccaggcctggccccaagcttgt

SEQ ID NO: 1889 - DNA, 190 bp, Homo sapiens
ccaaacttggaggtggccgcttccagaccatggaggagaagaaagcattcatgggaccactgaagaaagaccgaattgcaaaggaagaaggagcttaatgccaggaacagattttgcagttggtggggtctcaataaaagtttgtttcagtggaaaataacttttattgagacaaaaaaaaaaaaaaaaa

SEQ ID NO: 1890 - DNA, 187 bp, Homo sapiens
cagcctgcggccaggctttttatttaatgtaaatagtttttgtttgcctccgtggtttggtcaccgtgtgcatcgcaccgtgctgtaaatgtggcagtcgctgtgttgggagagccggccacgcccttggctttagagctgtgttgaaatccattttggtgatggcttttaacccaaactcattgca

SEQ ID NO: 1891 - DNA, 300 bp, Homo sapiens
agccaatgtgcttgcaagtgtacagatctgtgtagaggaatgtgtgtatatttacctcttcgtttgctcaaacatgagtgggtatttttttgtttggtttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtggagacagggttttacc

SEQ ID NO: 1892 - DNA, 300 bp, Homo sapiens
ggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggt

SEQ ID NO: 1893 - DNA, 300 bp, Homo sapiens
agaggccagatcacacaggaatgactgggattttaggcctggaatgtacctttaaaattatcttattacacaccatccttcatttttctcattttcctcttttgggattcatatattaagtattagggcattaaaacacaactgtatatataaagaaaaatataaagtaaccacacatgctcagggaaagacacaggctcagaaaatgcctgagaagaacttagtttcacaccccaggctgatcctaagcaccgagacagcctacaacaatccaaaaaacaaaaacaataaataaaaagt

SEQ ID NO: 1894 - DNA, 174 bp, Homo sapiens
ttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccgtttagtgagagaggtcagaaattg

SEQ ID NO: 1895 - DNA, 300 bp, Homo sapiens
aaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattg

SEQ ID NO: 1896 - DNA, 300 bp, Homo sapiens
gtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagatatatcatactttgttctggcctcttgaatggacagtagctggcagagagaacaacacttgttacgcaaagataatctgca

SEQ ID NO: 1897 - DNA, 300 bp, Homo sapiens
gcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccag

SEQ ID NO: 1898 - DNA, 274 bp, Homo sapiens
  misc_feature (1)...(274): n = A,T,C or G
ctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgacagagtccgactccatctcagaaannnaaaaaaaaaaaaaaaaaaaaaaaaaaaaaaaaaaaaaaaaaaaaaaaaaaaaaaaaaaaaaaaaanaaaatttnntgaannananantngaaaaa

SEQ ID NO: 1899 - DNA, 209 bp, Homo sapiens
ggggcttcttagggccaatcttaccacaatgctcacgtggtcaggcaggggcttcttagggcccctgttaccagttgggtcccagggcatcattgtggaacccatagatgagatactgcccaccacccccatctcagaacagaagggtgggaagccagagccttctgccatgccccagccagttcccacagcataacaggttctccttg

SEQ ID NO: 1900 - DNA, 300 bp, Homo sapiens
gtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacacttt

SEQ ID NO: 1901 - DNA, 300 bp, Homo sapiens
aggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtga

SEQ ID NO: 1902 - DNA, 300 bp, Homo sapiens
cattagtatttttgtgatttcattttttacacttaaatattgattcatgtggaattcactttgatgcagggtgcagtagggctccagtttaatttttttttagattgctactcagttgtttcagtactgcttagtgaataagccatctttattatcttgagatgtcacttttattatgtactgaatttctctgtttatgttgggtctttagctgtactatgtggtctcttccattgatttgtcttttactgggctgtgtcatactgtttttaattattgtagtgttatattttagtattt

SEQ ID NO: 1903 - DNA, 300 bp, Homo sapiens
atctcatatgagtgagaaagcttaccagtgcagcgaatgtgggaaagccttccgagggcactcggacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggc

SEQ ID NO: 1904 - DNA, 300 bp, Homo sapiens
cacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaagaaccaagtagagagagtggagctgctttattgcccttggagcccgcgctctcggaggctgtcttctgtcgccaagggtcccggaccgagtacacagtggcagctggcttagttggtggacggcctgggg

SEQ ID NO: 1905 - DNA, 300 bp, Homo sapiens
ggggaaagttttcagttgtattatagttgattctgactatttgccataactgtattctatacacttgctgaaaacattgaattagggaatactgaatcatggctcctaagggaaagacagggttaggttcctggaagcctctggtcacaacattttcaccaactgatcaatagataaccttgttttgtttatgtttgtgtttagagacatttaatatatattgttgacttactaacatcgaactcatggccaatagcactataacttacggctgaacaaagcttatcaagtcttttctct

SEQ ID NO: 1906 - DNA, 148 bp, Homo sapiens
  misc_feature (1)...(148): n = A,T,C or G
ccggcttcctcatcaacctcattgactcccccgggcacgtcgacttctcctcggaggtgactgctgccctccgagtcaccgatggcgcattggtggtggaggacngtgtntnaagngcgtgcnagcaganggatacaganacntanca

SEQ ID NO: 1907 - DNA, 300 bp, Homo sapiens
gcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtga

SEQ ID NO: 1908 - DNA, 300 bp, Homo sapiens
caaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggtgttggatgtcaatgatgatttttctgaggaagtaaccaaacaagaagacctcatgagagaggtaaacacctttgtaaagaatctgtaaccaataccatgatgttcaggctgtga

SEQ ID NO: 1909 - DNA, 211 bp, Homo sapiens
  misc_feature (1)...(211): n = A,T,C or G
ggactcagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttnggnccaaaataaaacctcagctagctctgccaatgtcaaaaaaaaaa

SEQ ID NO: 1910 - DNA, 300 bp, Homo sapiens
cttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaaggtgaatgaaataatggccatggatatattgttattgttctgatatgaaacaaagaatttagagtttcatgaagttatacgtgctctgtccccacaattctgattcagaccaaaatgtgttaagcttaatagcctttttacaagtttgct

SEQ ID NO: 1911 - DNA, 300 bp, Homo sapiens
gttagtaggtgcccataacttcggtggtggagatccaaaagtgaacaagacagtgttctggctgctaaattcttcttaactggttatgcctggagaccttcacttggttctgtgccagcactgcccatgaacttcatagactgtgatctttgctaaggcctaaatgaatgaaggtgcaggaccggaagcagaagacagaaagtggagaccagatgtttgaagctgggtaaaggcagggatggagcaggaaccgaggaacaaaccttggaactagagtctgatgcttggctgtctgaaacc

SEQ ID NO: 1912 - DNA, 300 bp, Homo sapiens
gttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagca

SEQ ID NO: 1913 - DNA, 300 bp, Homo sapiens
cccctttgccttccccatgattataagtttcctgaggcctcctgggacatgcggaattgtgactcaattaaacctgttttctttataaattacccagtccccagcagttctttatagaagtgtgaaaacagactaatacaatcctgaagcatttcatcaaagaattgtaacaggagatgaaacatggcttcaccagtatgatcctgaagaaaaagcacaatcaaagcagtggctatcaagaggaggaagtcaaagcaaagcagaccagtcaagagcaaaggtaatggcaacagttttttt

SEQ ID NO: 1914 - DNA, 300 bp, Homo sapiens
acccggcccacgcgggccaccagggccttccattccaggcccaccaggaccccgaggcccaccagggagggtttgccaggcccaccaggcccaccaggatcgttcctgtccaactcagaaaccttcctctccggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggaccc

SEQ ID NO: 1915 - DNA, 300 bp, Homo sapiens
gtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaag

SEQ ID NO: 1916 - DNA, 213 bp, Homo sapiens
gtgatgagatggggaaagtgggctcaggaggtctggatctgtgatgagatggggaaagtgggctcaggaggtctggatctgtgatgagatgggggaagtgggctcaggaggtctggatctgtgatgagatgggggaagtggtctcaggaggtctggatctgtgatgagatgggcggaagtgggctcatgaggtctggatctgtgatgatatgg

SEQ ID NO: 1917 - DNA, 300 bp, Homo sapiens
gcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcaga

SEQ ID NO: 1918 - DNA, 300 bp, Homo sapiens
agggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggt

SEQ ID NO: 1919 - DNA, 300 bp, Homo sapiens
cttccttgtataatactgatcattctattttagcggtaagaacccaagaaggagtatggatacctgtaaagctttctggtccttgggaagcctctccttctgtgcatattattactgaaattcttcaaaagattctgagatgctctcagtgtttcattgctactttaattttaatcattatgggattgattgctgtcacagctactgccgcggcagctggagttgctttgcatttcacagtacaaacagcagactatgtaaataattggcagaaaaattctactttgctgtggaattccc

SEQ ID NO: 1920 - DNA, 262 bp, Homo sapiens
cccaggctctggggcagcgcaggaggggtaggctgggaggggctgccgcagctgttcacttgggcaggaggccgctatgcagggtagcactgggaacaggagacccacctgaggctcagccctagccctcagcccacctggggagtttactacctggggaccccccttgcccatgcctccagctacaaaacaattcaattgctttttttttttggcccaaaataaaacctcagttagttttgccaaaaaaaaaaaaaaaaaa

SEQ ID NO: 1921 - DNA, 300 bp, Homo sapiens
ttgagacggagtttcaccatgttggccaggatggtcttcaacttctaacttcgtgatccacgctgctgggattacaggtgtgagccaccgcgtgtggcctctgggcaccttttgaagctgaagcagagagagaaggcggcaggcatcagcgttttcttctatgaacttataagatcaaagactttaagactttcactatttcttctaccgctatctactacgaacttcaaagaggaaccaggagtacggaaggagcatgaaagtggacaaggaacgtgaccattgaagcaccacagggag

SEQ ID NO: 1922 - DNA, 300 bp, Homo sapiens
gggggacacgttggctgcgttttcggcgggcttcccgggtacaaaaatggctgtggctagcgatttctacctgcgctactacgtagggcacaagggcaagtttgggcacgagtttctggagttcgaatttcggccggacggtgtttacgtgtaattgttcaccataggacgcatgaagagtaccaagcaagaggggagaggaaagcttagatatgccaacaacagcaattacaaaaatgatgtgatgatcagaaaagaggcttatgtgcacaagagtgtaatggaagaactgaagagaat

SEQ ID NO: 1923 - DNA, 300 bp, Homo sapiens
ctcccattcccggaaggaggagacagttactgtctatcccgcagacgtggtgctctttgaagggatcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccaggaggt

SEQ ID NO: 1924 - DNA, 300 bp, Homo sapiens
ctgggctcatgcaatccacctgccttggcctccaaagtgccgggattgcaggcataagccactgtacccggccccaactaatttttgtattttttgtatagatggggtttcaccatgtcggtcaggcttgtcttgaactcctgagctgaagcaatccacccgccttaccctcccaaaggtgctcatattacaggcttgaggcactgtgcctggccatgggtgccatctatctaaagagtgatgaacttggtgttaaaccagtaattgaaatcaccaagttcctaccatcatgagctcagt

SEQ ID NO: 1925 - DNA, 270 bp, Homo sapiens
  misc_feature (1)...(270): n = A,T,C or G
ccccagtgtcctcctccttctccggccagacccagccccgcgaagatggtggaccgcgagcaactggtgcagaaagcccggctggccgagcaggcggagcgctacgacgacatggccgnggncatgaagaacgtgacagagctgantgatccnntgtcnaangaggaaccgaaaccttntgnntngaggactnnngtaacgntgtgnggttnngctgnntntttnttnaattttatgtgnnggnctgtntnnanngntnctttttttagt

SEQ ID NO: 1926 - DNA, 188 bp, Homo sapiens
acagcttccacgcttctgtccacttctggttgccaggagacagcaagcaaagccagcaggacatgaagttgctattaaatggacttcgtgatttttgttttgcactaaagtttctgtgatttaacaataaaattctgttagccagaaaaaaaaaaaaaaaaaaaaaaaaaaaaaaaaaaaaaaaaaac

SEQ ID NO: 1927 - DNA, 300 bp, Homo sapiens
ggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacag

SEQ ID NO: 1928 - DNA, 284 bp, Homo sapiens
  misc_feature (1)...(284): n = A,T,C or G
aaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatccccttttatcatcctttcagtttttattaatctactgtatcataaattctgtaantngatgngagga

SEQ ID NO: 1929 - DNA, 291 bp, Homo sapiens
  misc_feature (1)...(291): n = A,T,C or G
ctcgagttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaaaaaaaaaaaaaaaaaanttnnnccttnaaaannaanngggngncnannaccnaaaacccnnncnnnaaaaaanccttggannatttgg

SEQ ID NO: 1930 - DNA, 300 bp, Homo sapiens
gctcagtgttgtaattccctattctagcactctcaaaagtaccccatctgttacacatgcagaaactgcagcagcatctgaaatgtccacttcttgattcattctgaactcccttaagcccagtgtttgttagttctcgttcaagtctaggaactctgccgagtaacaggtatctcaattttgccatcctttctttctgcatagacaggagtgttcttaaatcttctcctgtaaagcaagtcatctctgatttccctgaggatcattgctcccgtatactgttgttggggtgagccttct

SEQ ID NO: 1931 - DNA, 300 bp, Homo sapiens
cccactgccccatcagtatgggcatgaacctcactgctgccaccccgatgaaatgcttttgccagcaccccacatcagagtgatcttgccagcagactgggaacatctcaggccctcgagcacagcaggtgcttaaatttgaggtcccagataacaaagccgtgggtctggtaccaggccctgtgggttagagcatgcagcccacgagtgctgagagagccttggccccctgaaataatccaaaaacaaagccagtcatctgaacacaacttataccatagtcaaaccttcaatggcatc

SEQ ID NO: 1932 - DNA, 300 bp, Homo sapiens
attctctctccataccaccccccaaaaattttcgccgctccaacacttcaacactattttggtttatttgtcttattaatatcagaaggcaggaatgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgt

SEQ ID NO: 1933 - DNA, 208 bp, Homo sapiens
  misc_feature (1)...(208): n = A,T,C or G
gctggtgttagggttctttgtttttggggtttggcagagatgtgtttaagtgctgtggccagaagcggggggagggggtttggtggaaattttttgttatgatgtctgtgtggaaagcggctgtgcagacattcaattgttattaaaaaaaaaaaaaaaaaaaaaaaaaaaaaaaaaaaaaaaaaaaaaaaaaaaaaaancccccccc

SEQ ID NO: 1934 - DNA, 300 bp, Homo sapiens
ccagcatggtggatgatgtcttctacattgttaagaagagcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgagaacatcatgcacagcagcctccagcaaggcaaatttgacacaaaaggcatcgagagtactgacgaggcgaagatgtccttcctggagactc

SEQ ID NO: 1935 - DNA, 300 bp, Homo sapiens
aattccaattccacattttcaagaaataaggaggcaaaaatgttcatatatgaattggaattatttgttttcttattaggccgagatgcgccgcgtgcggctgctggagatggcggacgcgatggatatgttctgccaagggttggtttgcgcattcacagttctccgcaagaattgattggctccaattcttggagtggtgaagaaagaaaaaagttgaactagatttggtctgatgcagttacagatttacaaactgtgcccccaccctcctgcagacaccttccactcctcattctt

SEQ ID NO: 1936 - DNA, 300 bp, Homo sapiens
cccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagccca

SEQ ID NO: 1937 - DNA, 300 bp, Homo sapiens
ggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctaca

SEQ ID NO: 1938 - DNA, 149 bp, Homo sapiens
  misc_feature (1)...(149): n = A,T,C or G
gcgagtcgtagtgtcgctgtttgcgggtctccgcgcgggaccggggcgcagcggggtcgctgaggcgagggtgtcatgtcagacaacgaggacaattttgatggcgacgactttgatgatntggagnaggatnangntctatatgactt

SEQ ID NO: 1939 - DNA, 300 bp, Homo sapiens
gatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaat

SEQ ID NO: 1940 - DNA, 300 bp, Homo sapiens
ggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctggctcaccggcggtcagagtttaaggttatctctcttattccctgaacattgctgttatcctgttcttttttcaaggtgcctagatttcatattgtttaaacacacatgctctacaa

SEQ ID NO: 1941 - DNA, 300 bp, Homo sapiens
gcagcttgaaggaaagacttttaaaggtacatgatgaagaaaaccaaattaaataattggttaggtacagttcatagttacttgatttgtacaattaaggtggacatttcctggttatgtaatcagaggttaattggcagtttatgattggttaagcctaaatttttgtttccctcaattcagtaatttgcaaaaaaatgcatttgagttagagtttttaaaaaataggaacccagggactagagtaacctccgtctaattgcctgctacttagttattttcacactccacaggggactg

SEQ ID NO: 1942 - DNA, 300 bp, Homo sapiens
gggagggcacacctgggggacagcagcggcgggagtgtggtccgactggcctggaagatcttgggcagagctgacctcagagaacagtgcgggtctctcgccctcctggggcagtccccaggacgaggtgccaggtgcctggcccatgttgcagggggccgtggagcccatgcagatcgacgtggacccccaggaagacccgcagaatgcacctgacgtcaactacgtggtggagaaccccagcctggatctggaacagtacgcggccagctacagcggcctggccactgggtgccaccc

SEQ ID NO: 1943 - DNA, 300 bp, Homo sapiens
gcatatgcttgtctcaaagattaagccatgcatgtctaagtacgcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttaga

SEQ ID NO: 1944 - DNA, 300 bp, Homo sapiens
aaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctc

SEQ ID NO: 1945 - DNA, 230 bp, Homo sapiens
  misc_feature (1)...(230): n = A,T,C or G
gtcaacctctaccacgtgcgggaggatggctggatccgagtctccagtgacaatgtggctgatctacatgagaagtatagtggctctaccccctgaaagagggtggatgcagntgcttgtgntncatggggtgactgtcaatcggtatntactgnanacntatgactnnactcctncatccctantantagcgtanatnngtnntttnaggatctatttntngttgntnt

SEQ ID NO: 1946 - DNA, 300 bp, Homo sapiens
gcatattgtggagaggcacagttcaggaggaatagggttcgtcttgaagaggaggacactttcctgtgaatcatgagggacagaagatccatatagaagaagacaatagctttgatcttctattacaagaaaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctc

SEQ ID NO: 1947 - DNA, 300 bp, Homo sapiens
ttcaaatctgccactcccagagcccgtggaactctggcccaaggctctctgactgactccttcttggcttagcggctgaagactgacactgcccgatcgcctcagaaaccccgtagaccatcacggacgccgagctttagttaactctcacagtggaggaaggcaggaatgtcaggcctctgaacccaagccaagccatcacatcccctgtgacttgcacgtatgcacgtatgcacctagatggcctgaagttactgaagaatcacaaaagaagtgaaaaggccctgccccgccttaact

SEQ ID NO: 1948 - DNA, 300 bp, Homo sapiens
agtcaatgtcaattcctcaaagcagtctggttatatctgaaaatacatgattctagtcaaagccttggtgaaataaccagtgtttccaattgtgtcctgttacaaaacaaaacagattcttactgaatttatgcaaacaactacattgccataaagtaagaatactcatgaaaagtttccaaattctggagaactcaggtagaggggagaagtaaattttgctcacaaaagtatcctttacaatcagagtagcagtcttccaaacaggatgttgcccgttcatcatggaacggccatcca

SEQ ID NO: 1949 - DNA, 300 bp, Homo sapiens
atcaaacactacctgaaattattggcatgtggaccccggctcagaaacactgacataaagacttaaatgtaatgggatttgttttcaaaagatttgacttttctctgtaaaaaacacagcaacaaggcaacagggaatattaccaaagtttcccaaaggcttgtataggatttgaaaaagttgggggaagaatttaaccctaaaagcttaactgattttcaaacacctgcaaatacataattacagatcctgtgaagcttaaccttggtggtgttaaatgttagctagaatgtcacaagg

SEQ ID NO: 1950 - DNA, 300 bp, Homo sapiens
gtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcag

SEQ ID NO: 1951 - DNA, 300 bp, Homo sapiens
ccggcatgtctttctcccgcaagagctataggctgacctcagatgctgagaaatccagggtcacaggcattgggcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccagggacaggttgaagggcggcttggcccatccactgagggcctggaccacacaggcggctttgaggggcttc

SEQ ID NO: 1952 - DNA, 298 bp, Homo sapiens
  misc_feature (1)...(298): n = A,T,C or G
gtgcgcttntatgtnctcatagacntttttttnaatcccttttaancacctactatgntctggnntgcnggatcngntcggntctntccatgngacaacnctcnccacacgccaaccccgttcannaacgccctaanggggaacttannggggtgaatcccctgccacagaccccgnacctggagnaggacttgaaggangtgctgcnttctgangctggcatcnaactcatcatcnaggactacatcangcccnagaancataataggaancctggnctgcngcgganccncatcaa

SEQ ID NO: 1953 - DNA, 300 bp, Homo sapiens
ggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaat

SEQ ID NO: 1954 - DNA, 300 bp, Homo sapiens
cccgcctgcgcccaggtgaaatacacagccatgttgctcacacaaagcctgtttggtgggctcttcacacgggcacgtatgcaatttggtgccgtgactcggatcgggggacctcccttgggagatcaatcccctgtcctcctgctctttgctccgtgggaaagatccacctatgacctcaggtcctcagaccgaccagcccaagaaacatctcaccaatttcaaatccgaaggcaggaatgtcaggcctctgagcccaggccaggccatcgcatcccgtgacttgcacgcatacatcca

SEQ ID NO: 1955 - DNA, 300 bp, Homo sapiens
agcaagtcagcaaatgtgggagatggaaaactggcttcctccacccacctaggttctttggctgggctacaaattaaatggacataaaatagattaacaggagaaaaaacacagtaattatgtgtatatgcctgggagtcccacaaaatatgagactcaaaagaagggtccgaagagggaagcttatatagccccctgagccacagaaaggaatagggacctggggcttctggtgggtggtggagacaagttatggaagagtgaggggaggaagtgtagggtgagtaaatgtggtcttgt

SEQ ID NO: 1956 - DNA, 202 bp, Homo sapiens
  misc_feature (1)...(202): n = A,T,C or G
ccccagtgtcctccttcttctccggccagacccagccccgcgaagatggtggaccgcgagcaactggtgcagaaagcccggctggccgagcaggcggagcgctacgacgacatggccgtggccatgaagaacgtgacagagctgaatgagccactgtcgaatgaggaaccgaatccttctgtctgtggcctacaanatcgtt

SEQ ID NO: 1957 - DNA, 218 bp, Homo sapiens
  misc_feature (1)...(218): n = A,T,C or G
ggcagctccaagtggaatccacgtgcagcttctagtctgggaaagtcacccaacctagcagttgtcatgtgggtaacctcaggcacctctaagcctgtcctggaagaaggaccagcagcccctccagaactctgcccaggacagcaggtgcctgctggctctgggtttggaagttggggtgggtaaggggngactgngctacnncatannntttttat

SEQ ID NO: 1958 - DNA, 300 bp, Homo sapiens
ggtatgtgtagcggcagtggccgccggcggagcagtctgagcccgacgatgaggccggggacgggagctgagcgtggaggcctcatggtgagtgaaatggagagccatcctccctcgcagggtcctggggacggggagcggagattgtccggctcaagcctctgctccggctcttgggtctctgctgacggcttcctgaggagacggccctcggtaagggatcagtggggcagggggaaggcggcacattgaaaaacggagtgagaaacaggaagctttctccgaaaggagaagaagata

SEQ ID NO: 1959 - DNA, 300 bp, Homo sapiens
  misc_feature (1)...(300): n = A,T,C or G
ccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccaatggtgggtaattgtacaataaattttttttggacagatnnaaaagaaacaaaacttgctttacagatnctgaaaggcctgnnacaaggccnggnaattnggggantccgtcctgcattgngcangatgctcagcggcatccctggncacccac

SEQ ID NO: 1960 - DNA, 300 bp, Homo sapiens
agggggcgggcccgtacgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccagg

SEQ ID NO: 1961 - DNA, 208 bp, Homo sapiens
cagggccgtaggcagccatggcgcccagccggaatggcatggtcttgaagccccacttccacaaggactggcagcggcgcgtggccacgtggttcaaccagccggcccggaagatccgcagacgtaaggcccggcaagccaaggcgcgccgcatcgctccgcgccccgcgtcgggtcccatccggcccatttgcgtcattgccccagt

SEQ ID NO: 1962 - DNA, 300 bp, Homo sapiens
  misc_feature (1)...(300): n = A,T,C or G
agaaagattttctttattaatgaccccaaccgtatttctttagatacaggagttttgaacttccataattaggagaaaaccgttatgactgcattatcctgcaactcttacccgtaatatattgcaaagcgaaacagcttggaaaagagggtgggagaaaagggaagtgagggagggaagataaagaaaaggaattaagttgatcaagtggaattcttttttttttttaaattntnggnanctntnaagnttttgnanncccanntngttnnngcaaatnntttnccaancgnntccaaa

SEQ ID NO: 1963 - DNA, 300 bp, Homo sapiens
aggagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagca

SEQ ID NO: 1964 - DNA, 300 bp, Homo sapiens
gagaactagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatg

SEQ ID NO: 1965 - DNA, 300 bp, Homo sapiens
acaggttcccatagctacagaggtgcttttcaaacttacacagggaagtgtgaccttttaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttg

SEQ ID NO: 1966 - DNA, 216 bp, Homo sapiens
  misc_feature (1)...(216): n = A,T,C or G
ggagaacggggctgaggaggaagaagaagaaactgccgaggatggagaggaggaagatgaaggggaagaagaagatgaggaagaagaagaagaggatgatgaagggcccgcgctgatgagagctgccgaagaggaggatgaagcggatcccaaacggcanaanacagaanatggggcntcggngngagcccctgncaanaggctgncgntgggagg

SEQ ID NO: 1967 - DNA, 300 bp, Homo sapiens
taggcgtgcctaatgggaggtctatataagcaatgctcgtttagggaaccgccattttgcctggggacgtcggagcaagcttgatttaggtgacactatagaatacaagctacttgttctttttgcaggatcccatcgattcgaattcggcacgagaccattttattttttgggccattaccccataccccttattgctgccaaaaccacatgggctgggggccagggctggatggacagacacctccccctacccatatccctcccgtgtgtggttggaaaacctttgttttttggggt

SEQ ID NO: 1968 - DNA, 300 bp, Homo sapiens
gcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcacc

SEQ ID NO: 1969 - DNA, 279 bp, Homo sapiens
gtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgtgggaaagt

SEQ ID NO: 1970 - DNA, 206 bp, Homo sapiens
ggagacttaattttccaaacagtaagccttgaaaaaagaagccaagtaaatttgtttttcaaaattgtataaaaaatctataaaattttcatcttgaccataatatataagtttcataagccttttataacctttataacctttattaaggagtcagttagtgcttcaagaaaaccttgttaatctgacacaggggcccatttgcg

SEQ ID NO: 1971 - DNA, 300 bp, Homo sapiens
caggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactctgtctgcgacctgcttcc

SEQ ID NO: 1972 - DNA, 300 bp, Homo sapiens
catgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataa

SEQ ID NO: 1973 - DNA, 300 bp, Homo sapiens
gaaatatacttccttaaatgatggacattcctaaatccatctaggaatgttggatgtatctatctatctatctatctatctatctactgtattaagccccttctcaaaattgtagtttcagaagtatggtttgataattcataatcaagttctttttctttatgcccagaagtctgtattctgcacagacttgcatacccctagctgcgctaaagttcagaagtttgagctgccactgaagtattgactgtggagaggcggggttttctgtctccaatgaggtgcctttggtgtcgggaa

SEQ ID NO: 1974 - DNA, 181 bp, Homo sapiens
gttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggcccac

SEQ ID NO: 1975 - DNA, 300 bp, Homo sapiens
gcagtctcctgagccagagtgtgctcagacagagtccagctggtggaaagggacttatggagagaaaaagaaaagcgatgtagaaaaattgaaaagaggtacagaaacagctggattggttacagctcggtgtttgccttattttgaacagggtttgaacagttggccacctttggttgctcaaaacttggtgattggcacaagagtaggttacagtctgtttgcacatccatttaggttgcagttcactgtgtacagagaaacctttaggctgaacttaaaacgtgtaaggagacagct

SEQ ID NO: 1976 - DNA, 189 bp, Homo sapiens
  misc_feature (1)...(189): n = A,T,C or G
gtgggttaggggagccgcattcgcaaccacaagtaccgcagcctcaacgacctagagaaggacgtcatgctcctgtgccagaacgcacagaccttcaacctggagggcttcctgatctatgaagactccatcgtcttgcagtcggtcttnaccagnttgcggnntaaaatntagaaggangatgacagt

SEQ ID NO: 1977 - DNA, 300 bp, Homo sapiens
gtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatg

SEQ ID NO: 1978 - DNA, 244 bp, Homo sapiens
  misc_feature (1)...(244): n = A,T,C or G
ggggactctgccactctacccccagccctacccaccagcccccaggtgaggcttccagctgggacctgcccagacaggctgagcctgggcgtggtgggtggggtgatgnctctggngagcggctgtcatnctacaaacnncaccnnntnctttgagctntnantatggnacccagtgncttnntntgnannacanggngaanntgccnntcgnnnaccnncatncngggannnccccntttttg

SEQ ID NO: 1979 - DNA, 300 bp, Homo sapiens
aatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacg

SEQ ID NO: 1980 - DNA, 187 bp, Homo sapiens
  misc_feature (1)...(187): n = A,T,C or G
atgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggnggntganggntngctncctgnnctgnnngacng

SEQ ID NO: 1981 - DNA, 300 bp, Homo sapiens
ctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggtgggacatggacacagctcaaaaaggcagtgcctgccttactcctctggcttggaccactcagccttaagcgggacaataaccccctgacacttaaccctgtgttgagctatggggccatctctagcagagtcaagtcaa

SEQ ID NO: 1982 - DNA, 300 bp, Homo sapiens
ggggttgggggtgggaccctgggatggggggagaagcagctgtttctggagagagaaggggtcatggtggccccagactgtagagatttttatgtgtttggatacatctgctgtgtggaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgaaaaa

SEQ ID NO: 1983 - DNA, 300 bp, Homo sapiens
caatgaactactctgcagcctcattttttaaaaaatgagataggtaagtgtggatataaataactgtccaacatatatagctgagtaacaaaaatagcaaactagaaaacaatgtattattccatttgtgctgaaatatgtatgttggtatgtgtaaatatgtatggttgtatagacagttcttttctaaaattttttcatttttaatttttgtgggtacatactaggtatatatatttgtggggtacctgaggtattttgatacaggcatgcaatgtgaaataatcacatcagcataaa

SEQ ID NO: 1984 - DNA, 296 bp, Homo sapiens
gcctcatctcccactgagcaggtgccatcccaggagatgccactgttggcgagaccttcccctcctgtgcagtctgtgtcccctgctgtgcccacacctccctcgatgtctgctgccctgcctttccctgcaggtggtatgggaggtggcatgttctaactcctagactagtgctttacctttattaatgaactgtgacaggaagcccaaggcagtgttcctcaccaataacttcatagaagtcagttggagaaaatgaagaaaaaggctggctgaaaatcactataaccatcaat

SEQ ID NO: 1985 - DNA, 246 bp, Homo sapiens
cacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggag

SEQ ID NO: 1986 - DNA, 175 bp, Homo sapiens
ccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctcttttttttttttt

SEQ ID NO: 1987 - DNA, 208 bp, Homo sapiens
agccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccagcctctagaactatagtgagtcgtattacgtagatccagacatgata

SEQ ID NO: 1988 - DNA, 300 bp, Homo sapiens
cccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgca

SEQ ID NO: 1989 - DNA, 300 bp, Homo sapiens
  misc_feature (1)...(300): n = A,T,C or G
aatcagtcntttntancagtaacanaggacangtccntcgctnngctgtagtngtnnnantgtnggtaatactcnttgntcatcatgaaatgcagtgtaanggttgtgttcgcctattgannnttnaaacnncangtngtttangtnaaagnttancagatcttaaagataatcactgtgagnnnnttagagtaaaaattcgaaaactgaaaaataaggctagtgtactacaaaagagactatctgaaaaagaagaaataaaatcgcagttaaagcatgcaacacttgaattggaaaaag

SEQ ID NO: 1990 - DNA, 300 bp, Homo sapiens
gtgagccgagccgagatcgcggcacggcactccagcctgggtgacagagtgagactccgtctcaataaataaataaataaataaataaataaaataaagcaaggtaatgaaggtgaatgtgcttagtatgtggccagatacagagtaggtgctctgtaatattagttacagtgattgcctgctaggagtgtaggctggtgctaaaacatgacccaggtctagaaagacacacaatccacccctaactcctttcctcgtctgccactccttatccccaggattacttgttcttttatgact

SEQ ID NO: 1991 - DNA, 300 bp, Homo sapiens
gtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcatatctgccaagaaccttcgaattcatgaaaggacacaaacacacgtaagaatgcactctgtataaagaccttataaatgtaagatatgtgggaaaggcttttattctg

SEQ ID NO: 1992 - DNA, 300 bp, Homo sapiens
gtgacacagagacagagaaacctcccccacccagggaagcagctctgcagagttggcaggatcaggggctagtctgaacccctagcacagaacactcacctcacggaagagtggccagaatgttttccacataggtcctggtcctcacttctcctcactgagcagggctgcccaacgtgggacttctgcacaaccatcctgcccctgcctgaccacttcaatcagaggcagcctggcagttaaaggaacacccacacacagaggtgaaaaagaaccaattcaagaactccagcaacacaa

SEQ ID NO: 1993 - DNA, 300 bp, Homo sapiens
gccaccaccaccaccagccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgc

SEQ ID NO: 1994 - DNA, 300 bp, Homo sapiens
gttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccct

SEQ ID NO: 1995 - DNA, 300 bp, Homo sapiens
gggcacccagcgaagccaatcagagatggaagtagtgctctgagggtgggcgccgcttggtaccaccctcctcgccctcggtgtcctggagaaaggcggaaggaatgcggacctttttgaagtgacggacgcgccagcctatcaggggcgagctcaagagggcggggcggaagactgcaggaatgaaatggattgacagaccaaataactaatgagaggcttgattgagaacctacccgactatcagaggacctgtccgggaagagaaatggggctacgtccagacagaatctcgctctg

SEQ ID NO: 1996 - DNA, 300 bp, Homo sapiens
ttatagctgtgtcggtctagcattttctttgaagcatatggaacatgttctgctactcgagataatgaacatttccttctgcctcaaggtacaatcagtttatgatcctgggagagcaagaagcaaggagccagcaagtctggacacattccagaggccacgaggggttttatgtcctgagtcctggattccatccaagccatgaggggttttatgccctaggcttaggttgtagtgcggcggggcagccttccacccttaagcacagaacctggtgttccataggccacaagaagtttt

SEQ ID NO: 1997 - DNA, 300 bp, Homo sapiens
aagggagaggcagtaggactaggagttaaattgtcatgccgaggtctctgagcatgggtgggcctgtcagaattgtcatcgctcactctgttgacttccagcagctgacaggcaaggccctaggaagctcttcagcctcctttccttgctagaggtgctgttttccctggaaatgttcaagccctgcaaatcgtttctatagtaacaggtctctgtcttttttcttatgatgcagatttttgaaaaggtttcttatctaaatgttcttgggatctatggtcttcctacctgtagctcctt

SEQ ID NO: 1998 - DNA, 300 bp, Homo sapiens
aagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcat

SEQ ID NO: 1999 - DNA, 290 bp, Homo sapiens
  misc_feature (1)...(290): n = A,T,C or G
gggggacatcatagacaaagaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaaaaaaaaaaaaaaaaaacctggnccnttnaaanntntggggngccntttnncgaaannccaanctnnntaaaaccctt

SEQ ID NO: 2000 - DNA, 300 bp, Homo sapiens
gcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtactttttttttgagacggagttttgctcttgtagcccaggctggagtgcaatggcaggatctcagatcactgcaacctctgcctcctgggttcaagcgattttcctgctt

SEQ ID NO: 2001 - DNA, 300 bp, Homo sapiens
gcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtactt

SEQ ID NO: 2002 - DNA, 300 bp, Homo sapiens
ccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgt

SEQ ID NO: 2003 - DNA, 300 bp, Homo sapiens
caccagtggctttagggcctgtcgcttacgcgatgcgggtagtattgttcccgttgcgcagttgaggacacctaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcg

SEQ ID NO: 2004 - DNA, 300 bp, Homo sapiens
tttttttttagaacgtggtcttgtctctatcctctggacactgcagcgtacgagtaacaacaggtcttgcaggctaaataacttataaacaaaatttccttcctgaggagctaggtattccgatgtatcttcaacatagtcctgaagttcatatggcaatcgtccttttggcttctgaaatgcagaaggccatccagatttcggccaactagaggagtctgaaggaccagacaattgctcagaaacagaaggctgtttagaattttctaaattcattaagggcaattctggtacttttct

SEQ ID NO: 2005 - DNA, 300 bp, Homo sapiens
  misc_feature (1)...(300): n = A,T,C or G
gcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgnatctgncactcattccactacatnaagcacccggaataaagcccgnctnncccaatcggaaaaaaaaaaaaaaaaaaaaaaaaaaaaaaaaaaaaaaaaac

SEQ ID NO: 2006 - DNA, 299 bp, Homo sapiens
gcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcacccggaataaagcccgcctgccccagtcggaaaaaaaaaaaaaaaaaaaaaaaaaaaaaaaaaaaaaaaaa

SEQ ID NO: 2007 - DNA, 300 bp, Homo sapiens
gttcgacgctttgaaagatgatgacagtggggaccatgatcagaatgaagaaaacagcacacagaaagatggtgagaaggaaaaaacggaacgagacaagaatcagagcagtagcaagagaaaggtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctggga

SEQ ID NO: 2008 - DNA, 300 bp, Homo sapiens
cccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgttt

SEQ ID NO: 2009 - DNA, 300 bp, Homo sapiens
ctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactccgggc

SEQ ID NO: 2010 - DNA, 300 bp, Homo sapiens
gctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgatgcgtgctggcccccgcacaggctcctgtgtgcagggactgattcctcagcacac

SEQ ID NO: 2011 - DNA, 300 bp, Homo sapiens
ggccgctgcttctttcccgagcttggaacttcgttatccgcgatgcgtttcctggcagctacattcctgctcctggcgctcagcaccgctgcccatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatc

SEQ ID NO: 2012 - DNA, 300 bp, Homo sapiens
gcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagtt

SEQ ID NO: 2013 - DNA, 300 bp, Homo sapiens
gcccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctgcaggagccaccaggtcctttcgttccggaggccgcccgggcccggatgcgg

SEQ ID NO: 2014 - DNA, 300 bp, Homo sapiens
gcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccattt

SEQ ID NO: 2015 - DNA, 300 bp, Homo sapiens
gccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctgcaggagccaccaggtcctttcgttccggaggccgcccgggcccggatgcggg

SEQ ID NO: 2016 - DNA, 300 bp, Homo sapiens
gctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccatagaagaattgatggctcctacccttcttccagaactccatcttttaaagcacgattaaagtaaaaggcccaagatactgggaactgctcatagatttaagcaa

SEQ ID NO: 2017 - DNA, 300 bp, Homo sapiens
atgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaag

SEQ ID NO: 2018 - DNA, 300 bp, Homo sapiens
aagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttg

SEQ ID NO: 2019 - DNA, 300 bp, Homo sapiens; identical to SEQ ID NO: 751

SEQ ID NO: 2020 - DNA, 300 bp, Homo sapiens
attgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggc

SEQ ID NO: 2021 - DNA, 300 bp, Homo sapiens
aactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagggcagaatttttggaacagcattatgatagatttttcagtga

SEQ ID NO: 2022 - DNA, 300 bp, Homo sapiens
tccaaaaacaatgggcccaaggcaaaccagagccaaagagttttaacttgaaccccttcagtcaggatgaacataaagctctcaagttcttgaaaggatgagacacaagaataagatggggtaccagtgaccagctcctctacctggggtcatggaggaccgaagaccctccaaccttgatgcctgtaaggacaggcgctcctgtaagggatcaggtgtaaagaatctggccatagctcctgtacaaagcctctttgtctgaagtacttgggtgctctttgacggcaggagggaacacaa

SEQ ID NO: 2023 - DNA, 296 bp, Homo sapiens
  misc_feature (1)...(296): n = A,T,C or G
ctgaggcaggagaatcacttgagcccaggaggtggaggtttcagcgagctgagatcacaccactgcactccagccttggtgacagagtgagactctgtctcaaaaaaaaaaangggantcatttgggnnttnggcaaaaatnancntagggantntnncangacccnaganggaanccntgagngntcagnnccannntggggnctttttnnnggtttnttaaangnnccgnnccttnanggngggnnccncgnttngcnttggggggtntnagggnangnctgctttctttttta

SEQ ID NO: 2024 - DNA, 253 bp, Homo sapiens
  misc_feature (1)...(253): n = A,T,C or G
cacttgaacccgggaagtggaggttgcagtgagccaagagtacaccactgcactccagcctgggcaacagagcgagactccgtcttaaaaaaaaaaaaaanaanccccttttnanngncntaatannccnanttngnggcagnnttgnanngggaaaggccgtttaaancnntaanggtngaaaaaccntnaaanattntccanccnaccccttngatnttncanaccaaaaaannaatcccnaaacgggaaa

SEQ ID NO: 2025 - DNA, 294 bp, Homo sapiens
  misc_feature (1)...(294): n = A,T,C or G
gctacttgggaggctgagacaggagaatcgcttgaacccaggaggccgaggttgcagtgatctgagatcgtgcactccagcctgggggacagagtgacactccgtctcaaaaaaaaaaaanaaaagnnccnntttngggttnttanttttttccnaanaactgaacntatttgnacnnttnnatttttanaatgnttttttngtaanntaancnccaaaataattaannncntttaaangcctnnannaatnncctgattnnntggcnnnanccntttnntaaggggggatttt

SEQ ID NO: 2026 - DNA, 300 bp, Homo sapiens
  misc_feature (1)...(300): n = A,T,C or G
gctactcgaaaggctaagactggaggatcgcttgagccaatgagttggaggctgcagtgagctataatcacgccactgcactccagcctgggctgcagggtgaggtcctgtctctggaaaaaaaaaaaagggantaggtaaanggnncanaggnnaanttttnagngnctngagncttttgnagcccntgnttacccaaancntttnnggcctantngnaccntcncaaanagnntttcntgnantnaccaaatttnaggtnttcanaantngactccntaagngnncaantnggaaata

SEQ ID NO: 2027 - DNA, 293 bp, Homo sapiens
  misc_feature (1)...(293): n = A,T,C or G
ctcagctcttccggaggctgaggcaggagaatcgcttgaacccaggaggcagaggttgcagtgagccgaggttgcgccactgcactccagcctgggtgaccgagtaagactgtctcaaaaaaaaaaaaaaaaaaaaaaantngcctttnggtnncntnatttccnaaattnaannaanngnccnnttttggnaaggggggggnnaaanngnaaanccctttnttngtnngttcctttnnaaaagggncnntcnccttttnaaanggncntnaagncctttttnanaaatggtt

SEQ ID NO: 2028 - DNA, 300 bp, Homo sapiens
atctgttactacttcagaattgctggttgatgttaggcccctcctatctgtgctctctcagctacagtttcccgtttgagcatattcattcttttttatttttgctctgaacaaaaatattagagttacaatattactatattccaggccttgctagaaactggggataaatctatgaatatggtcgcttccctggaagacctcacagtccagggaagccaaaccctgcagacatgcagtagacttagtggtctctcttaaggttgcttgttgagttttgacattggagattatgtacag

SEQ ID NO: 2029 - DNA, 300 bp, Homo sapiens
gtgagaacggagatacgggaaaacccttggctcatggaagcatagccaacataaaccttttaagcaaaccagcgcagagttccgtcatagtgcaccatcatcagaaaccagggctcctggtgttccagaagttgccagagtttatgttacttcagccacttggtggggaaagcttttgaaatagatcatacatgcatttgtttttaatcagagtgcgttggccatgatggggttaatttatactgagcacatggcacccatatctggggtttccctcttggtcagggcccccattggcca

SEQ ID NO: 2030 - DNA, 297 bp, Homo sapiens
  misc_feature (1)...(297): n = A,T,C or G
gctcattccagctggtctatcgtgggcctcagaaggtgaagagggaccgtattctggggcccacgatagaccagctgtaactcattccagcctgtaccttggatgaggggtagcctcccactgcatcccatcctgaatatcctttgcaactccccaagagtgcttatttaagtgctaatacttttaagagaactgcgacgattaattgtggatctccccctgcccattgcctgattgaggggcaccactactccancccntaaggaaangggggcanttcannngccccaagaggga

SEQ ID NO: 2031 - DNA, 300 bp, Homo sapiens
gcgggaatcaatctgcactgacaccgcggcaggaactgaagctgcccaggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggacctgagacccgcttttccttttcccttcattcccttgagagtcagccataaacggaatacctgctaggttccaggaatgagctcacc

SEQ ID NO: 2032 - DNA, 300 bp, Homo sapiens
gccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcga

SEQ ID NO: 2033 - DNA, 300 bp, Homo sapiens
ggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgc

SEQ ID NO: 2034 - DNA, 300 bp, Homo sapiens
  misc_feature (1)...(300): n = A,T,C or G
gtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcgtnattcccnacagtcatccccatagccctctgaggagg

SEQ ID NO: 2035 - DNA, 300 bp, Homo sapiens
aattttgccatcttttatcaggctttctgtgtcgaggacgctacccacatagagtagaagctaaagggaagggatgtgaagtgacctcaccctcagcttctagctcatggtgtcaaggcttgtgtgatcttagacacgtctgcctcttctgagcctgtttcttcatctgtaaaacagggatgggaggttgtggtaaagattccacagcaacactgcacacgcatgaagtacctgggccagggatgactcggcagacctcagtttccctctgcctcctgcctagagctgttagcaagcatc

SEQ ID NO: 2036 - DNA, 300 bp, Homo sapiens
aatgtctctttcaaagacactcagggctgaatcagccttaggatgctaagcaaatcattccgtaggataggacacagtcacatagaagctacagctgggaaaggcagaattcatagtagagagtgctggtccacctagaggccagcccaagaggccagaggtggccatccccaaaagagagatggagagagtatttgctttttttcctcagatgttttcccaaatccccaggaagcccagtatctctgccttttcagtgaagcctctgtcttctagagtatgcctttcccttcatttgaa

SEQ ID NO: 2037 - DNA, 300 bp, Homo sapiens
tcttcattcaagttgtagatgaaaaggcagaatggagtggattcagagccgtgtgacgtgccgtcagaggcttcctgttcttcctcctcacttcagcgcaaagtgccagacccaaaaaacaggatttctacctgtctgtgtgtgtcgtccggggctgtttcttcatcttcccatgtcttgattttcaccaaaaaaggaggctgttaatacttgccttcttcacttttacatagagatatcataaagattatgaactaaagcagcaaagtacattgccttccaaggagaaagtgttccttg

SEQ ID NO: 2038 - DNA, 300 bp, Homo sapiens
gtaaaacaccccctacagttccaattctgggcctgtcttctatctatctttgcccttctggtccgttccctgttctgagccccagggaacttagggctgaaagtcacccccgaagcctcagaccagatcgggaggccacacgcagctcatggggacagagggcccagggtgacggtccactcatgagaagtgctatgtgactccagggagtctgtccctctccgggctccaatccccagcccaagctcagatgacccagcctgtgtccctttagcggccgaggagccaccacctgttcgg

SEQ ID NO: 2039 - DNA, 196 bp, Homo sapiens
  misc_feature (1)...(196): n = A,T,C or G
gccaccttctaagcaagtgatggcctggctggttcagtaccctttgcaccctgctttacaanngaacttngtncactgtttnnnaggtnnatanctgagtnnacacacttntgcattngataaatggtactgngattttctngnaangaanaattnntgttgnnaggnaatggcatcanaancttgnanaanaggt

SEQ ID NO: 2040 - DNA, 286 bp, Homo sapiens
  misc_feature (1)...(286): n = A,T,C or G
ggaaggcactggtccgagaacaccggattcactgcgtgctgtcctcacttgttctacaatgagtgccaaatctgctatcagcatggaaattttngcacctctngatgannggatgctngnanccnnccnanagacgnanncnatctcaanagctccctngaatngntttgcctnnncnngtncannantnccnctaacagaggacctggcncaccttancngnnacattcaaatgactnnangacatcancatcacannctncagttggcacttatctgngtaact

SEQ ID NO: 2041 - DNA, 300 bp, Homo sapiens
ctcagccaccgtctccttacctgactcctctgggaaagagtttccctaggttaagccatacagggatagggtaggagatgccatttggatctaggagcagagggcagagcctcagcaggaagagtgtctctttgagaaggagacacagtggagcaggtgtgtaggttcacagggccagctatgggtagagtcgggtgtacatttttagaagccacaattcccaaaaatctcctgactataacatcagtgcacagagccagtcaaatggaggaggagtgggtccaggcaattcaggaagaa

SEQ ID NO: 2042 - DNA, 300 bp, Homo sapiens
gcatccgtggcctcggcctggagagaaaccaaccagctttgctgtctggcttgcggttccgctcctctgtgaggggggcgagattgcccgttctcctcgaagaatgccgttacttgaggcccaaaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctgga

SEQ ID NO: 2043 - DNA, 300 bp, Homo sapiens
gcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtca

SEQ ID NO: 2044 - DNA, 300 bp, Homo sapiens
gtgcatcagagccaggaggttccagacttgtcactgtcacgtcaatcttgtaactttccaacaggtcctccttcccagaaaccaaatcagattttctacttgaagcagtaccaagcctctggatagagcttcgagggaaggattttggggtcatgggttttttccagggaggctcgaaaaaagcttcccttgcagtttgagtttgaaggctgtagctcagtggcagatcaggacacctaggaacatttccaaggaagtagccatttctctcccagccttgaaccctgatctctgggttct

SEQ ID NO: 2045 - DNA, 300 bp, Homo sapiens
gcaacctaaagtaaatctcacatcttggcaatcgtttttaaatatgatcgtcccatcttgatgtgctgctcctgctgtggaaggtatccctgggttttaggcaagcatatgtgttctttactatggctccagatcccagcatatttgaagtcctgagtcaacctgctctcctagacaagcagacattaagtatgtcgcttgggctcttaagtgcgttctcctgacttttacccatctttgtggcagtaaatgcatacgtgtcactgtatatgcggactagatacctcaggtcccagcgcc

SEQ ID NO: 2046 - DNA, 300 bp, Homo sapiens
ctgatagcgacgcccgttgtattcagcgctctcccccggctgcaccttggaattgccgaagaagctttttttaaactccaaatgggccgggttggcgctgcagctctgggattcattcattcatatagctcgtatttattgagcacctaccatatgcctggaacggtgctagggaaacagcagtgttaaacaggtgaagtcctgcccgcatgaagttttacattgtagttcaggacacaataagcaggttgcagagcctgaggcctgtgatcagatgtacgagagcttaacgcgactcca

SEQ ID NO: 2047 - DNA, 300 bp, Homo sapiens
gcggagcttgcagtgagcagagatcgcaccactgcactccagcctgggtgacagagcgagactccatctcgaaacaaacacaaaaaaaagtatcaaagacagaaagtggaagttacaaggctttttaaggccttatcttggaagtcacagcaacatttattttgcattccattggtcaaactcaagtcctaacaggcctaagggggtcaagtaaaaggtgggactcacaggaagttccatatacattacagcttcacttgcagtacagaggggaagggaaatcctactgggacagaacct

SEQ ID NO: 2048 - DNA, 300 bp, Homo sapiens
aaacgaccacctttacgagaattctttgtcgatgactttgaagaattattagaaggtgagagaactctttaccacacgtttcttccagatgctcctatggtcccgtaaacaatgatatttttttctgcaaggctattttactttttaagagcagtaatcgtggcatttgccgcatgatgggaacccaggtagggagcgggtgatgttcccaggcagccttggtgtcggcaggtctctaaacctggttgttagtcgtcctctgtgggagttgattttgttctgtgacccaggtcaggtctc

SEQ ID NO: 2049 - DNA, 246 bp, Homo sapiens
ggcacatcttctactagctaacttggtccttttttatgaaaaaataaaacccttgcgtagttctccctcaggggatgcctaggattttggatgagaacgtattggctcaatgtgagtggggcagtggcaggcatccatttcccttccccccattctgtcacaggtgcccatctgcctggcagttcaatccagggctcatgttggagactccagagccccttccttgctggtgcctgcctgaggcat

SEQ ID NO: 2050 - DNA, 300 bp, Homo sapiens
acactgggctcaggggctgagccattgttgggtgctattacttgtgttgggaaccaataaggaacagaaaacaaacaaaaacactaaaccagagaagcgggcttattgaatactttgcacctaagaagaattaagaggaaaaggaggaggttagagttggtgcatctgctcctccggtgtctgagtgtgataagaaagatagatgttagaggtagcagaattgtgttgcaagaattaaagccaccagcagatgagacttggaccctaaacaattccccaggagaaacctgtgaaaaattt

SEQ ID NO: 2051 - DNA, 300 bp, Homo sapiens
gaaaaggccccagaatgggctggcttgaactggaaaaacacactttctcatcccttttggaccacgagcttcttgagagcaaagcatgtgtttgatattcctttgctcaccctcaggccttgtttggcaaattgcctgggatacagaaaataaggacaaggtctgggtgtagtggcttatgcctgtaatcccagcactttgggtgaccaaggcaggaggatctcttgaggccaggagttgcagaccagcctgggtaacatagtgagaccttgtctctgcaacaaaatttaaaaattagcc

SEQ ID NO: 2052 - DNA, 300 bp, Homo sapiens
ctacgatgaccccctcttcaggctgccatttggtagagggcaagggagtggctagccatcgagtaagaccatgctttgcacccaccatcagcaaggctcaagatagtgcctgcgtcctcagaataagccttcccttctgcaggtatctcatctccatctgtgggaaccaggtatgaggctctgaacagttcctgctctggcaagacacctccacatctttctccctcaaacattcatagcctctctgccattttatgcttctggtacaccagaaataatatcacaatgccctgcatcact

SEQ ID NO: 2053 - DNA, 300 bp, Homo sapiens
gggaaggtctggctccagcttgagcccactcacaggatgtcagggggaagtgtgactaaggtcacggccacgccacgtggtgggccagctggatccagagcaggggccgttgtggccacacatcctgagtttccatggtctaatgcagtgggcttgaaaaaaaagggtggatgcaggatgctggctgggactgtggagtgcgtgggcagtaagtcttaagtgacagtgggtggagattacagcatttcatctgcttttcctttgacaccttttaaagatacaacccacagttttcaaggg

SEQ ID NO: 2054 - DNA, 293 bp, Homo sapiens
  misc_feature (1)...(293): n = A,T,C or G
cacaaagccacagacacgcgaacgtccaagaagttcaaatgtgacaaaggacatcttgtgaagtcagaattacagaagcttgtccctaagaatgacagcgcttctttgccaaaagtgacacctgagaccccttgtgaaaatgagtttgctgaaggcagtgccttgcttccaggcagcgaggctggcgtttctgtgcagcagggggctgcangtnttnctnttggttgctgnatnagttgttngtntnttcatnnttttanttctanattagctttttntcttgntntagtgtt

SEQ ID NO: 2055 - DNA, 300 bp, Homo sapiens
caaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggtta

SEQ ID NO: 2056 - DNA, 300 bp, Homo sapiens
ccttgctcaggaggaggcgtttggcaaggacatttcacatggtttgtgggtgaatagtttcacaccagagtgggatcctctattgcatgtactcgactagcttttcattcttatcacacttcccttcctataaagttacgtatcttttaaagggaaatttaatacccaccttcgctttctgtgcggccttgtgaaaatcaggcaataacaaggacagccttattgccagtgtatgaccagagcatctagatggcactactagtggaatgtcatcttgtctaccattcattcattcattca

SEQ ID NO: 2057 - DNA, 300 bp, Homo sapiens
cctacctcaccaggttgtcgtggggagtgaacaaggtgagtggccctcacctacagactcaacatatggcctttggctcttcccacttccaagagtcttggaagggatgggtcgagcaagcagaggaaaggaagatgtgagttcccaaaatgctcctcacctttttcttctgagtgggctccttctcactggcattggagggcttgcggcgcagcatggtcctccaccctgggagactccgtccctgctctcctaggtgtcaagatgcagaggcctcttgcttagcctcaccagaactgc

SEQ ID NO: 2058 - DNA, 300 bp, Homo sapiens; identical to SEQ ID NO: 853

SEQ ID NO: 2059 - DNA, 296 bp, Homo sapiens
  misc_feature (1)...(296): n = A,T,C or G
attcaaagtacatttgacaacccactgcaagttgtggcatacatgggtgccatgaaccatgacaccaactacagctttcaggttcaatgtggcttaattgtggtggcctacaaagatggatcacctgcccacccacatttcatggatgcagagctctgttcccagtactggaccaagtggcttcttcgactagaagaatatacggaaaagannangaaccagaatattcagaaaccagaatattcagaatngggancaagttgctatttgggaacattcagcaccttctcacagtt

SEQ ID NO: 2060 - DNA, 300 bp, Homo sapiens
aagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcaca

SEQ ID NO: 2061 - DNA, 300 bp, Homo sapiens
agtgactacttagaagatgctgtccccaccttcgccccctccctctagttgcccaaatgtcttacctcccccagcttcactcgggctagtggaggtcttcttagacttctttcaaggcggaggatttagagtctggggtgaagtggcggtgatggatggctggggacgtggggctgctgactcaatggtgatacatcaagcagttaattaagggacaagttatcttctaagtgggaggtaaaggattttctggtcctttgttcttaatgctcatattaatgccattttccctcatggaga

SEQ ID NO: 2062 - DNA, 300 bp, Homo sapiens
gtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggatatatctgtaacttgccactgccccgaaatgaaactgatgccacatttgccacgacgtcacctataaatcagactaatgggcacccacgctgtattgtcagtgatag

SEQ ID NO: 2063 - DNA, 300 bp, Homo sapiens
gctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtt

SEQ ID NO: 2064 - DNA, 300 bp, Homo sapiens
gagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctaga

SEQ ID NO: 2065 - DNA, 300 bp, Homo sapiens
ccgtgcctcgctttccctgtcccccgccctatggacacccctggctcaggccagtgtgcttgtcccagcatcgcgctcatctcctgtttttatttgatgttacagatttcatttcattaggaatgagtgtttcctccccgacttttgcctgcattcttttccagctcctccctggaaaagggcaggggcggacactttcccagcctcccaccgtgctctgttcctagtggcacctgccccagggtctgggcccctagggatgcgtcctctaccctggagactgggatcttcttaaatccc

SEQ ID NO: 2066 - DNA, 300 bp, Homo sapiens
tgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgca

SEQ ID NO: 2067 - DNA, 300 bp, Homo sapiens
acattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcc

SEQ ID NO: 2068 - DNA, 300 bp, Homo sapiens
gtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaac

SEQ ID NO: 2069 - DNA, 300 bp, Homo sapiens
agctgggggtgactacagctcacctgcagctggtgagcaactcaaagcagagacccaggtgagccgggcctggacccctgagccaaggaaactgtgagataacaaatgtgtgttgtaagcagctgactgttaacggaaattttctaggcagccataggtaaccagtacaccatgctaggtcagattaaatgtcctcagattagcatcccttccattccctggttcctgaatgtggccatgatttttaatgcatgaaagagccatggcagggagattatctgtaggtcaataaaatcatac

SEQ ID NO: 2070 - DNA, 300 bp, Homo sapiens
aattcataaaaggagttagttgcagtcatgtgtggccttgtctagaagcaaaaattataatatcaaaagctctacgtatgaattgggccttaatgtctttgtactcatttattcttttattgaaaaaaagctctaaatgcctattttgtgtcacataattgagatttgctttgaaatgtctgattctttactatagtactatctgagttgttcacagtggtatggtgatccatactctgaactgttccattatctggaattaaaggcatataataaaaagaaatagactgtatttagttt

SEQ ID NO: 2071 - DNA, 300 bp, Homo sapiens
acagatcctccctctgcagatggtgagcagtttcccactcggctcttttgattgttctgcaattttcaatgaccatggcacaaatttatttaaagctgaaatacttcacttctattaaagcagttggctgggtatattgtttttgctgaaattattactctaggaggtaaatctaggctttatttactactttgggaaagtacatttaaaggccatgaatcagaaactaggttacaaacgttaagactcaaaggatctgtatactgaggcctatatttccatgaagtggttctctactct

SEQ ID NO: 2072 - DNA, 300 bp, Homo sapiens
cactgtggagtccctgcaagtcagcaggaccagggctgtcttcctgcaccatctggatttggttagctctctctgggcagtggggccgagtctcatttcctccaacaataatgttatataggcaatgatcctgggctgccctaacataattgaaaattatgtgtattgtaggcttggagtgctgaaatgtgggctcataaaaatatgtggtgcaggtagcctatggagattggatgtggcacacaatgaagctttatgtaaagtaagaactataagtctccatgttaatattgtattatg

SEQ ID NO: 2073 - DNA, 300 bp, Homo sapiens
gtgacccttcctgcccttcttgagcagcttgtgaaccagaagatgtgcctggagagaaagcctcatttggggaagtgcagtagtcgaagttctttattttgaaaatggagaacaacccttctcacaatcctgtctccccttccccctttccaactagaatatcagctcccctgaacatgagtcagtcacatttcagggaaaactggctgatgttgaagaaatcacttgagggcaaactttgtccttcaagctgtgggtctctgaagtgtagagccagcagatcccccagtgtagggactg

SEQ ID NO: 2074 - DNA, 300 bp, Homo sapiens
aaagacttataagccctctgattgagctcctttgttgttgacttcttgatcctctttaattcaggaatcacagttagatttcttagaatccttctttgtgctccaagtatcaaagaccttatggggctccccagccataatggaaaaagtaatttctttaacaggggagacaccagagcaagagcggagatgggggtacgagggggtcctcatttatgcagctggccagagctcctcatccaacccggggcttagtgaggtgacagatgtgatgttggccaatgtagtcttccttttctt

SEQ ID NO: 2075 - DNA, 300 bp, Homo sapiens
attttctgaaaatctcagttgggccagtctctgagccagatatgctaacttttgcctgtgggattatgtgatttactggggtcagaatagtcaggtatttttatagtaggcagttttactatatgctatgtggacaaattgaaaatgaaggactgagttttttttttcccttaaatctaattggagatacaatacatgaacctacaagggaacatttactcagcagcatattaattagtgccaatttaaatatttgatgattgctaggtagcaaagaattctctagatcctgaagaattt

SEQ ID NO: 2076 - DNA, 300 bp, Homo sapiens
cccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctata

SEQ ID NO: 2077 - DNA, 300 bp, Homo sapiens
aagacacttcctctccggaaagccagtcatattcatcccagcgtctttcttggtgtctgtgcatggataaagcctccccattcccccgtgccccccaccactttgtgtcctttcactttgcttcacttatgtgcccaccactccagggctccctgaggtccaggaattccatgccattccctttcacatggctgagagccccagccctgtggatgagctgtcctgagtgggcactcagtaatgtgggcgtaactgaaccaagctgaagagggaaggagcaaaaaacaaccagaagccctc

SEQ ID NO: 2078 - DNA, 300 bp, Homo sapiens
atcatctagaatcccagcagtttccttaagttgcctactgtcaattttccatttctctcgtccaaattcacatggagacatcatttttacacacttgtaatcaattgtaggcggagtctggggtcctagcacttcccctaacatcatctcatgatacttagacttttaaagaacccttgagtaggccctgtgataaaggatgttagtgaaaaaaataatgagaaacagggacttggcttagagaaagaagcctgcgtcagatcagtaggcccccctggggctgtggaagcatgcagaagg

SEQ ID NO: 2079 - DNA, 300 bp, Homo sapiens
agtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagact

SEQ ID NO: 2080 - DNA, 300 bp, Homo sapiens
aggaggcgcaggcgcagcacaggtggcaattgaagccggaagaacatctaccaagagcagagaacccaggaagaaaattctgcctctttaatacgttccaatatggacgttttccatatagatacctatctatatagatagatgctctgggatctgacggtcctggacacctgtatggctgtgtgctgtggtctttgcctagcctgcggttcacttttgctctggccaccacctcccctcatgtacaaaccgcgtctctgctctgccagtcttggcccccgtcaggcagcggttcactcc

SEQ ID NO: 2081 - DNA, 300 bp, Homo sapiens
gcttgtgcttccacctagagctgcaaagggcagcgggcagaaaccgggctggggctggcattagctttccctcctcccagtttctctccagcgcagcagggcacctctagcccagaaaaagaaaactgactttctcttatttctgttttctgctgctgctaatctcctcctgaagggttgtgtggcttcttgggactctggaaagaaactgcaggggacgaggacaaaggaaacagctactgtagtcactgcagctatgcaggctctgtgctagccctggaaaggcctggacgttcaggt

SEQ ID NO: 2082 - DNA, 300 bp, Homo sapiens
ctttttcaaagtgttgatggtaatctgaggcaatctaagggagtcattttttaagtgactttatacagaaagattggtaagagccaaggggtagaagtggcataaatgtctaaagcagggaagtgacaggactttcattgttcttggctgaggagaagcgggagtggctgatggaagcacctaaatgatgcctttgtctgtgggaaggcaaatgatgccccagagctctaaccaaaggttttgcagccgccgaaaaacaggaaagttgggaagcgggggtaggactacactgaatcatta

SEQ ID NO: 2083 - DNA, 300 bp, Homo sapiens
caagaattgctgctgctgttttttttttaattttattttttatttttaaagactttcctaccttctcattgagagagagaaagatgcccagagttaaaataggaggtgcttgggtattttgttgaacttcacaagttaaactggcgaatggcgtccatcagctgttattcagtccttgaacagagcagatatgtttgtgcgaggacaaagaagatgcctcaaagacaaagaagaagatgcctcgtcgtcccctgagctcccacacggcatctgcacatcaccagctcagcatttagcaca

SEQ ID NO: 2084 - DNA, 300 bp, Homo sapiens
gcctggcgaattttttttgtatttttggtagagtttcgtcatgttgcttaggatggtctcaaactcctgagctcaagtgatccacctgcctcggcctcccagagtgctgggattacagtgtgagccaccatgcctcacctagggtgtttggtttttaagtgaaacatgcacatggtaaacattaaaaccgtctaaaaggctggaccatgaaaagcaaggctcccttctcccacccaatccctgaattctccctggagagtatccctcctaagtgcacgcacttccactctgttccatttc

SEQ ID NO: 2085 - DNA, 300 bp, Homo sapiens
gtgcacctttcaaatagtagggaaaacaagcatcgcctaatatgttgtgagacctagcaaaaggaaccctaggaaaggaggcaggagacctaccctctgatttcagtagtagaacactgatttgctctgtgatccttgaataactctggtcctcaatttccattaccctgactggtattttaactgtaataattcttccatgaatctggaagtcctttctttctttaagaaacagggtcttgctctgtcatccaggctggagtacaatggcgtgatcacagctcactgcagcctcaaatt

SEQ ID NO: 2086 - DNA, 300 bp, Homo sapiens
gcctaaagtaactgaagatccatctggacgtatacgtgcaagtcacaagggatgcgatggcttggcttgggctcagaggcctgacactagttattataaaatgtactttcagcagtcttctgggacttgactaccttgtggattgtactagaaatgtcaggtatggtgactgctctgcccaccactctaaatgaaactgtccccccacagtctctgttgcccaggtgtcctatgtccctcgtcacagctgaatggaccaaggcagatgtgctatcaaggacagccaatcacaagtgagca

SEQ ID NO: 2087 - DNA, 300 bp, Homo sapiens
agacagtgtactgggagaggctgatgaaagctaagacgtgtaggatgtaccacatgccaagttatggtcatttcatcctcacagccctatagctttagtactatgactgtctcccttttacagatgaggaaactgaggctgagagatgttcagtaagttgcacaaagtcatacaagtgggggcagagttgggattcagatcttgccattgtgcagaaggggtgaacaggtgggttctagagtccttaaaaggtattgaagggttttgaagcaaggggacgaaatccttggaccaacattc

SEQ ID NO: 2088 - DNA, 300 bp, Homo sapiens
accatcttcactctctgggaagaaataaggtgggttaccatttacatcccagtgataagggccagtttgatcattccaaagatggttggttaggccccggccctatgccagctgtacacaaagcggcaaatggacactcaagaaccaagatgatatcaacctccatcaagacagctcggaaaagtaaaagggcatcagggctgaggataaatgattatgataaccagtgtgatgttgtttatatcagtcaaccagtattaaaggcctgcctgatatacaaccctcgaatgcaacacagtg

SEQ ID NO: 2089 - DNA, 300 bp, Homo sapiens
gtgagccgaggttgcgccattgtactccagcctgggcaacaagagcaaaactctgtttcaaaaaaaaagaaagaaagaaaattacctggaattcaatattgccatcggctgatttaatttctaatatgaagaaaggggcagtgtgatgtgccatggagcatccacaacctgccatttcagcccagccaaccttagaaagccattgaaaagagttgtttttaatggtgtttttacatccagcttcccacacctcaaatacttggggtggaattgttaatctcacattgcagtacaatgaaa

SEQ ID NO: 2090 - DNA, 300 bp, Homo sapiens
attatagctctatccatacaatattgtgattgtctctggtcttgttgctttcctgcactagattgtgagcaccatgacattagggatcatatcttttcattgtactgttagctacacataacagactgcatgctatacgttggtaaatgttaattaaatgaatatcttctcaggctagcttttttgatcgccccaacgccttggctagttttctctcatcctgcctcagattgctgtggtgatgcgtcccgctagcacctgcagagacagccctgttggtaatgttggccacagtgccag

SEQ ID NO: 2091 - DNA, 300 bp, Homo sapiens
cagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaa

SEQ ID NO: 2092 - DNA, 279 bp, Homo sapiens
  misc_feature (1)...(279): n = A,T,C or G
gttagactgaagaagattaaagaggaaagcagagactggttaggttattatagtgtcctaggtaacagttttggacacttgtgnntnatgtcgnngtgntatcttcanncactgggccggagctgcagccctggangagggggcgggtcgaggctgtgtggngattggggtctccgcccccacgccctncccnggcanggnctggagctggncngangccaantgcctttnagtcnnttntgcnaanccctctngggtccngacgctntncnnttggcc

SEQ ID NO: 2093 - DNA, 300 bp, Homo sapiens
  misc_feature (1)...(300): n = A,T,C or G
cccatgtccagcttggtcccgcatatgtgggagtgtgtgtccgtccaggcctgtgcctcggcccacagcaactgcttcgtgtgctggagacgcccagaccgacaggcgaatggttcgagtgcacctcgatccgagtctcagcacctagactaattaggatgacctcagagatgctgaagagtacctttggtcagcctcagtctttttgtttttggttttttttgagactgtgtctcactccgtcacccaggctggagagcagtggtgcgatctcagctcactgcagcctcancctctcag

SEQ ID NO: 2094 - DNA, 300 bp, Homo sapiens
ggccaatgggacccagtgtaagaaattgcacctgtcctggcagatagagaaggtggaagcagtgaatggtagagcatcctcactcttctctctgccagcaagcacctttggggaagtcctcacggacaggaatgtcgtgtgtcttggcttgagatgtcaaagaaacatgttggacacaccatggtgacagagcaggagtctcttaaccccggcgtggttgaggctgccgttctggtgggatctggggtcagtcaggggttaacagtcgctcctgcttgcctgattgacacagtaataaag

SEQ ID NO: 2095 - DNA, 221 bp, Homo sapiens
  misc_feature (1)...(221): n = A,T,C or G
cttttctccaccttgccctgtctcagggaagaaggaactgcccttctccccgtggggacctggctgcctgctctgacaggtacctgtcatctgcccaccatgggcttctgggacctgctgtagcccctgccacccactgctgcagacccacccactctcagcttagctcaaaggctgttctctaactcatttctgagaataattgnanggctgnagtngca

SEQ ID NO: 2096 - DNA, 300 bp, Homo sapiens
ggtgggcaggcagctgcacctcattcctgagaccatccggggcagggcttttctgactgagacacacgaccctgacaccagagagaattctgtatttccccacccttgcaggggctgcccctagagaatcccatcgggtgagcccaggaacccacaagttctgcacccctcggatgggtaggcattttgagggcatgaggtaggcgttacagtgataagatacacagggctctaaaccacagaggccccggttcaaatcctgcctcttctaagtacaaattagttggctttgggaagtga

SEQ ID NO: 2097 - DNA, 300 bp, Homo sapiens
cagccatgcacaccagccctgcacggaagggcttcctgatcctggctcatggatatagatacccttgagtgcaaaactgtcctgtccgaagtagaatcaaatcacttttctctggtcagctctggtgttcaacaaacactacttgtggttgaaaaagtgctggatttggaaaccagagaacccctagctgggtgaccttgagaacaaggagatgatagtcctcattccttgcaaggtgtattggagacgggtgaagggtgtggctgtgctggaagctcctactgctggcctttgccccag

SEQ ID NO: 2098 - DNA, 300 bp, Homo sapiens
ctccctctgcttcctcaaacccaggcttcgctgcctctgcggagttcttacctgtctctcctttccacccgggttccctggaggaagctaaactcagaccaaggccctgggctccccaggagttaaaagggaatacgctgtcccaagattctagaatgaagagtcaacgtagcccgagtggcttaaacctcctgtccttaaatgcaagaaatgttttctatcgagccctggacaggtgtctctgctggcctggggttttcaacaggtcatgcctgcctcagaccccagggacaaatgttc

SEQ ID NO: 2099 - DNA, 300 bp, Homo sapiens
ctctgttggagattgggagggggcctatgcatcatgctttctgtagtgcaaacccctaaccatgtgccagcactagctagtgagatctacagatcatcgcctcgcctcattaagtcaaaggcttcaacttctgcttccacaagtcatctttttgttcactctctgtaaaataatcaactcacgccctcaagtttctgctgtggagttgaggtgacaatatttcaacagaattgatgccatatggaaaatcccaagctagcttttgtacaagtacaaaatcaaatattcaaaacagatgag

SEQ ID NO: 2100 - DNA, 300 bp, Homo sapiens
aattgcttaggatacgagtctgtgctgggtgaccagaacttgacacatacacaatattaaatttaaaaggacatttaaattactcattagtcagggccagtgttaaccactacccatttggccagtgtcctctaaatattatcatttattgtgttattgcagctggggagggagaaaatgacagcatcccaggggtaagatttaatcttgaattcatcaggaaaatgacccctgaacatccccgagtctagccctcatttgagaactagtcctgctaattatataccttccccgtaaagt

SEQ ID NO: 2101 - DNA, 300 bp, Homo sapiens
cactgtcctcctggagcctccatttcagtcatttacagaggattgcgccctccaggactccattctcttgtgctgcctgccattggagcattgtattcagtggcctcccacagagagtatcaaaactaacccagtatgtggagacctatgtcagtctatttatttttctatctctgtggggctggagaaggaaataaacataaaactaaagatttaaagattacttttgatttcacttagtttttttataacatccttgtgttatgggtagtttcagaatctcaagaatgagcagagaat

SEQ ID NO: 2102 - DNA, 300 bp, Homo sapiens
gctatctaaacctaatcagacccatgctcttgtcccctcaagagcactgttatctccattagcctcctcatagaaaatttaagcagccctctctaggacatcaccagttcatttccaacctcagctgccagcagggagtactcctacactgtgtaacttcagcctctcgccgttctgtttgaggaaacttcctcccctcagggacccacacttggggttcctcgagtgtgtagtccagagggtcccagcctttatcaggagccttgcctgtaagagaagccttgcctattgccccctatg

SEQ ID NO: 2103 - DNA, 300 bp, Homo sapiens
caaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgagtttccaagctgtcatccaatggaagtagaatcttctctttgaatcatatggtacaggtgccaatatgactgctgctatttagagtcagagaggtggaagtcactgggtcc

SEQ ID NO: 2104 - DNA, 300 bp, Homo sapiens
gaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtg

SEQ ID NO: 2105 - DNA, 300 bp, Homo sapiens
gaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacaga

SEQ ID NO: 2106 - DNA, 300 bp, Homo sapiens
ctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgtgaaaatgaa

SEQ ID NO: 2107 - DNA, 300 bp, Homo sapiens
atctttaaagaaagcatccacagtttctgtgccatttcattgacaggttttattttaaatgtagacatccacagaggataggagctgcagcgtgtgctgctagactcaagagagaagtctcgctgactcatgcaggttgaggttttgtctcattcccaggaatgcttggactcccagaggcagtgaagccacacattttagcagaattacctcagcagtgtggtgcatgatcatgaacttcaagtttacctacaaggaagatttcattgtccttctgtcactagccaaacacttcacagc

SEQ ID NO: 2108 - DNA, 300 bp, Homo sapiens
ggacgttgtaggaggaagaggctgtaggggtaattggtagaggcaggtctagaagggaaggtcaagaagggaaactgggttcttccagaatacttttgaaaagttctagggaatttttcaaaggctattttgttaaggatattgagtagtgcttagaagatacagtctccactttgagggcgcatgaaccctctaggctgttgatgagagagtctgagcacttcccaggtttttctgcatctagacatgagtaaatggtgaagaacacttggttttgttttcaggttatatctgtgtcct

SEQ ID NO: 2109 - DNA, 300 bp, Homo sapiens
actgactcttccccctagagtttctccttgagaaacaaagtccctgtgatactttcctggaatgttgtatacatgaccttccccgaagggacacaagtgtttctggtgctttccaatgggaatgtgggaagggacccaggtgggccttgccactttgggattgctgtccctgaagaaatcccttagcctgatagaaacgtaattgttgggagcaatgaactgtgttgggggagaaaacataacttggcctttcttaagctgtatggctcagtggtctgagtttctgtagatctcttattg

SEQ ID NO: 2110 - DNA, 300 bp, Homo sapiens
gcagtagctgtggggatggagaaaagtggacaaattaattagagagatttagaggcagattggtgattgaattgagcagggcagtgagaggattcccaggtttctgactgaggtgtctaagtggggatggtgatgaaagggggaatattgggagaggatcacgtttggagggagactaaggcaccatcagtattctagagattagagggctgtgagagaattgtgataggagggatttactctttggcagatatccaagcgtggaaggcctgtttgatggactgtccttgataatcacag

SEQ ID NO: 2111 - DNA, 300 bp, Homo sapiens
ggcaagtgagatcttaaatgagagcgtgcaatgctcagtgtaatcacacggaggcctaactagatgaaatcagtaagaaagaatgtggtgtgtcagttcaagagttctgttatcttgagagccctggtgaccttagcttgctattcaattgagccaaatctgtattttctgaaggcagaagatgaaagcaaatgatagatgcttagatttgaggaggttatttggtgctgttgatatttttaaactttaaaaaggcattaaaagatctaatttaaattgcacatgtaaatgtggctgtgc

SEQ ID NO: 2112 - DNA, 300 bp, Homo sapiens
ggatgtttggcatcactagcctctcatggtaaatgccagtcatgctcctcagtcatcagaaccagcaaaaatactcctcacatgtccttagatagttgcaaatgctccagagaggggtaatggcactgctcctacttgagaaccactggctcctgtaactgcttggcctagttctaacttctaaaatgttctcctttcctgagagtataatgaagagccagatactttgtgatctttctatcattcctctggcttcttggacttccttaatgattgagctcagatgctggagtcacatcg

SEQ ID NO: 2113 - DNA, 300 bp, Homo sapiens
ccccacccattagttaggtgggcctgcccaacaccttcctgggttcacatccggccagacaagaaagaagccaaaaaactttccgtctaccactgcgcctcctcatgcccaccccatcctattagcctaaaatggaacgggctaattagtttatttgtatagggaggggtttcagctgcctggacaaaaccaggagtccactgtccaagcttcttctgttttcctgagctcagaagaaaaaaagtgtgttagactaagataataccgccttttgaatatctcggcttcatatttgcctcc

SEQ ID NO: 2114 - DNA, 300 bp, Homo sapiens
gtctcttggtgcgctttcatctgtcctctaaagcacaccctgcccctccctcctctgtcctcatgccgcccttgtgcgtggtccccagctgttggtgtcagggcaaggacaaagacccgggacacctcaagtctgagtcctggtgattgccaggccctggggaatgggggaagatgtggtcagaggctcttcttgtgaccggggcaggatgtgtcttctgctggaccggcaccttttgtttgtcccattggtggcagatgtgagcgacatcaggcgcttcctcagtgcatttcacgagcc

SEQ ID NO: 2115 - DNA, 300 bp, Homo sapiens
gctggaggctgtcagaaggatgctgggggtgaagacaccctggggtcctgacaaccattgggagtgtctggtgctcctgggtgagagagagggccagttggaaaagcctgcaggcccagccctggggcagaactgagtgtggcgggtgctgggcacaggatattcccccaggggcttagcttcatgcattcaggcttaccttgaggctccaagcttattggtggcataagctctgcagatccctcacctgccatcagcctcatctgaatctttgtctttcctcagataagcccttaggca

SEQ ID NO: 2116 - DNA, 300 bp, Homo sapiens
tccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatgg

SEQ ID NO: 2117 - DNA, 300 bp, Homo sapiens
atataaaagcgtttagaagaagaagcaaaagagacccgcacattccacccagggagggcatggagaaagaacagtgagtggaaggaaaacaggtctgtgctgtcctcaagcatagaggtctttctatggcaggcacccggggcagccaaaaggacactgtccacagccaggccagagtctagctgtcacacacataggcaggtgtgttgcatacctcaggcatgcgttcaggagttgtaatacttaagtgaatttgtttttttacagcaacaacctatagttccatttaaaaagggatag

SEQ ID NO: 2118 - DNA, 300 bp, Homo sapiens
gggaaagaaaataactttgtgaagccagtgtattctgtttttaaaactgtgcctgcagtgcaatactccttctggtgtattttatccattatttcacttgctggtcgtcatttcacagccagctttgacatgcccgtgaggacaggagccgccgcttcagttgtcactgcagagccatcgtatgtcagttgcaatttccatctgaagctatgtctttgacttcactttaagcagaaaattttgtaccctggtggtcgagtcttcccttaaaaattgttaaatcatttggctttaatggtt

SEQ ID NO: 2119 - DNA, 300 bp, Homo sapiens
gcacaggccacggagagagagaggccgggcctggatgaagccgtgggcgttggtgccgtgcgaggcccaggcatgcttggaggaaaggtcaccgtggctgtaaagtgctagccagggcgggagccgggcttgtgtttctcgcacagtctcagccatctgtcagctgcttcaaagggcattcaaaagtccaggttttgattgtttcttggattagtctgagtcgtgtggcctgccttatccaccctggaaagttctaggcaattaatatttatgtggcatttctgaggttttgatgccccg

SEQ ID NO: 2120 - DNA, 300 bp, Homo sapiens
gaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttcc

SEQ ID NO: 2121 - DNA, 300 bp, Homo sapiens
gaaacccccagctttagttaggtctactttcatgatttttcctggcatactgaaaaataggctttctctaaacataaggaagaatcgaggtgaaatgtgaacctctgccagtatagttattggtgatgctcttgcatttagtcataatttggaagatggcaggctgacccaaatgagcatttcatcactctgcttaatttacttagagtgatttgtgaatcctgtccttgtacacaggcgtacctcagataattcgagttctaatccagaccaccgcagtaaaataagtattgcagtaaa

SEQ ID NO: 2122 - DNA, 300 bp, Homo sapiens
gttcagcccaagacgttccattgatccagatggtgttagagcacatttggtcaggttgccttcatgggatatttgacaagctgcaaacccgagggcatgctggtgcccgagggcgcctccgtgctgacctcagcatgtgcagcaagagccagggcacaggggcggcctggcccatttcaggcaggtgctctgtgggagggtggctgtctccactgacaacccagggaggtcagcaaggaggagccctgaggtggactcgaaagctgtgggagctgatggccctcctggtctctgccacag

SEQ ID NO: 2123 - DNA, 300 bp, Homo sapiens
ccaagcagagccttggcattatagatacaggtttctaaaagctgatagcttggctgccagcctcatgggctggatcacccacaacttcatgggcctcttctagtggaagctggagcatttccttggtgaattcttttccctgaggggcaagatccatgccacacagctctctgaccctgtgtgtcacaacccttatggtccatgagcaaaatggttgctagtagtcatttgggcatttctcttctgttttcttatgtgtgtaataagatatacaaagtcgggcttgaagattagaaattg

SEQ ID NO: 2124 - DNA, 283 bp, Homo sapiens
  misc_feature (1)...(283): n = A,T,C or G
actgactcttccccctagagtttctccttgagaaacaaagtccctgtgatactttcctggaatgttgtatacatgaccttccccgaagggacacaagtgtttctggtgctttccaatgggaatgtgggaagggacccaggtgggccttgccactttgggattgctgtccctgaagaaatcccttagcctgatagaaacgtaattgttgggagcaatgaactgngntgggggagaaaacatnacttgggctttcntaagctgnactggctcaccgtgctgaggt

SEQ ID NO: 2125 - DNA, 300 bp, Homo sapiens
gaagaaactcccatgaagttcaaaggagcagcagatatgcagggtgcatctagaaatgaaaatctgaccctttgtccctctccttttcatctctcttttgtacaggccttctttccttctgtgcaaacagacccttgtcatagtcatagtccatcacgctgttaaatgatttccagcactgctctatgatgtgctgtaatttcagggagtagttttattttctacaacatgttgctctgtagcacgtgtatttcactactgagtggtagttctaatggacatattcttaacaaaatagtc

SEQ ID NO: 2126 - DNA, 300 bp, Homo sapiens
gtgacctgccagctaccagtgtttccgaaaatgagggtgggatgggcccatttgcgtagttggccaacagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttg

SEQ ID NO: 2127 - DNA, 300 bp, Homo sapiens
gctcattccagctggtctatcgtgggcctcagaaggtgaagagggaccgtattctggggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagct

SEQ ID NO: 2128 - DNA, 300 bp, Homo sapiens
cttgaggacttctttttaatgactttttcagacttgaggactcctttttaaagttgtagactgttccacctagatccttctggtcattctctactttgttgtggataaaaattttataataaattaggtaatgtttaaaagtggctttgtattttgtacatttgcaacaatgtgtgtattaacctctcctaattccatctactggcaaagcttgatttgatgagaattgggtcccctgcagtaatgtgactctgaagctgacggattagagagcttgtggttcaggcatgaaccttgtct

SEQ ID NO: 2129 - DNA, 300 bp, Homo sapiens
tgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatc

SEQ ID NO: 2130 - DNA, 300 bp, Homo sapiens
gtgatgctggtgatcaatggactggaagccaacagcagagacttagacccaagaagggagcttgaggtacaagaaaacttcagggtagacaggaaggaggcgtggtgaaagtgatgaaaggggagagtagaagggtggtccagggtcagacagggagttagatttaatccttcagggcactttcattacatcatagctgccattttgtcttttatctgactcaataataagtcagtaataagtaatgttttaattaaaggtaaatgcttggcaggtaggttaaacttcattgagtcccaa

SEQ ID NO: 2131 - DNA, 300 bp, Homo sapiens
accaaatgcacttgtgtatattttaagtgaaaagaagagaggactcggatgaccatgcttagttaagggggagggtgaccttttatatgcaagttgggaaatacagagaaagtgaaaggggaccaaaatgaaaacacatgaaataagataagcagagatgaaaggtggcactagaactgtaagaagcatttgaacaggcagaacagtgctggagactttaggagagggctcaagctgccatgtggccggtcctcaaatagttctagaatgactagcatatctttttacaaaactataagc

SEQ ID NO: 2132 - DNA, 300 bp, Homo sapiens
agaaatttttctgcatttttatatgctgaaactagtttatatcttgattccaaaataacttgttaaaatatatagtttaaaaccttgtatatattataaacttagctttgtaatattaagtatgaaagcagcaaagatagatagtctcagaagaagaagaaatgtataaattttggggagatgctgtgataaatagactagacttacctttgagttcctagcgatacctacctgacagcttccagctggaaaatctgcttggcaaggaaaggggaatatgattattgatgaacttccagc

SEQ ID NO: 2133 - DNA, 300 bp, Homo sapiens
gtttcgccttgttggccagactagttttgaattcctagcttcaagtgatccacctgcctcgacctcaccatcctagattttaaaccttgaaattttctagagctgcctcccagtgactttaacttactgtgtggatctgccttgctgccctcacttcttcatcttctcaccccgtcctcaccacttccttgtcttcttttggactggcttgtgtttacaacattggattagcagttgtaaggtcagcaatgaattcccaaatagcattcagcacctattttcagcccttcttaatttttc

SEQ ID NO: 2134 - DNA, 300 bp, Homo sapiens
gtggccagagtggagaggatgtgcagaaaggggcaggagatgaaggttggcagcagctggtcatgaaggtgttaacaaggggcctccactgggctgtgcggagctactgaagatgtttgcacaagagaagggtagggcatggtagacatcaaaactcctgggacctcggaggtgatcgagcctaacctggggccattttacagataggaagactgagatgaagacaggagaagggccatgcgtgaagtcacatagcactgggcctggctcctggggtaaactaaggggtagaaaagtctg

SEQ ID NO: 2135 - DNA, 300 bp, Homo sapiens
gtttgtataaaggttgtcagtttaatattcaagcaattaataaagacaaggtgtgagtttttctgttaatgcacctctgtcttaatgtgaagcaacgtataagcatgcatcttaccataattggtgtgcatgtctgtgtacatgggcacaaacatttctctttcagccctgtaatcacatctccaagtaatctaagtcaaaaagagcaaaatctaagccagtggacatgctgaggctatctcagggtcttctggaatgatcaaggccagaaatcccatcttcatatacattttttttttt

SEQ ID NO: 2136 - DNA, 300 bp, Homo sapiens
atctgttcagttctggcttgaaaatgtgtgtgccatactgtgacccacgggcagcccctcctcctctactgtgtcaggtggaccagggtcacctctgttctgcgcagctttgagattctaggattctacggccggcacgaatggcatgggagggttctctgcacgggacggcataacggcatgccatccttcaggctggcaggagcctgcgcaggtgtggcaaaatcttgaaacagcctgtgtcctgcctggcttttcactttcctatttaatataagaaagcacttttttttctgcttt

SEQ ID NO: 2137 - DNA, 300 bp, Homo sapiens
ggcagttctagatcttgtgctttaaactctggcctgcctttcctaattctcagaccaacaagtagtgttttcccattcgtattgcttatcataaaatgagagagtcttctgtccatcatctttattgaaagttgaaccactgtaagcaaaaataccaaggagaggtctgatcccactattgaaataaaaagaaccatgagggccctgcagaattcaactggaccttggggattactcactgaagaaggttttctattttgaatgtttattgtcttcctaccccagtctccccaacaagaa

SEQ ID NO: 2138 - DNA, 300 bp, Homo sapiens
ccggctttagtttttaatatatagcttagttggtcacatggtgcagatggcattccttcagtatttcgcgtgccagttgtctcagctaatagatatcagcagctggcaaggaccttggctgcactgcctgctgccccctcatcttcactggcacagggccctacacttagtcaacaggcagccaaaacttactgagtgaaggaaccaaaggcacaacttgagaactgtctatgtttgtgtttatagaagaggaacaataaagtcatcgactatctaaatataatgaataacaaaaaagaa

SEQ ID NO: 2139 - DNA, 300 bp, Homo sapiens
gaagaagcagcacacttattctcctgtacctctggaacatgtgagcaccctggttgttctgggctttctctgccaaggctgggaaactagagttctggcagctttgttgctcctttgtcttctgtgtgagccgcggtgtcatcagccaggtcaccccgcttgcagcacagtcgctgtgctctgggcatcggtggagcggggagctctggttgtgcacagagggccaggtgtagatgttgtgcacagaagtcagccccacccaggttaggctgagccgtcttccctgaacctgaaatggtt

SEQ ID NO: 2140 - DNA, 300 bp, Homo sapiens
agatgttataaaatgtgtaggcttttaatatataagttatttggctcctttgttttggcatacttaaaacagaagaaaaccacttctggggcagaaaagctagaactgatatcacagttccctctggtggctgctatgtgtcaattcgatctccttagaagaaaatagtgtagcctaaaataggtctttctttaccacagttagatccctgcagcaatctacttctcgaaacagaataaccattcaactatgacagctatcttaaaatcatagactgtaaataatattggtcacttctac

SEQ ID NO: 2141 - DNA, 279 bp, Homo sapiens
  misc_feature (1)...(279): n = A,T,C or G
gtttgtttcatgatcaaataatgaatcttaagagcagtatttctcacagacgcagaatgttccagcaattctccttcaggcacatttcctttgctgaaacctttttagcaggtccctggagcactcatgaacaaaataaaaaaaccagaaaccctgtaaccctggtttctattaaagtctagcttggggctttttttttttgacaaagggtcgnaangtcncccaggctgnagnggagnggngcagnctnggntnantgcaanttccacctcccaggtt

SEQ ID NO: 2142 - DNA, 300 bp, Homo sapiens
gcgacgtgtctgcggagcctttttatacctccttcccgggagtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggtaggcttccaggcgccggcttccctccccgccaccgcactgcacgcgccgacccccaacccccaattccccggcacttgggtcccaccctccccgggagggggcgtcgggaggaggagta

SEQ ID NO: 2143 - DNA, 300 bp, Homo sapiens
ggttagcagagccaacaagcaccctgggagaaacacacacttccttggtggcaaattggaaatcatcactgcttttctgtagacatttagccgcagatttgattcaaaatcctgttagtaggtggtgactgaaatagtttagtgggggcagggaacagcaagaggtaggaggaaagccattcagtaaatcccccaaatcccaatgtttgccctgctcatttgagcaactgctcccattgtcaggagaaggtcattcctgtatgaatgtttacatcacaaataaaatgaagcttcagtaga

SEQ ID NO: 2144 - DNA, 300 bp, Homo sapiens
gttactgatggagagagcagagaagctggtgtttgcagtcccatctgtcagccttgacacccctactcctgtccagccagtgtttctcaaagcgtgctgatgagcaatgcaagatgatttcatgttatagataagaataaaaaaattgttttgtgtttaactcaaattagaaaaaggcaacaattggtatgtgcgacctgtggttttgcagatgatactgcttaggatgttggtacttaagaaaaggtcaacttttcaaaaatactattagtgacatgtggacctagtcctcctgaagag

SEQ ID NO: 2145 - DNA, 300 bp, Homo sapiens
gccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgg

SEQ ID NO: 2146 - DNA, 282 bp, Homo sapiens
  misc_feature (1)...(282): n = A,T,C or G
gtgatgctggtgatcaatggactggaagccaacagcagagacttagacccaagaagggagcttgaggtacaagaaaacttcagggtagacaggaaggaggcgtggtgaaagtgatgaaaggggagagtagaagggtcacctcnnccccatcnnncacctctnncntctcnccccncctccttccnttctnctncancnagntcccncncctcnncacnttcntnctccccntaccccnncncntncnnncnnnccccancnacnggctcgccctcnagcttc

SEQ ID NO: 2147 - DNA, 300 bp, Homo sapiens
gattcatcttcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaat

SEQ ID NO: 2148 - DNA, 300 bp, Homo sapiens
gagaacctaacaaatgaatgtggtgggtaaggaagagaaagaagtagagatgaaatttccactctgactggggaaactaggtagatagatgatcatgaagaatctgaggaagagcagaagtcgtacaggtaagaatgaatgcattcattaatttattcagcaaaactgcctgaagaataccatgtgcagcactgcgggacaaaacagggcttgcattcccaggctgtactcttgtgaggacaacaagaaggaagtagagaaacacacaagaacaatgctaagatggggaaactccatacg

SEQ ID NO: 2149 - DNA, 300 bp, Homo sapiens
agaaggaaggaagaaaggaagggagggaggaagggagggagggagggtttgaagttaacaaatctatatttggtttggaaaatatggtcacatagctataggcattctgcagaaaacatcattccttgttaatagtcaaataacttaggaatttaataataattatacctaactcttattgagtacttaatatgtaccaggcatatagtatataaatatacctatatagtatataaaaataaattgtaaaattttgtaaaatatatataaatttttaatgtaaatatatttatattattt

SEQ ID NO: 2150 - DNA, 300 bp, Homo sapiens
cttggggccaggatcctggagtccttgcttggggataacttcctggagagctgctcagtcagctatacccttgggagtcttttgttgagggagaaataaatgtcattttgcaaagccactgatattctgtggttatcacggcagtttagagaggaaggatgggggaaagctgggttgcgctctaggccttgacacttcctgcctttgtagtgttaggcaaacatggcaaccccagaaaactcagctgcctcagttttaaggcatgcagggtctttgtgaggaccatataagccacgtgga

SEQ ID NO: 2151 - DNA, 300 bp, Homo sapiens
acagcattcgctgaccattctcctcctccacccaccaaggacaggagggctaacccaggcagagaacctacgctgagaactcaccaccagaaaaaatatctgcttttaaaagcacagtgcacaatagtactttttaaaagctaaaagagctaagtttaaagttaaagacacgtatgttctttgacacagatctcctaaaagtctgacaaaattagaagtaccagcacataaaaatagatgcccaagaatgtttattgaaaaaagctgaaaacccatgactatctcaataggacaatgaca

SEQ ID NO: 2152 - DNA, 300 bp, Homo sapiens
aggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagat

SEQ ID NO: 2153 - DNA, 300 bp, Homo sapiens
ggatggtctcgatctcctaacctcatgatccgcccgcctcggactcccacagtactgggattacaggcgtgagccactgcgcctggccgccaatagtgttttaaatggcacaaatttgaatgcctcccccttaagatcaggaaaaaggaaaggatgtctgctttcaccacttctgttcaaggttgtagcagtgagataagcaaaataaataaaaggcatccagattgtaactgtgcttttttacagagcaggatttataccaactggtttcacaaataattttaaagattcactactcaa

SEQ ID NO: 2154 - DNA, 300 bp, Homo sapiens
caattcttggctccccaaagcccttaccaaaataagtgagtaagagatggcgagtctttaaaggagtggctcatctttcctctccctggggcattttggtgtgggagactacaggggatgaggttaaaaagcttggtcggcaggtagaggatggggagagaggttagggccctgggaaaggtgagagatcagccagagacaggtttcccagaacagaatgtctggcctttgtggtgaggagggactgtggtatgagccgcagaagcgggccaggggtaaaccctcctgtgcgtccttcct

SEQ ID NO: 2155 - DNA, 300 bp, Homo sapiens
cagaacttcatatcctactaacatagaccacaacagtcattttcaaagaatactgataattctatggaatgcaatttaaggacattaaaagccttcttcttgggcatgaaatcttaccatatacaagctgggccctgaaagtttaatttcctttagtcctatttatggggcctatgattaacctgctgctctccatcctcttccctcatccctgggccacatgactaccaagtccaaggatgcctgccaccctcttgcatagtgccctttcctacaactgccaccaaactcagctgacag

SEQ ID NO: 2156 - DNA, 300 bp, Homo sapiens
attgccctctgctgcctccaccacaccaaggcatcgagacctctggcttctctcatttgctcttccctgtcccccaaaacctaccagcttaaccctcctttgtgccatgtcactggtgcctgtggctgcacgtaactggaatggaacatgccttgtttcccactcagccccctttaagctacatcctgaattccccaaaccactcttcctcgtacctgttctgctgcacccaggtgcctgcacggacagggaagcatcttttctcggtagtgcactgtgcttcagagactgggtccccct

SEQ ID NO: 2157 - DNA, 300 bp, Homo sapiens
ctcaattgtacatcgcaaatcccactcttgccctcctgcagtgtcagaggacttggctgtgatgggaataagccttggctctgttctccttgcatacttagcccatgggaacccagtttctggcctcaccaggaatgttgttgtgctttgagctccctgtggccttgcatgatgcctccgttggtccttacaggaggtgattggctggccacctcacttgctttctcctgtggacccttctttctctgtccttccttgaatgctgcctttgtccctcatgattatgctatcaacattctt

SEQ ID NO: 2158 - DNA, 300 bp, Homo sapiens
gacctttcctatagagaagaagagtagtctttgcaaatttgctttacattggtgaaaaaagtcatcatttcgaagccactcatttcatcggaattgggagggccaccatcttatagctgggcttgtgaacctttgacttttcccagtatatattggactattttgatcactgctatatgcttctagttcctcaatcagtatctgccacagaggaggccctctaaattttttgtggaattacttaatgaaatgaatgagtgattattcgccttcacaggattgtgtgagaccatataaggt

SEQ ID NO: 2159 - DNA, 300 bp, Homo sapiens
gcactagtgtatcttaaagtaagagaatgacttttattcaagaaatacacaacaggcaagtgccgtataccaggaattgttcaaggagagcaggtagtttgtcttatattctaacgtgggagaaagaaagcaaataaattacatgaattgattaattgatcagttgcatggcttttagtatacatttctgtcagtctgccaaccagcacaggtcccttattagcatgggagaagggcctgatcactgaaagtattatagatttatagagtattgaaaggaaacttaaggaaattgggggc

SEQ ID NO: 2160 - DNA, 300 bp, Homo sapiens
tatctattggcagcaaagactgtttattggtatactacaatatgatttaacttttattttggggataaatagtagaaaaaagtgaaacagaatgaaggcaggtgttttttattctaatgatggaataatacagagatactggacgatctctagcagttaattattgtgacccatataaaattatacaggtcacagtataattctctattaccgtttttacaccagtaagtcttagataaactaagcatgcttatgaattatgtatacagttagaatgcattatttttacagaggaacaat

SEQ ID NO: 2161 - DNA, 300 bp, Homo sapiens
ggttcatgcagtaagatttgttgtttatttgtaaatagaatggtattctatttcaaacttttaagacaaacctgttgccgcaaggctgatgcacattggatgatgactgttttctggttccagatcttgtctttgtgatataggagttatggaatgagccctggacaggatcctaagatccgggtttgttcctacttctactcattaatagcagtttgacatttaatataggaataatgttaacttgtcacttaaaacaagattctcttcatcttgttttcaagatttcaagattctttt

SEQ ID NO: 2162 - DNA, 300 bp, Homo sapiens
gttggccttttctcttcagatgtttacatgcaggaagtgcctttgataaagtatggtttgctaacatgagtatgatatgcatgcgcatttttggatgccaaacacataggcagatgaaactaagaagccagatgctaagatagttgttgatgaattgaaactagcctaactggctccactgttggagtcatttgctcaaactactccaaacttttgtttggtctactgaaaacattagttggaaaggtacagcgttaatttaaggcagggaagcctccagcacgtgagagtcgtgtctct

SEQ ID NO: 2163 - DNA, 300 bp, Homo sapiens
gagagaactagcctggatgagaggtgactgagaataacaactaattttggtgtctgaaaggctgccatggcaagagaatctttgttccatgttattctgtaatgcaggaatgagacaacctcatagaagctcttgagtgacagatttcagcacgattcagggagagcttgattggcaagaatctcagttacttttgtcattagtttcaatctgctgccttgcaaaacccctccaaacgggaaataagctcctcggactgagtttccattattctcctttatccagagggctcgtcggtgg

SEQ ID NO: 2164 - DNA, 300 bp, Homo sapiens
gtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggt

SEQ ID NO: 2165 - DNA, 300 bp, Homo sapiens
gcttaaggctacattaagtggacagactttatatggattctctaattttaatcttcaaaatgctatctaatgtctcattaagacttgcatataatgtatcttaagtacagtcattaaatatagtttagggagatttatgttcagatattgcttaaagatgttttaataggcccatttactctgatgatattaatgagctcttaatacagactaagcttctaaaactagtggtaaagactcccagcctgaacacaacaacttggaattaatgcctggtttggacagatgcctgagggtgag

SEQ ID NO: 2166 - DNA, 300 bp, Homo sapiens
gagaaaagctctcaggtaatctgtatggcttataagggaaacctgcagtcctttctgaaaggggagctgtgaatatgactgctttgtagaaagatgtcttaggattctgggtgaaaatttttaattcccctcatgtaggaatgtcacagagtgtacctttttgacttagtattttcctagtaaaatacacctttcttaagaaaatggctacaaagtcagatgcatgtaaatgctttcagcaagggtttattgatcatctgctttaggctgggctctatgttaggtgcctgtggattccat

SEQ ID NO: 2167 - DNA, 300 bp, Homo sapiens
  misc_feature (1)...(300): n = A,T,C or G
cctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtanaggttgtatgacattnngctaaganattanccccgatcaattgagaatttattggaacttncngtgcaatg

SEQ ID NO: 2168 - DNA, 300 bp, Homo sapiens
atttaatcttccataagatctttcctcagtgtcttttacttcttctcctgccatcagattcttaccttgattgaaaagccatgttaagtgcaaggcaaattctttacgtctttatacagagattaacaatctctgggtgatgggagcgttaagtgatttagctttgtcactagtagatgtgtgaggttagaaaagttgctgtcctttttgggtctcagtccctcagctctgcaattacaggcagtcttcattatttggtacaaattctatgtaaaattgataacacatatccagattaaa

SEQ ID NO: 2169 - DNA, 300 bp, Homo sapiens
aaggaacatttcaaactttgacagattcagaaggaatgatatgatgagcgccatgttcccttcacccatagtgttctgcatttggccagtcctatttcctctgcgcccccagctgggcgatgttaatgtgctcccagctgtcacatcaggccactgatagacgccacagtgtgggatgctactttcaaatgatatgttcttgtttacaagtcagtttcatagtattatgatgttaagagatttcatttcagaggtagctaagtttgaacaccagctctgtctttgaccagctgtttagga

SEQ ID NO: 2170 - DNA, 300 bp, Homo sapiens
gccacatagcaatggagaactgcaggactcaggtccacttgcccagcagctggcagggaagggccatgaggcagtagagtccctacaggccaagaaactgagcagaacccatgcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgac

SEQ ID NO: 2171 - DNA, 300 bp, Homo sapiens
gccacatagcaatggagaactgcaggactcaggtccacttgcccagcagctggcagccaagggccatgaggcagtagagtccctacaggccaagaaactgagcagaacccatgcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgac

SEQ ID NO: 2172 - DNA, 300 bp, Homo sapiens
attccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatg

SEQ ID NO: 2173 - DNA, 300 bp, Homo sapiens
attatacagttccccacattgaagttgggaagaagatatatggagagcagttgaagacataaggggctctggggaacagcatagttttgctttaattctccagcttgttctcagtaagggtggaaggagaaagagaggaagtatcgattttacagacgtcacatcgtactgctaagaacagacagaaaacttgttgtaataacccgtacacactgtaggagaactaaggaggcccctggtgtagcaatcattttcccaaggatgacggattgtgaggcaggaaggtgtgaaaagaggcag

SEQ ID NO: 2174 - DNA, 300 bp, Homo sapiens
gttagaagttcaatgtgagtttagtgattcccagggaagacttagggaaccttggtttctgagttgtgctctcctctgactacgtggtgagtcttagtctctggagtcagccagatccagatcttagtctcatggagttagccatgatcattttaaacttataattattaaagtgctatgatgtacaaaggtgcttatgaaactaaaatttgaggaattagatacaatgactatgcggttttgctttttagtaactgtttctcattacttcattgatccaaagtgagatttttaaagcta

SEQ ID NO: 2175 - DNA, 300 bp, Homo sapiens
ctccgttgaacgaagccagttgtgtagggtcagtgccattttctgtcacgatccagcaggggctccacctgcttttgaaaactctccagtggaaacatctactaactctgacctaaatcagtagctgctcaaaatctacagactactggcttaaaaccttggtaagtgcccagggtgtagtgaaagttctcaataaacgccggctggtggcgctgctgctactataagcaacgttaggagagcctgggtcggctgacacctgcaatagaaacctgtacgcaacaagttggatgtcacatc

SEQ ID NO: 2176 - DNA, 300 bp, Homo sapiens
gacactttcattgttgtgccagctggttgaaattaaaactctgatattactttttttgaggatttttatttttggttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatct

SEQ ID NO: 2177 - DNA, 300 bp, Homo sapiens
gacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagataagtcaaaaccccagcccaagattgggaaagcaggtg

SEQ ID NO: 2178 - DNA, 300 bp, Homo sapiens
gaagggtaaagtttccatttggggcctctggctcttggaaaagggcagtgtctctaaacccaggcaaacggtaaatgtggggcataggcaagagggtccgggtagtggccacttccccatcatgctcgtttctcattttgtgttttttagtagaaaaacacagtgtgttcttttgcccagacattaatctttagaatgcctgtattttctaatgttgggatttctttcacaaccacccaccttaatatttccattgtgactcagaaaatcagacttcattcgattctttagagaactata

SEQ ID NO: 2179 - DNA, 300 bp, Homo sapiens
gcacgcagcacccactcagcacctcttagaagatgcgtccgtagtatatagtatgatttttcgaaggggattttgctcatattaagggttgctttagggatgtccaggaagggtcaggtaaggaatctttcaatctgctttctaattggcttagttttcccactgtcttcgcaaaaggacaggaatttccaggttagtttgcagcttgtctttcatcaagcgaaatgctcatgctgttgggtagatggtaatagaaaccttttgctacctttatttatcaagagttgtggagccgaggaa

SEQ ID NO: 2180 - DNA, 300 bp, Homo sapiens
aacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctg

SEQ ID NO: 2181 - DNA, 300 bp, Homo sapiens
ctgtgatggttccccagctgcggagggaaaacagccttctcctgtggaatgtctttgacttgaacaccccagtccacaccttcgtggggcatgatgatgtggtcctggagttccagtggaggaagcagaaggaaggtgagtgggagaggcctgctgcccactttccttctgagctctggtgacagcggtgccagtcagtgttgccatggagtccagtaaagaagacatagagagagctgggctttaggaaccagagagccagggctgttgccacctttcgtcataggtgagtaaagggac

SEQ ID NO: 2182 - DNA, 300 bp, Homo sapiens
tggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagc

SEQ ID NO: 2183 - DNA, 300 bp, Homo sapiens
gggcatattttaactgtaatcttcaggaatgacttttctcctgaaagtaggaattctctttctgctgttaagtgacagcatgtgctggagacattggagaaattacccagtcatgctaagcagagatctggaggtcatccatggatgcagccagattctttctagagctacaaaactgactttctaaaaagtcagcaacacagcgctgaagaacatttattgctacaccttattttaaaattggattcaatatcatccaatctagtagttctcaatatttctacaaaatagaatcactta

SEQ ID NO: 2184 - DNA, 300 bp, Homo sapiens
aaaaaaacaaaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcattt

SEQ ID NO: 2185 - DNA, 300 bp, Homo sapiens
cccgcatgaactctgctttgttccatgttcacctgactcccaggctagtacttattccagaggagagcctcactgtaactcagctcaccactggcatctcctgcaattgtttacccatgttcctgacccagaatgcctggcagaggcccgggagcccataaagcaggtattcatcttgtctcctgaccagggacacaaaaggcttcttttgtccctttatatcttatagctttttttggttttggtctttgcaaggcgaatcctgccatctcctctgtagattaagtctgtgaatagggg

SEQ ID NO: 2186 - DNA, 300 bp, Homo sapiens
agaaagaaaaagaaaaaagccatatggcatagaaaaaaaaaattctgtctttggaggaaaaaggaaaaaagtcccaggtttgaagccagttgtggcctcttactaggtatattattgagtctttcagctctgtttcaaaatctagaaaatgagttcagtattacctgtttaaatttgtgaataacgcattgatgtacaccctggattccctaaaactgtcttaactgcgtgagtccagtggactcagtgcatgagtctaaatccttagacttctatcagaccttctcccctagcagtttc

SEQ ID NO: 2187 - DNA, 300 bp, Homo sapiens
gatacagaaaagaggccccaacattaagaatttctaaactttattctttttgttatcgtttgtcctctggtagtgatcagtggtcagtctttgaaaagaaaggacctatgaactcaactttagttacagcaaagaaatgagtaggagacggagggaatggccagcagccattgaagagggagagcaggctgggcccaagggggacccagtattggcagaaaggaaagctcagggtgtcaagtgggcctgagaagggatcatctggctgaacaagagaggtccacatgtagctctcagcac

SEQ ID NO: 2188 - DNA, 300 bp, Homo sapiens
ataacctaggtcttagaaggataggaacaacaaacatcatgatcttacacacctgcactttctagcaccagctcctggagaaaaatcgagaggctgaatggtgtctgttaacagattatagtcagtgaggcctctttcctcagatgttgtatcttatcaatggcagacattttcaacctgaaagacacatgctcattacaagacttagtagtgctctaaccctgttttcacttatcagtccaagacgtagccgacatcaaagtattcagcttattacagaattgacttcctcaaagtttc

SEQ ID NO: 2189 - DNA, 300 bp, Homo sapiens
aaactgtttaaattttaaaggggtgtattggtgtatgtcactgaaaattccacaggtacagtgggcttcaggcatggtttgattgggatgccagctccgttttgctgagattccattggttctgctttctaccgtgtttcagcccggtttaggtggcaaaacagtggtggaaatgttaggcttcacatcaccgtaccacatagaccaaaatgagagctaatatccaggatgagaatgaacagctcttctaatcaggctgtcataaaaataaggaagcttattttatagaagcctttacca

SEQ ID NO: 2190 - DNA, 300 bp, Homo sapiens
  misc_feature (1)...(300): n = A,T,C or G
attgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaanagaaatcattaatttg

SEQ ID NO: 2191 - DNA, 300 bp, Homo sapiens
ctggaatgggatgactgaggctcccatcgctgtctttatctcagaccttgggtttaagtaactttctgaaaaccacagtcccaccacagcacagaagccagtggggtgacacgaggagcaggcctgggttcccccggttgcctggttccaagaggggcccgtcgtcctgtgctctggggtggccttgggattaggagagcccagctaaacaaccttcccatcaggctcctggtcacagcacgaggctttaacgtcagccgagcctggcaaagaaagtgtcatattatggggctttaggat

SEQ ID NO: 2192 - DNA, 300 bp, Homo sapiens
cttccaccaggtactgagtagatagatgcaggcccccagaggaagctggaggctggagatcatgaacaagctcatttcccataggaggtggggagggcagcctgaaggttactctgcagttctcttcggcagaatcggaagcagcaggctggcatttgtgcatgagctaagtgaggacaaggagtctaggttttcagccactgcacacaggctctgtggcctgcgaccggtcctatcctgcttgatgaactaccaggagtgagagctgctttctgttttggtagtgggttcctcacattt

SEQ ID NO: 2193 - DNA, 300 bp, Homo sapiens
ggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaagg

SEQ ID NO: 2194 - DNA, 300 bp, Homo sapiens
ggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagat

SEQ ID NO: 2195 - DNA, 300 bp, Homo sapiens
ataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggaagggtcctttctccctccttttacactcgcagacaagcttgtggatgctcaataaggacagctgccgtttggacagagattaatcatttat

SEQ ID NO: 2196 - DNA, 300 bp, Homo sapiens
ctcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggac

SEQ ID NO: 2197 - DNA, 300 bp, Homo sapiens
gtgagccactgcgcccggccaaagacactttcaaatactcatgattggatatgcctctgtgattgacagtgagatttcaaatgggttaaagattgctctgcaaagaggttaactgttgagattgatacaggctatcttcaacatatgtacattgctgtatatgacatttacctaccattgtgcatctgggacttcctgatggaccacaggaattcccttttcttcccattctcttccagatctttcttctacttgaaaccccttatctacaaaaatgaataaacaacccaatctcatttc

SEQ ID NO: 2198 - DNA, 300 bp, Homo sapiens
ggtgtgcggctgtaatttgagctattcgggaggctgaggcaggagaatcacttgaacccaggagacgaaggttgcagtgacccgagatcgtaccactgcactccatcctgagtgacagagcgaaactccatcttgggggaggaaaaaaaagaaagtaatagggaggcaaatcagaatttgtgtgggagtaccccctagttctggctcttgttagtatactcaacctgtcaggctattctgagagcgaaagctcctgctttgggctagtttccattcagaatggtttttgataggtatgaa

SEQ ID NO: 2199 - DNA, 300 bp, Homo sapiens
  misc_feature (1)...(300): n = A,T,C or G
gccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggcttttgttttgttttgatttgtttttggagttggagtctcgccctgtcacacaggctggagtgcagcggtgcaatcttggctcactgcaacctccgtcacctgggctggagcaattcccctgcctcagcctnccaagt

SEQ ID NO: 2200 - DNA, 300 bp, Homo sapiens
ttttaccctcctataatgcattttctttggatattctcctagattctcagggatatttccatattttactattcatgagtttagaagagtgtttactttcctgagttttcatttccttctttttcttctgtcataggtaatttacagagcaaatagccaccagagaggataccgtaagggatgtggaaaatgagttcctttgcgcttatccagtgaggttgattttcagtcaatgagcattcagtatatgcctgggactctggctttattttttagctttgtgatgccaaacccatcaat

SEQ ID NO: 2201 - DNA, 300 bp, Homo sapiens
aattccgttgctgtcgcaaaaacaggggcccacagaagaacctgaaaaagcagatcgggggaggagagctgcaatgatctaaaaatatgtatatgagcactggtgtccaaggctgtggaagatccaatatggagatacagaaaagggcacggagcttggcaaagagaggtgattgacttttgaagaacagaagccaggctaggatgggcgaagcatgaatgaatggatgatgaggagcagggcccaccctgggctaaattgcaaagcagtgcatgtggaggcccccttttcccttgtggc

SEQ ID NO: 2202 - DNA, 300 bp, Homo sapiens
acattgtttaaggggaaagctgctgtgagaatattgacagtaggcataaacagtgatatattttactcacaggtattttgggggttgctttcattttcttcagatcagtgccacttctgtgctaacggtaagagatagatagacagataggcaatgaagtgttcacttaattaccttggtttttagtttactaattattacattcatcgtttttgtgatcacaaaaacacaaagaaggaggtctgcctggatgggattacaaagatttagccagtttcttggtatataacagaaggtacc

SEQ ID NO: 2203 - DNA, 300 bp, Homo sapiens
gtggctgttaagaaaacaatggtaatttcttttaaggtgatcatttcatgttcctatggtatggatgcatgtagaccttttaagaacagttaatgaagtttaatctgcttatgtggaggagaaggtatgatggaaaggcttctggcatgcaacgggagccgccctgctttcccccgatgtgtctattaggacatttctgtgacactgcctggcgtctgcaacctgctacgttgctcactgatggaaggaagaggcctggccgtggtagtggaaagctgagctctgttgtgatatgagagt

SEQ ID NO: 2204 - DNA, 300 bp, Homo sapiens
gcaacaaaagcatacaagatctcataaaggaagtggaggagctgcagggacgaccgggagctttcccagtaagcatcagttcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtt

SEQ ID NO: 2205 - DNA, 300 bp, Homo sapiens
acggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctga

SEQ ID NO: 2206 - DNA, 300 bp, Homo sapiens
ctctcatgtggcagaaaaatgatttccaatattcagcactcacctctctccccaagaaaaacatgtcaaatgcaagactgtgtgctcttaatgacatctatattaagggatctgaattttccatcataaatgaacatggtagcttaccaaatatcttctgataagtcattcagtgctcaggttctatgttttttctcctgtagaagagtgaagaaactacacatcaccaaaatattgtaaggctaagtaataataacggtgactgggaaaatgggaaatgagatagcgtcaaacgtttgt

SEQ ID NO: 2207 - DNA, 300 bp, Homo sapiens
ctgagatgctgacaaccactgcaggcaccatgaatttttaatgtggtggtgattagaaggctggctagggcctcatttcgtttcattggactgctgtgacacttgtttccttcatggtatttagacttcctgggttatttcccaatccagactcatgttctgtttcatgagtgcccattgcacccatgcacttattgaggtgtgtttgaaagcagaatttaaaaatttgatctcagttattgaacatcctacgctatttcagaaagggatgcttcttaaattcctgaaaaggaattcaat

SEQ ID NO: 2208 - DNA, 300 bp, Homo sapiens
ccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagc

SEQ ID NO: 2209 - DNA, 300 bp, Homo sapiens
gaaaagaaaaaaaaagaatttaaaattctgttttagtggagtcatttgaacttaagtctaagtttataacaacactggcttccacagcacaggaggtgagcatgtgttaatatttaagattggcataactccctttaggtgcaagtgttcaggccaaaatgttcctgaggcattttgattcctcctcctgctgcccatctataccaagcccagaaactgtctggaatatattttagtttcctgaatgacaccaagaagtagaacagtcttttcaaaaatgtattttaaaaataagctgaa

SEQ ID NO: 2210 - DNA, 300 bp, Homo sapiens
gcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacag

SEQ ID NO: 2211 - DNA, 300 bp, Homo sapiens
tgcttgcagagcatttgccaggacttagggatatagtggtagcagaaggcagataaagttccagttcactcacaggagttcatattctgatggaggagacagaaaataagctatagcatatctgtgctttgtgaatttgtcattgctgcctattcccgttgccttttttttacatctgtatttctgtcatctctgtcctacctggctcatcagggaggtgcagaaggctgaagaaagcaaagtccctgaggactcactggaggaatgtgccatcacttgttcaaatagccacggcccttg

SEQ ID NO: 2212 - DNA, 300 bp, Homo sapiens
cctagtagtaccctgacctccaggagcccctgagctctgggaaagcctttctgatgatctcaagcttgcagattctgtccctgttctgaccgggggtcacagcctagtggtagaacaggacctcctgctaagatgctggaaggaccctttgggggagctgaggcctggctcccctctccccaggcgcaggtgcacaggcgtgtgggctgtctgcaagcacagatcctgcctcacagcaccattaccacaataactgaatctgtgtttcctggctgctgttaattgtgctagagatttggg

SEQ ID NO: 2213 - DNA, 300 bp, Homo sapiens
atgagcccatgaacttccccagaaactcattgtcttctatttccgtaacagctcctaaccactagtcgggctttgcacacagcgacttctccgtaaatgttgactgcagggcagaaagaaaggctaaaagttcttaggagaatgtttgcctttgcatgtatatgctggcgatgctaataagtcccagctagacctggcagtgagtaagttcaggggtggcaatttaattttcttgctattagtaaaacaaacagtaggtgggatgggtggtaagcttaaatatctctgacgcgccattta

SEQ ID NO: 2214 - DNA, 300 bp, Homo sapiens
atgaatgtggaacttttatttttatccattattttcaaattggatcaatgtcctcctgatctattagatctaagacctaagaggaacctaccttgttttggctagcgggtacagactttcttactaaaaggtgggtgtatttcctagaatagcattttctgttgagtagagatgattttcagcaatgtggctggtcacttagcttcaaagtaattattgagtgtgaaagtaagcagttgtaatactttttaaccactgtctgtgttcttaccaaatggaaaacaacactcgtcttgaaac

SEQ ID NO: 2215 - DNA, 300 bp, Homo sapiens
gggatggaccacacagtctcttggaatgttgacctgtggcagtgacgaaagaagagactctcccggccgaggccccagtgcatggagagaaggaagaaatcaatttcctaattggtaccatatacatcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaagcaatgttcacagcat

SEQ ID NO: 2216 - DNA, 300 bp, Homo sapiens
gcattaggcagtgttgcaagtacatatcggaatctctttggctggctctaagaaagagtttgaacttatttacctccttagccctatgtaacaggtaagaaactaaaaggtacagaaaatagagatgtttgatttttctaagttgccccaagctaccgtttttaaaaacgcctgcaagcatgtctaaaacaggagcctgttagctacagttgccaaaccggtttaacagcactgcctccatgtattctgggtaagaaggagctccgagtacataaatttatcaaagatcactatcccaat

SEQ ID NO: 2217 - DNA, 300 bp, Homo sapiens
ctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtc

SEQ ID NO: 2218 - DNA, 300 bp, Homo sapiens
gaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtt

SEQ ID NO: 2219 - DNA, 300 bp, Homo sapiens
gcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctgga

SEQ ID NO: 2220 - DNA, 300 bp, Homo sapiens
ctcatgaagacacccatgcaagtggtggtgagaaagaggactcccccataccttgctccagcacggaccttgctccagcaccggccctgctcagccagattttcagaacgagagggatattcttatctgtggcaaagaatattctctatattctgtatacatcatttgagacttaaatgggtttcaacagatccattctttttgtagatgtaggaaagtttgacatatgattgttctttgccaaatagccacgttcgcgggattccttttgatggaaattatttattaggacttaaaaaa

SEQ ID NO: 2221 - DNA, 300 bp, Homo sapiens
actggcattctgctgttctcaggaggctccgctttgatggatggctgggcagcctgtgctgcatggaccaccagtggttgttgaggtggtgaagtgtgtccccgttaactccactctgggcagtgaactgaagagggagcaaagcccaggaaatgggccttcgtggcagtggtggaggtagagtgacccacagcaaacctccccacttgtccctgaccattcagtagttccagaggcagtgagcttggaatcttagcaagagagatcttggggtggggtgtggactttccacaaaggcat

SEQ ID NO: 2222 - DNA, 300 bp, Homo sapiens
ctagatttcggtatcattccctatcctttcaactctgttattctataaacatgagctggagattgtgtctctgtctttccctctgtcagtgcagccagcttattaaggccctaggtgagctcccagctttcattgttatcactgactaaaacccttgcctgttgatatttgctgagtgtggaagaatttaagctaatgaggaaggagttcaccaaattttacaaggtctaaaaacagttagaatataaacaagtgatcccaaggaaggaacaggatatggtttattcagctagtctcaaa

SEQ ID NO: 2223 - DNA, 300 bp, Homo sapiens
agaagatgaccgagagactcttgtcagccaatgcagggacacactctgtgttaccaagaactggctgtctgcagatactaaagaagagcgggatctctggatgcaaaaactcaatcaagttcttggtgatattcgcctctggcaacctgatgcttgctacaaacctattggaaagccttaaaccgggaaatttccatgctatctagaggtttttgatgtcatcttaagaaacacacttaagagcatcagatttactgattgcattgtatgctttaagtacgaaagggtttgtgccaatat

SEQ ID NO: 2224 - DNA, 300 bp, Homo sapiens
ctgatgtattagctattttcatatgttttctaacatacttaatatccttacaggcattatgtggattcagggtaaacttctcagactgtgagcctgagagttcctctctaggaggctccacaccattctgcctgctagatcggggccagatgagatgaaagtcaacgcttgagaaagaaaaccaacatgcattaactgaaacaccgtcttcacttgttcatccacagggtatagagcgagttccaagaaccaggctaggaaatgacacgctaagtttcctatttctagcagctgccaagg

SEQ ID NO: 2225 - DNA, 300 bp, Homo sapiens
ctggaaatgtggagtgggtggtgatggcagtatcattggtggcaatgctttgtctgcaattaagccaggaatcaggaaggaactgcagatttcttagaaagttgtagtgctctatgagggcacttagccagttgttttgaccgactaggcagataatcacactgagctgatacaatcgtggtgctaaagtatcataattattaaaatattagtcctatgtgttctcaacacatgtaaaggaagagtgaccagattgatcttaatcagaaatgtccagttacatgtcggccgacagcattg

SEQ ID NO: 2226 - DNA, 300 bp, Homo sapiens
ctcagccccccagtttttatgtggacatgttttcatctctcttggatatatacctaggagtggaattgcttggttgtgtggcaattctatgtttagcattcgaagaaattcattgaatggtaagctgaaaagtgacgtggttgaatttctgatttcagaaagatcactgatgtgatgagaatgaataactctctggagtgctaggatgtgggggcagggagctagcttagtatattattgcaaaatcttgccaaagatgagctgatcaaatgagaggaagcatgaactaagaggggagca

SEQ ID NO: 2227 - DNA, 300 bp, Homo sapiens
ggatagtgttaactttccttaaaaagcacttttgataattcaggaggtataaataggctgcttatttaaaaaccttcacttggttaactttagaaactcaagaattataaactcaaatttatacttcttgatacacaaacttaagaactaaagctatcttctgactcttctatttgaaaaggtactaacacttctttccgtcagtctctcattcttcatttttgttggtatcctgtggaatttttgtctagtctagtaaaattaaattattatcactttaatgttttgtagctctttttt

SEQ ID NO: 2228 - DNA, 300 bp, Homo sapiens
tagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcaggtatgact

SEQ ID NO: 2229 - DNA, 300 bp, Homo sapiens
ggacaacatggcctttgtggaaatggaggccttggagcccagagaggggcaggactagctcagggtcacacagcagggactcaggaaaaagaacaagatgagctgagtgctatggtgtgcaggcgcacggctcagtccacaggatcccgtgctgccccaggtgctctcacctccttaggcctgcctgggtcatgggtggggtggtcaataagatctttccttggctccagtctctgcctccagcctccttgactagcccacctgcttacctttgggtggatcccagaaacctacggtctc

SEQ ID NO: 2230 - DNA, 300 bp, Homo sapiens
cattagtgtaagtgcaggtaattgcttcattaggacatatgtattgaaggagggagggcaagtctatagcatggtgataaaaacaggcctcaccctctttctctacccacacaggagcatctcagcttgacttcagggatccaggagccaccagccaccctgtaaacagcccagattaatcctgggtttcagtgtcatgggaggaaggaaggatgacctagtaaagagcaacttacttactttctttggggtggtaactcattgctgaactctggatggcactggtgcgttcaaggcaat

SEQ ID NO: 2231 - DNA, 300 bp, Homo sapiens
cgtagaaacaccccaatttcaaagctaatttatctgttgtttttaatcacgagtcctctccttctgcactatcaagtgtcttctacttcctgcttaagtctctgttgtccatttcattaagacagaagtttctattattgttaaatttgaactgtatctatgttataatagtaatggtaactcaatccaaaggacctaataacaggaagtaacatgtcttacatatcagtttatatttgtttttttgtagggacatactgtgatcttggtatacttgtaattttttagtttcctggtcgg

SEQ ID NO: 2232 - DNA, 300 bp, Homo sapiens
aggaggtgtttgatttaaaaggaaacacaccagttatgccttcttgtaggggcatgtgagccagtagagtttgcagctgcatggagagatgaagcaaaactctgaacattcaactgcattaaaaaaaaatcatgccaagagggcctttgagcaagaaattcttgcagatttatgacacccgatgcctgaactctgtgtgtgacatcagggttatggctctgtaagctcttaaccctgcagctgacccagtcagcttctggctgtactaggggttgatgcggttcactgtggttgtttgta

SEQ ID NO: 2233 - DNA, 300 bp, Homo sapiens
gaactagtcatgccaggtactaaatcaaagggggcagtgaggatctggtgcagaaacaacctgatcaatgggacaggacagggagtctcaaaatagccataactgcatataaacatctagtatatggttaccacagtattcaattcaagggggcaaaatagagactttttaataaatggtgttggaataaattatagttatttgttcaaagagttataattttatgcattccttacaccatgcactagatgatcctccaaatggattagactgaaatggaaagaaaaaaagggtgaattc

SEQ ID NO: 2234 - DNA, 300 bp, Homo sapiens
ggaaaacggaaaaaactcaagagtgaaaactaagtggtgtgtgaaaatgtcattgtgcctgggtggttgaagtcattaaagtcagagagccaaaaatacctaacagagtggagcgaaaaaagagccggacagaacagtgagaataatatatcactgatgtaaaaacaactcatatgatgcttgtaaatgtggaaactataactatccctggaggggtatagagatgagttcaattaggagggaaactgagtgacaggaggacaaaattggaagggagatttttactgtataactttgtat

SEQ ID NO: 2235 - DNA, 300 bp, Homo sapiens
gagaagcagagggacaaggtgtcatccaagtgacctacctgcctcagcctcccaaaattctcggactacaggcatgagccactgtgcccggcctgttattgttgtgttgtcctgcttttatggtgcttctttttctttatttgtaatagtttcccctcccactcccactgttttcttaacatggagaaactttttttttaattgttcccagtgaatgctgtctcttcccatgttgactccattcacttgccatgaattgacttagtgccagacctctgtgccttcttcatgtaaccagct

SEQ ID NO: 2236 - DNA, 300 bp, Homo sapiens
cccgccacagtggcctgtttctttccttgctgctcctgcagcacagccctgactcgggggctttgcgtgtcccctcagcgctgcagggcccactccttcctctgtcctggtctctgcttagccagcgcacggtcagggaggcatgggtggccagcccgcaaggagccaggcctcccagcaccccttcccttgtgtggcctcctcccacatgggatctcagccggtcctggcttcaactaaacaggacgtggcaggcgtgatgccctgccaattccaggcctaagccttgacacagcctgg

SEQ ID NO: 2237 - DNA, 300 bp, Homo sapiens
ccaggactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcatgccaggaaaactgggggcagctcccccgagaccaagtatgaccagccccctaagtgtgacatctcaggcaaggaggccatctctgccctgtccc

SEQ ID NO: 2238 - DNA, 300 bp, Homo sapiens
ctgagtgagcctgatagagatagaatacagcttcttctttcctggcttctctgtactatagacaaattcttactttatctgaatttagaagtccttaaaatttcattcaaattcaatttgtagggcattgaattagtggcatttttctctgataggttttctgtatcttatgagaaattttactatacaatcctcgtatgttcatagggagaactgatctgctttcactaaatccagagtatgccagaagatctgaccataagatacttaatttctggtaaaattgaaagtttttttgtt

SEQ ID NO: 2239 - DNA, 300 bp, Homo sapiens
caaaaaaaaggcttttccctgatttccagaatgtactgggtggtgtccatctggtcttggatggtgtaagcataaggatttattgaatgaagtatgaagtgtggtttttatttgaagtcaaatatttggcagttggtgttcatttattctataaactttcaaaacagatgacaagttttaaggaaatggggcctaataccaaatttggttgaattaatgaattccaagattctttctagctttttctttttaaagacagggtctcactctgttgcccaggctggagtccaatggtgcaat

SEQ ID NO: 2240 - DNA, 300 bp, Homo sapiens
cagacttgagccactgtgcccaaccggtatttaaatatttgaaggattcatggttaaacttgatttccatccaaggtaaaattctagaatggattattaaaaggatcttaaccaaatagacttggaaacataatcagggcatgtgcacggtcctgtcttggagtaaagaaaactatttgtacagaagagtagagacctaatttagcattttccggcaatttgacattgctctagaagtttatgagagagaaatgcagattatgaaattatttaaaaatatacctcagaggagcagggaat

SEQ ID NO: 2241 - DNA, 300 bp, Homo sapiens
gcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagt

SEQ ID NO: 2242 - DNA, 300 bp, Homo sapiens
accacacctggctcatttatttttattttgtctagagacagtgtctcactatgttacctgggctggtcttgaactcctggcccctaatgatctgtctatctcaatcacccaaagtgttgggattacagatatgagccactgtgcctggcctatttctgactttttttctttttgtatataagaatatatatttcgagacaaattgtggattataaatggatgcttatttatctcgactgcctttcagacctttttcccccagccaaccagtttttttcttctcaaagaagacacaggtga

SEQ ID NO: 2243 - DNA, 300 bp, Homo sapiens
atttcaacatactgttgtctaatcatcgtgactcccccaatttctcttttttagaggaaagtattgtacagatgtatcttgaagattataatcttggttgattattgcctattctcactttaggaatagatggtgatagcttatgacttgtgttgtataacgaggtagaaatattgctgtcttctctgacatagcttctcaaagagatcattaatgtatgatatctaataaaccatctaatgcatgtaacagtgatcagcaaattaataaattagacctctattcatgcttaaattatca

SEQ ID NO: 2244 - DNA, 300 bp, Homo sapiens
acactgttctaaaggtgttgtgtgaattttcttttttatttattaccacaatactgtgaacaaatacaaatatctttccagttagtgcattccctcaaattgaacttctggctgcaaggaaagctaggaatgattatggttttgttagtaaggaaaattatcaaaatggatattaggttggctactagcagtcttggcctcatgctttcagtaaatagtgtgcacttcagatcatgtggcattggagaaaggaagaacatgttaataatataacatggttaggtcatggagtcttgatta

SEQ ID NO: 2245 - DNA, 300 bp, Homo sapiens
gtgaaaggagatgaggaacagtaagagatgaggtcagaaaatgtgttttaccaaactctttggagattagcgtctggggaataaagaatgagctggaggtcttaaatgtctcgtgactgggacaaaaacagtggttgagaacatgatgggatttttccacatggttgttaggaaagttgctatatttgagactgtgaatgtcagcaaagctgaggaacaggaggtcttccatggagtacacagtgccctagagcatcgtcctttgaaacccgtttccttttatatccgtccatagaggcc

SEQ ID NO: 2246 - DNA, 300 bp, Homo sapiens
gggttgtaaagcatcattgagataatatcttagatattattgggtaatattttgttttataacagtgattcagtatatctgaattatggattatatggccatagaactacaagcaaaaaggatacacaaacaaattttgtagttaagacaaatctgttgcactaagatcaagaaatgtaatagatggaggccatgtagaggttagaaattcaaagaaatcgaggtcaaaaactggccaatcataacggcatagggattagttcctaaatttggtcacttgagaataacagtgtgaataga

SEQ ID NO: 2247 - DNA, 300 bp, Homo sapiens
gggtgcttctgtatatcctgacaacagtggccagccattaaagagttttgagtaggggaactggatttgtggttttagaaagatcatttggcttctgtgtgaaagaggccaaaaccaggagcagaaagaccagttaggaagctgtgacagcagttgagagacgatgttgtcaaagtctgcagcagaacagaacaggggtgaccccacatggacatcatctctgctcttcagtcacctgtagtgcagagttttgaagtaggtctgagcatggaaccgtagtggttgggaaggaaatgccat

SEQ ID NO: 2248 - DNA, 300 bp, Homo sapiens
gaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggatgtatcatgctaaactgttggatccaagcacaccagtccatatacttcgagagataggtctaagactctcccattgttcccattgtg

SEQ ID NO: 2249 - DNA, 300 bp, Homo sapiens
aaaaccagtactcagaatgagaaagagaaggagaaagcaaatatagtaaaaatggacatttggaatatctgggtgaaaggttcttgtatcttttctgtaagtctaaaattatgccaagataagtaaaaacaaaacacctattttctttttacagttcttcctatttttcatggatttctgaaaaggcagagactagaagaaacttgtttagctatctcattctgctcatttaggggctctacttttaaaattaagatggtaaaaggaaagcattttacccataagtaaaagaatgcttcc

SEQ ID NO: 2250 - DNA, 300 bp, Homo sapiens
acttgatttggtaatgaaagacaaatagctttcataacatgaacatacaaaaatagatgctttgctgttgttcagttttctcaagacttactgttttaagcttgtaaaattaatgaacagtaaaatagcagaaaatagtgatacattggatgattttaatagttttattagtgagatatttgaggtattcgaattactacaattctttccaatcctacaagttaaaaattttgttatggttgctgacttttaaatgctgtttattctctgaaggcagttttatgatgcatttagaaaaaa

SEQ ID NO: 2251 - DNA, 300 bp, Homo sapiens
gttaggtgtagctctaactgggagttccatttaggcccagttttggcaggaatactttgtaggtgatgccgtgtacatcccactgtattgccttgaaggcacaggtatgagaaggcacaggtgtccggtcattccactttcagcctgtgattgaccagtgggggcagggctgtgtgagtctccactttatagcgcccatcagactcccctctcatggttgtagcatccattgctcatagttgctagagccatgatttcattaaaggttgtcaagtgatgactgtctaatttccatttatt

SEQ ID NO: 2252 - DNA, 300 bp, Homo sapiens
atagtaaattagtcatagaaaggcaaactcaaataactttgaacacagctctttgactatccacctgtgtgtaaacaaacaaaactacaaagaaattttgtacttcacttagttggtagtgatctggtatagcaattctgaaaatattttctgtgtattgtaggattaaacaaataagtaaatataatgatattcttgggagctgggatcctcactatgagagaagaaagataaaaatatggagtgaaggaaggcaaagaagagctccatgaattggaatgagagattccacagattact

SEQ ID NO: 2253 - DNA, 296 bp, Homo sapiens
  misc_feature (1)...(296): n = A,T,C or G
ctgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtangtggaagancaagagtcccttccagtccatggggnaaagccct

SEQ ID NO: 2254 - DNA, 300 bp, Homo sapiens
agattaaattgaatatgtataatctttgttaggcaactgatgactatacttatttcacaactggtaatgtgaattattattgcataaactatagtgctgaggccccagtctttacacttccatttaataacttcacagtttcatatcttcttgagatacttactaatttcaagtcccatcttggtcacaaggagttgtgaattagagaacaattaatatcaccagttaaagaagttagattagaaatctgaaccatcctaaacataagaagtacctgcatcttcagagtcttatcccaaa

SEQ ID NO: 2255 - DNA, 300 bp, Homo sapiens
gatcacaccactccactccagcctgggcaacgaagtgagaccctgtgtcaaaagaaaagaaaaagagaaaagaaaagaaatctgaaggtctgacaacccttggtccccatcctcctatgacttggacctaagtcagagctgccctcttgtaacagggtgtggcccctctatttcactgtagtctgcttcattccctgcagcctccttgatacgaagatgcagtgacaggccaggcactgtggctcatgcctgtaatcccaaggaggccgaggcgggcagattgcctgagttcacgagttc

SEQ ID NO: 2256 - DNA, 300 bp, Homo sapiens
attgcttctgttttaatggtaatttgtctaattgtaaaaataccgaagtagtgattccaagttagaaagtagtgatccctaagaacagttggagaaacatatggtttgttctatagctgtaagcggtaattttgaagcaattttgaaagcattctttccctttaagaaaaaaatagtttcttactgaaatgactttttaggatgtcttgaaaaacgtagtgaaattcatctagaaacttacaaggttgatgctagccatcacatgcatgctgcaatttgctgaaatgtcttgatccaggg

SEQ ID NO: 2257 - DNA, 300 bp, Homo sapiens
ctgaattccaacctgggtgacagagtgaggccctgtctcaaaaagagaactctcgatgtcactggctttccatgtaagcagagcacatcatgtgagccccattcgtggatgtcagtcagcagaacagaatcttggacctggagcttgtttgtcctgtgctagaggttggaggtgtctctgtctttctgttggttcctgtcagttcaggtcacttagagattctgttacatacaccagctctgacaggttgggggagatgatcaaccttccgcctgcgcctgttcccttccctgactcatg

SEQ ID NO: 2258 - DNA, 300 bp, Homo sapiens
gatagctcaagatttttttttggtttattttgttttttaaaagtaagcttgtgccggttggggaagaggaagtgaagttcctttttgatggtgttgagtttgagatgtccagtaggcagttagaaatctgggagggccgttgagctcattagtctagttttgggaaacgtgtgtgggtaaggtaggggttgaggatatcacccagggtgacaccagcctttcaggggcagaagggaaccccaccaaggcgactgaggagtgagcggatagtttcaatttcaaggagggggaaagaggagc

SEQ ID NO: 2259 - DNA, 239 bp, Homo sapiens
ctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttctattaattaaccatatcctaag

SEQ ID NO: 2260 - DNA, 300 bp, Homo sapiens
acacattcttccatttgtcagtaagagtaataatttgactgttttattggattttagcctttttgatttcatatagctgtatcttaatatatcattgtttttaatatgtctacattgaatacttattacttgtgcaatgaaaaataataattaaagatgaaagttaagcctgttaccactttcagagaacaacgtgacgttttggaatttaaaattttttcagtagatttgagaaaaacttgggttaaaatgaagatttatgctcagaactgagattccagggtttaagtctggttttaa

SEQ ID NO: 2261 - DNA, 300 bp, Homo sapiens
atgcctagtggtctctgagtgtaagattcttgaacctgctgatttgcatttcacctgtagttctacagtaaaaaatgattttatataacttttggtatataagtctcaaaaagtgtgagtcagaagagatgaaacattatatttaaaatttcatatcaaagcttctaatacaacgttgctagagccatggcttggaaataaatcaggaaaaaaccctcaaatacagaatcagttgtgttaatgcactagaacttgccttctgctttaaagccataattaatcatttaaatgctggataaa

SEQ ID NO: 2262 - DNA, 300 bp, Homo sapiens
gagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctgaatacacggctgcgggatgacagggacgcctgcgaggccaggcgggcgggcagcagc

SEQ ID NO: 2263 - DNA, 300 bp, Homo sapiens
acttttacagcagaatttaagagcccaccttccagagcctgatgcagcttgtctgtctgatgcttttgttccccatccacgtcccccccagtgctgaagctgtttcgtgtgtccttacagtgtttcctctgcacttccacttgtggttgataagtggcagggggacaataaatagagttgatgaaagatgggcttgggcagcagtgggcccaagtgaggcagaaatgagaaaaggactcctggggcagaggtggagtgacaaagccttgagcacgagggtgtgaaatgtgaacttggtgc

SEQ ID NO: 2264 - DNA, 300 bp, Homo sapiens
gttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggca

SEQ ID NO: 2265 - DNA, 300 bp, Homo sapiens
ccagaaagtgcctttacatttttgtcttggaacaactctgcaatttcatcttgatttaatatttctagtaataaagcatcttccgactccacattcttatctctgggcagacattttattcttaagaattgtagtgattgataagaagctaaatggagatgattaacgtgtcaatgattaataattataacaacattcaaacacttagaaattatagtatttcatcagatgtctttttaaagaggcatttctggccagttgtggtggctgacctttgggaggctgagacggctggatcac

SEQ ID NO: 2266 - DNA, 300 bp, Homo sapiens
gttaacttctctgagagagttccttgtaaggctacttataaatagtagtatatatatatatagtttatggcagggaagatctgggaagtaagcaaaaagagcctttagttaggcaacatagaacaaaatagaggtcacaggttccatgcactgaagaatggaattgaaatagagactccagggtcatagactcttggaaggaagactagagtacattcatgaccctcacccttaattacttcacaggtgagaaaaccaagagctacagaaaataagttattcctcagctccagggctacc

SEQ ID NO: 2267 - DNA, 300 bp, Homo sapiens
gagaaactgcattttgggggggtttgaaatccaaagaatgcagtttgtaggcagtcgagatccttgaaaaatcaagatggattttaataatgtattaagaataaattggatttgaatcaacacaggaaacagggattttacttagagactatttcagtaattttgaaatcattgcccaagattgtagttggtttgtttataatgggtaggttatttatttgtgaatcccaaatgtactccatcaacattccattgaataatttacaaaagcaaacagcaggggtttatgttttctcttct

SEQ ID NO: 2268 - DNA, 300 bp, Homo sapiens; identical to SEQ ID NO: 1381

SEQ ID NO: 2269 - DNA, 300 bp, Homo sapiens
cccagggagtggggaggataaggcgctgtcatggaggacgccgccgcgccggggcggaccgagggggtccttgaaaggcaaggagcgccgccagctgcaggccagggaggagccctggtggagctcaccccgacccccggcggcctggccctggtgagcccctaccacacccaccgggccggggaccccttagacctcgtggcgctcgcagagcaggtgcagaaggctgatgaattcatccgagcaaatgccaccaacaagctgacagtcatagctgagcaaatccaacatttgcaagaa

SEQ ID NO: 2270 - DNA, 300 bp, Homo sapiens
ctcaatcaaacaaaagctcaaagtttttgttttgataagaaaataaaaattttgtgggctcttacatagtgggtactttgattatgtgtgataatactgtgctgtgacaaataatataatgaagaaattaataccaagattgctattctgaaagattaaacattctttaatacttagatctttcatctgtttatgtaacaaaccctaacatacaggcttaatgccttgcagatattaacttctttaacttaatctttgtaacagtcccatgaagtaggtactattattattacattttcc

SEQ ID NO: 2271 - DNA, 300 bp, Homo sapiens
gttttcctcaggcacaatgagccactgcaggcttttgaggagaagagtgacaagctgagagctgtgttttaggacagctatcctagagctatgtgtgggcagagagtagcaagcaggttagttaggaggctagggtaaaaaggcagacaggggacacatttgtcatatgccctagtgaggcacagaatcagggaacaggaggtctgcaggtttcaggacaggccagttcagggagaaaagggactagccgtgattatcaggtcactggtgatttatttatcacttccttgaagtattaaa

SEQ ID NO: 2272 - DNA, 300 bp, Homo sapiens
atattattttaattttatataatagcatgtactgctttacacatttttataataagtcaccacagtattacactataactacgttataagtgcaatagatatgggtacaataaataaaaatagttgaggagaaaaaacctttagaccattcattataacgtgccagactgataaggggaaaaccccccatgtcacatgagagaaataaaacccactgccatttctctgtgcctgggtaactgagttgattgtattcaccagaaggttcttgttctgccttttagacctgcctgggtcatt

SEQ ID NO: 2273 - DNA, 300 bp, Homo sapiens
gacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactat

SEQ ID NO: 2274 - DNA, 300 bp, Homo sapiens
ctgctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgc

SEQ ID NO: 2275 - DNA, 300 bp, Homo sapiens
gccacctagcttattttatttgtatttaagtgaatataccaaacatttatatgagcaaaccaagttttacataacatgcttttggtatgtattatgactttttacatttctacttggatttcctcttcagatctcagtttccacaaatctgcatccaggttcagggcctctgattctgcacaaatcatatgagccaagtggattgattactagacagatcagatccttccccagctaataactctgccttctgattccagtcctcaaaataaattgcagcctgccattttctttatgttt

SEQ ID NO: 2276 - DNA, 300 bp, Homo sapiens
ctacgaccccatcaatttggcctataacttgaaagagaattctatcctgctagctaaagttgctcggagtgaccagtgagattgttccacagcatgtatattataaaacaaatattaggcagatagcttataatgactttttaatatttatttattcatttattttataataagcagacattgggacaagaaacttctgaaaatatttatagttctctgaaagaaggtgtcttcccttccttctgggagttaaggaatgttttgacaaggaagaaagatgggtgaataagagtgtattgt

SEQ ID NO: 2277 - DNA, 300 bp, Homo sapiens
tgtgaattagcttcttcctccgcccacccctgctttctcacttcctatttcccaagagtacttcccccaacaaccttctgcatgcgattctccatttcagtctgtttccaagagaatccatcccttcctcaagaactgtgccctaacatggagtccattccaaagtcagtaccagtgataattgagcaatgggatgatagaatgtagatgaggcagttagtggttccagcaaaccaaaaagatggcaaggcagtgagagaccagcagtgtaggaaacagccagctatattcattgaaaaa

SEQ ID NO: 2278 - DNA, 300 bp, Homo sapiens
ctctactacatttttaggttttatttcatttttatttatgtctagttttttgggacaggaccattcattggctgttttttaagtatgatgttgtaaagtgcagttagaataaaaagaacagaaaaaaataaagtagggtttggaggaagatgggatgcacatgaaaagataatggcagcagtagaggtgagggaaggagtggatatgggggaatgattttataaaggtcatgaaactagaatctgagtgagggaaaagctttaaaatatctgtgtctcttttctagagggtggataccct

SEQ ID NO: 2279 - DNA, 300 bp, Homo sapiens
cacaagcctctttccatttgacccattcttgttcttcatgaaggactgaggatattgtttgtgcacagttctgaaataaggagaaaatagtactcacaatctagttagggaggcaagactaacaagtgagctttaccgtcagtaatatgtagtctgagtctgtgccatacatatttggataataggtgaatggtggggtacggaggatggacaacagtctgctggaactggagcagagtgccccagcctccacagtttgtcattttgggccagacagttatctgttgcgggaactcctcc

SEQ ID NO: 2280 - DNA, 300 bp, Homo sapiens
aacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttc

SEQ ID NO: 2281 - DNA, 300 bp, Homo sapiens
aagaggagaagctgaatcagttggagtcctctctttgggaagaggcctcagatgagggcactctgggaggatcccccaccaagaaggcagtaaccttcgacctcagtgacatggacagcctgagcagagaaagttctgaatctttttccccgcctcacctcgactcaaccccgagtctcacctcccgcaagatccacgggcttagccactccctccggcagatcagcagccagctgagcagtgtcctcagcatcctggacagcctcaaccctcagtcgccgtcgctcgctcctcgcctcc

SEQ ID NO: 2282 - DNA, 300 bp, Homo sapiens
atgatttgattgtaaattatctcatggtccctgtttgcaaaccaccctcttaagagagaacattgttttggacctaaagcttgaagaacggtttatgtatttttctccttaagtagcattgcattgagtgttaggttcttttccctttttttcattcttggtcttcccaaagcttcttcccacatttcgtttgtgtctgtttccaccattcatagaaaccttggaaccactctcacagcaatgctaggatgtttcatggacctgttaagcattttgatgatacaagacatcctatcaatg

SEQ ID NO: 2283 - DNA, 300 bp, Homo sapiens
ggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataactt

SEQ ID NO: 2284 - DNA, 300 bp, Homo sapiens
caaaaataatagaaaaaaaaacagaatttccacaaacccccacctaatttatctgcctcctgccatcagtgccaatatactgtgcttttcttctgtggatacattatttaggccactattcagggccaacccctccacctgcctactagaggccatcaccacttgtttattcaagggcacagctccaggtagttttccttctcttggggatcatcagtttccttctgtctaccaggtcattcccattagcatgtttttgccgcttttcttaagagataatatctcaaccctaattcctcc

SEQ ID NO: 2285 - DNA, 300 bp, Homo sapiens
ggaacatgcaaagcagtagccctctgaggagcagagttaaggctagtacagaaaagacttttcctcccaaaacaccttcagtgtttggagaggctattatgtcaataagtaaagaacatgctactgtgaaaaaggtacaggaacaaaaaagagttgccaaaaataaaaaatattattgtaaggtaaaaaatttcataaatgggcctaatagtgggatggatataactgaaaactaagatggtgatgaggaagacagtcaagaataaatataccaaagtagcaaagaaatacctgtgcaag

SEQ ID NO: 2286 - DNA, 300 bp, Homo sapiens
cctaggcgtagtcatttctttattagtccttactttatttttcaaagttacgtaataaatgtctatgtttctaagctatctttagatttgtaaaagggctaaaatgttacttttaaacatgtttggtttattcaaatttgtttataaatctctcctttgtacccctggctaccacccctccccactcctctgcctaaaactaagggaaaatcctgtctttgcccatagcttcagaatgttctgcaattttagacttttacttttaactgatcactgttaagcaagggaggaaatttacca

SEQ ID NO: 2287 - DNA, 300 bp, Homo sapiens
ggaaaagtaaagagatcaaaatgattttatatgtattttttttgtactcagagaattacattttcactacccccgcctgtctcagggaatagcctttgataagaatcccatggagatctctggaactctattacagtgtgttcagatttgttagttcatatgtaaatttcagagctagagcttcaaaactagagtattgtaatctcaggaacataagattatccaagaagcctgaaccttgctcttttcatgataaatgacatccaaatttcctttgtctaggagataagcatagatccc

SEQ ID NO: 2288 - DNA, 300 bp, Homo sapiens
acagggtaagtgcatgtgacggtgtccaagacgcacagcagattttcattcacaaaaaaatctgaccacaagagctaaacggaaataccttccgctgtccttcccaagtcacagagcaaacacctcagttcccaggggtccgcatcagttctggtggaggcggtgactgtgagcgtgaccagctgggctaattcgtcctgacatttagttgggacagctatagtttcctacctctatgaccagagagtgaagcgtttcactgaagaactgtggccggcgtctccaggaaaggaaggagcc

SEQ ID NO: 2289 - DNA, 300 bp, Homo sapiens
tctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggc

SEQ ID NO: 2290 - DNA, 300 bp, Homo sapiens
gaatcaaaaccaagtaccagaattatgtgttccttaaggaaaattgaggaactgtgaaaaatagaaagtgagggtaatcattcttaatctaattacctaagcatagatactgttaatatcttggtatatgttttttctggtctttgttttagtctgcatggattgttttaacatccttttatttgctctctgaatgctgttttatggtttatattttccatgtttttatatttttacttaccatgtaatatatatttttccatattacctagtatttgaaatggtaaatggctttataat

SEQ ID NO: 2291 - DNA, 300 bp, Homo sapiens
caaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtacaaagaaatactctgtcaatatagtataactgcttatttcaaattgtatctaggaatgaataactactattattta

SEQ ID NO: 2292 - DNA, 300 bp, Homo sapiens
atgcgcttattaggtattttatctttcaaaaatatatgtacccaactgtgtttgtttgtttcctgactgtgaacactgaagaggactagatcaaaaatgaccaattgagtagcaattgaacatttacagtgctgtgtgcagtgaacttctgtagcacccaaattgtggtgttgggaaaaaccattccaccttaaaagaaaccaagcctttctggcaaaattgctgattctaggttttgggcaagaaatgtacatgctgagctggaacattgtcataacagttagtaaggaggctgttaaa

SEQ ID NO: 2293 - DNA, 300 bp, Homo sapiens
gaatcacagggcaaagaacccacatccatggctcagtagaacctgagctattacacccaagatccaaacaggaaagaaagggaccagagaaaggaaagggtccagagcctgaagggaaagagatgtagaatcagagaactcgagaggaacagtatgcttcatttgagacacagccagagatgagttcacaggaaggatgctgggtgtacatccttaggccttacccacctacctatttcagtcttctcttaggggtccccatatgctgaacccagcctgaagctaaaggacttaagagcc

SEQ ID NO: 2294 - DNA, 300 bp, Homo sapiens
gccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaag

SEQ ID NO: 2295 - DNA, 300 bp, Homo sapiens
ctgaatggcataatcttattaatgagatgttttgtttctcgtttagcatttgaatatttagattcatatatcaaaaatgcatgattctggcactaaatcagaatatttgcatatcttaccatttacagtgggtttttaaatttgtttttatgtcatatcactaatttgtagcaagtagattttctggtggtgtaactgttgctaatgatagtaaatgtttcatagactagctgaaacacagagtagctttttcaccctgaatgttgaactatgaaatattattttgagttttaattatag

SEQ ID NO: 2296 - DNA, 300 bp, Homo sapiens
gtcttcactctgcgacaacaagcttcttgaaggcaaagaccatattttaagtatcttttgtgtcctagatgcactgagtaaaattccagggatgccgttgatcataaatttgttataatttttaaaaatagactttaaaatttagatttacagaaacattgcaaagatactgcagagttcctgcctatcctacactgtttcccatattattaacgtcttacatccctgtgatcatttgtctgtattaataaaccagtattgatacattatcacagagaccatactttatcaggtttccac

SEQ ID NO: 2297 - DNA, 300 bp, Homo sapiens
cggcgcctgggctgctcgtctggctgctcgtgctccggctgccctggcgggtgccgggccagctggaccccagcactggccggcggttctcggagcacaaactctgcgcggacgacgaatgcagcatgttaatgtaccgcggtgaggctcttgaagatttcacaggcccggattgtcgttttgtgaattttaaaaaaggtgatcctgtatatgtttactataaactggcaagaggatggcctgaagtttgggctggaagtaaatgagatgccacctgtggtcccaactgacaaagattaa

SEQ ID NO: 2298 - DNA, 300 bp, Homo sapiens
actttgcatttgctcgttttgttcaacttttccttccttctctgcctgccaaagaaactgtaataactgtaataatttttatgactttctcttcaatgacagttatcttcctttaccctaattccttccctcctcatccttcaaatccccttcctcatcattcaaagtctaactcaagctagcctttcctccttattttccccttatctttccaatccgtatggagatttctcacctttcctgatagaggttgcgccagaatggtgaggattaaattgtaattgctttctaatagactgc

SEQ ID NO: 2299 - DNA, 300 bp, Homo sapiens
gaccagtgatgtcacaggaggtaggaactttatgtgaagtgtgttgcctgccgtgacccgcagcctcctctctaaagggttgtgacaggaactgtcccactgggaggcctgtggctgtggagtgcactcatagcctccactgtccgtaaagggagccatacaaccagagttcgtcctgccccaaaccctgccactcacaaccacatatgtacagtcagatgccatataacaggctgcatatgtgatggtcccataagattacaatgaagcagaaaaatccctgtcacatagtgacatcat

SEQ ID NO: 2300 - DNA, 300 bp, Homo sapiens
  misc_feature (1)...(300): n = A,T,C or G
cttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttttttttttngnaaacggattntcnttttgtnncccaggttg

SEQ ID NO: 2301 - DNA, 300 bp, Homo sapiens
agtgggtagcaagagttctgtgtaaatacttgggaggcatccaagcggagagttaagtaggcactgaatatttaagttgagctgaggggagtgatctagactggacataaattttgggagtcactagtatacagatggcatgtcatggaactgattgagattgtttgtggccttaagatcaagccctgcgagactggagtaataaaactctggtctcccacacagccagctctgtgtggggaaaaaaaagccctaaaacactaacaacggctaaagcttgggcaaaggagactgaaaagg

SEQ ID NO: 2302 - DNA, 300 bp, Homo sapiens
  misc_feature (1)...(300): n = A,T,C or G
gctatccctcctcctgttccaccctccagaggtagtctctgttacccttttatttataacttttatggtttttttttctgtatttatacaaatcgatgcacaaagagggttctcttctctcataaaagtgattattagtcttcagtgtgcctttttttctcctaacaaatgtaaactgggagcattttcccaagtacatatttataatacttacggngcctatctagtattctgtgaatatatactggtaatttattccttcccattgacagacttaccttgtttccatgtattgccatt

SEQ ID NO: 2303 - DNA, 263 bp, Homo sapiens
acttaattcacttgagtagaaatttgtaatttagccataggaatttaggaagtgttagttacaagaggtaacttgaagctgtggacatgatgatagcttttgttgcataattagaatgtgccaaacactttgctaagtgcttatgatagcttttctcttcagaacatcaccatgattatttacagtataacctgtattttacagatggagaaatgtacgcaaaggaaaggggcataacttgcctccagggtcacatagatagc

SEQ ID NO: 2304 - DNA, 300 bp, Homo sapiens
ataacactgagaaaggagtatggtatacttggtttgaactgtgtgctacactaccaggccccttccacattatactactaatttatttaaaatagataggtatcacactgagaggatataaaaaaaatttctgcctcttcatttttgtttcttgtttgaacagaaaaaatgaccaaaatattgggagtacttctaaggaaaaggcaacacacattccagttaacacttggatgtgaaaatatcaatgaatattagaatttataagtcaaactggctctgctcgctgattgcaatttttag

SEQ ID NO: 2305 - DNA, 300 bp, Homo sapiens
cccagggaatgctggcttcctcctattgctattccttgcctttcctaatgccttgaatcagtgcattcattcatttgttcatttcaatcaggaaatatctgtttagcacaaacatagatatttatttatctaagtggaaaagaatattgtaattctcagtgttggtaactgctcctgagattttaaaacgatacaacattttttcagagcaagttgttgatatgtatcaaaagtcctaaagacacacccttttacccgtcaattctacagtcgagtcatctttctaaaaaaaaaaagaat

SEQ ID NO: 2306 - DNA, 300 bp, Homo sapiens
  misc_feature (1)...(300): n = A,T,C or G
cccaccttctctctctcattgtctgattgaaagcaccaggtctcccacattgctttcatctttgtgctgtttgttgtccctttccatatctgtatttatgctacctgttagggctcttgccgaagcaggggtgggaacaagaaccacagatatacttctgtggtttgtgaagcattgtgtggagggctgtgtacacagagtacctggggcagttgtcacagccactctgtgtggtagctgctactgtgcccatcttagaaatgagaaggctgaaggacccacccangccacncagccagt

SEQ ID NO: 2307 - DNA, 300 bp, Homo sapiens; identical to SEQ ID NO: 1477

SEQ ID NO: 2308 - DNA, 300 bp, Homo sapiens
attctgctgaaagcctgctccccagaagggtgggaacaatagggacaatgaactgctgttgttcgttatgtttcatccccattccgtttcattttattgaattgtaaaccgtgtgtataacaacactttttaatcaattttttaaaaaagagagagtggaaagaaaccgcttcctacaacagaactgaagagcacaccagtgattacagtgtccagagaggagggtgcattaacactagttttattatttcaatcagatgccaagcaagaatatatctggggttcagacaagaaaggctc

SEQ ID NO: 2309 - DNA, 300 bp, Homo sapiens
ggaacctctacaggaatgcagtgggcttagttttttaatatggaccaggtcttgtttacctttgtgttcccgcaaggcctagcccttcttaagttttcagtaaatattttgatattagcttacctgaaggttttatattgtttatatttcctatgatttatcagtctagaatataagcatattaagcagtgatgaagtctgaaagtagagaaaacttcagattgtttcaaaataggtgatttggaaggtgtatttattctgataaagcaaatatatagctgcgatgggaaaatatctaat

SEQ ID NO: 2310 - DNA, 300 bp, Homo sapiens
gcaatatgtagtttgccataaaatgaatgcatgtcttattcttttccatagttcttcattaatgagacttgtagtcaagaatagattgaagataccattctccttgtgtagttcaaaaaaatctcctctggtaatactgaaacaactaatttttcttattttgtttgttcctctttattattaaatactatgtgaattaactctttagtagttggcctggttgaagctctgtgaggagcaaagcagccctctccaggtgaactgcttgactttaccacctgaaggagtatttactgcaag

SEQ ID NO: 2311 - DNA, 300 bp, Homo sapiens
ccaacgatctgtatcaaccacgtcttcattttccttttcctgtttgtcttactctccccccaaaaagagtcagtttcctgttttctcaatttctcagtttaaaattagagccctatggcaggtgccatgtacagctgcaaaggtggcaagaagccctgagaaagctcaagaagcaggtcaagggggtgggtaaggaagatgggacgttcaagcagaaacaaaaagaggagctaaaagtgaaagccaccccgccaccagccctcaccagtcacaggtggaattaaagaaatctggcaaaaa

SEQ ID NO: 2312 - DNA, 300 bp, Homo sapiens
tggcagtgggagtcgaagcgagggtctgaagttcacgactactagaaggggaggggagtggaaaggctctcagtgaaaaaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggctcctggagtcttctgttctctaac

SEQ ID NO: 2313 - DNA, 300 bp, Homo sapiens
agcataagaaagctggaaaataacctataaataatggcaaaaaaaaagcaaacaataggaagaggaactatataaaaggaacatttggagcatagaagagagttcatggaaatgtaaaaaatgatggtaccctgggtttgatatagtaagtaaaaaactaagggtaagagggtcatgaaagcatctagaagtaggagggaaagccagtcaaattcacaggatgaagtcaggaagataatagagcagtgcccgcaagatcctgagggaaagcaagttccaatctataagtctgtaaccctc

SEQ ID NO: 2314 - DNA, 300 bp, Homo sapiens
attagatactatagtaggttaataatgactaacaccttgtcatctcatcactgagcttttgtctaagatagtctctgaatttagaactgggacgaaagtgtacataataggctattataaaatttttagaattggatttctaaacttggggtcagtgaatctagcaggcttaagcagtgttctcaggtttttctggcacagacaaggaatataagaggaggagagaaaaggagagacagtagtgggagggaatagaatgagagaagatagaaaatatggaattaatagagaaaggataca

SEQ ID NO: 2315 - DNA, 300 bp, Homo sapiens
  misc_feature (1)...(300): n = A,T,C or G
agcataagaaagctggaaaataacctataaataatggcaaaaaaaaagcaaacaataggaagaggaactatataaaaggaacatttggagcatagaagagagttcatggaaatgtaaaaaatgatggtaccctgggtttgatatagtaagtaaaaaactaaggggtaagagggtcatgaaagcatctacaantaggagggaaagccagtcaaattcacaggatgaagtcnggaanatantagancagtgcccgcaagatcctgagggaaagcaagttccnatctannnctctgtaaccct

SEQ ID NO: 2316 - DNA, 300 bp, Homo sapiens
taacagtcctatattgttacctgggcaagttaaatagtcctaattgtccctgagttgttagagaatgtttgtgaaccactcagcacagaccttgacagataggtttttgttttttgcttttttgaagtacatgatatagacaggaacacagatttttaaatggtagctgttactaagtgtgggagagagctttgactctggcagtttgggatggcctttcaaaattgacaagtgtggttgtaagggttagagagtaagttggtgatgaatgatacactactctttggagaataaagagcc

SEQ ID NO: 2317 - DNA, 300 bp, Homo sapiens
gatagaataaccaatttaaaatgtcttatagataaaatctagaatgaagctttggtaagaagtctgagctacgtacataagattatcagcaacatatatgttaaggtggagccatttaaagaaagaacagaagggacctatgatttactgattgttgaaaatcaaaataaaggaggcagagaaaataaagattgtgagtcagcaggacttttgtcttattttcaagtggatttattgattacttttcttcttacagccaagtgcaagatttgtgaatgggcgtttgaaagtgagccacta

SEQ ID NO: 2318 - DNA, 300 bp, Homo sapiens
gagttctcttgtgttttactctttttacagtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacc

SEQ ID NO: 2319 - DNA, 300 bp, Homo sapiens
gatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggt

SEQ ID NO: 2320 - DNA, 300 bp, Homo sapiens
gtaatttgtaaattctgtggtacttttcaaatgtatatcatttactgagtctgattatcacacggcctggcatataataagtactctataagtattggctgatttctaataggtctgaaaatttatcctttagaattttttcttcagttggtttagcgagtttccctttgatgttgaaaatgtttttttttaaaaatctaacctagaccatcccaaatcatgaattactgttgtgtgaaacagtgagactactgtttttatgccacaggtttataattatgcaaataaatactacatctt

SEQ ID NO: 2321 - DNA, 300 bp, Homo sapiens
gtgatctgcccgtctcagcctcccagaggagcacgtggattacaggcatgagccaccatgcccggccctggatgtattttctatcctagaatgtccacctttaaaaatgaagcccagtgaaaagtgttcccccactaaaatgtggactgttttgcttgcagggatgtgtgggtttctggtagatagaaggctagagctagcaccttcccaaattgcagaggaatcaatcctggcttgtctgtgagctggggaggaatggaaaggtaggggccttgagagtccttaattacatagggaatg

SEQ ID NO: 2322 - DNA, 299 bp, Homo sapiens
agtaaataatataatattaggatatgttaggtactgtgatgaaaagtgaagctgataagggtatagtggtgacttagggtgctgatttagagtttggtcagagaaagtctttctgaggagctgtgcgaggtttgctactatctagaggcacagacgagattcagcccaatgaagatgacaaacgctcctgtaacacattacccacattttctgtaggacactgttttgtcgacctatacatatatggctaagtagtctgacactatggattcagtgaagcatacggtatgtgcccatgg

SEQ ID NO: 2323 - DNA, 300 bp, Homo sapiens
caagagcaagggtggagggggacagattgtcaggtcccgaaatgtgtgttgacacacatgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagatgtgtt

SEQ ID NO: 2324 - DNA, 300 bp, Homo sapiens
tctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtggcggc

SEQ ID NO: 2325 - DNA, 300 bp, Homo sapiens
aatagcatgagcgtcaaaaacaggctgattcaaatcctgttatccagatgcaagtggttatgtactctaagcctcagtttcatcatctgaatatagatatggtacttatcttacaaggttgtgataactaaacataataatgtatataaggcatagcatagcatttggcacatactaggtgcccagtgtgtagtaattgctgtgactacatggtataccaccttcctctccctgagaaatctcaggatattggacacactgaactactccattctaaaccttaaaaataaaaacaaaagg

SEQ ID NO: 2326 - DNA, 300 bp, Homo sapiens
attccatccacttcctccccccattcagcacaaggtacggttttgacaggtagcgtgatgagatttagaacagaggctgaagttaattgaggttagcaagaaaaatattactgtcaatttcagattttttctttaattattttaaactcatgaataatcagttaaatgaaaaagaaatgcacatttaagagcatcttgaaaattcccactcctaggtgcgtcagaggagagaagcctcttgtgacactatctacaatagaacacaccactggctttttgcagatgacatagtttttgttt

SEQ ID NO: 2327 - DNA, 300 bp, Homo sapiens
gtgaccaccactccattcttgtctcctgtgttctcggttcagaccacccacaaaggcagcttcaaagccaaatcctcaggaagggggatctgcccgggctagctagtcacgtgtcaggcacagtcagctctgttgaggggtgtgcagtgagggctcagtgaggccacagagctcagatgtggctatgaagactcctggttggtgggggatggcagttctcacagatgagaggtatggatgggctgggtgcaatgactcacgcctatgatcccagccctttgggaggccaaggtgggcaga

SEQ ID NO: 2328 - DNA, 300 bp, Homo sapiens
gtattcttcttctactggagaaggtaccgaaaaagaatttgatcctctgattgcctagggttttgagacatgagaaataatgtactttgatctggttttgagaaattattgcatattttattttaagtgcttgctgcctctgcctttccccttttgctcctcaaatatataaagtaagtagcctgacctacaggaggactgttaaaaatcatatcactagattaaatagaattaaaaaagaaacaggaagattgaagatgtagtttaatatatgtatcattaataatagaataaatacaa

SEQ ID NO: 2329 - DNA, 300 bp, Homo sapiens
cttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggc

SEQ ID NO: 2330 - DNA, 300 bp, Homo sapiens
gatcattttaacatgcaatcagcataaaaaaactgagaaatctcacatacttttctgtgtactatgtctttgaaatctgttgtgtattttatactcaaagcatactttaatttggaccagccgcatttcactagtttcatgtggctggtggctaccacatggctcagtgcaggtgtaagacacagataagtagtctgtattgcatttagattactgcagtgtcctcgggtgctttcatcgttcacatcagtggaaagccttgttcaaaccaatgtggaattggtgtttcagacaatggta

SEQ ID NO: 2331 - DNA, 300 bp, Homo sapiens
ggggtctcttctactgtcttattggaccctagcagtggctctgagccagcagtcctgtcagttgatttcttggtcgttcctttgttttcttctataatcacatgtggactcagaatgaattttgagttactctgaaatctatttattcaacagatatttacttagtacctcctattgccagactctgctttatgttggatattattttttaaaagcccaccttgcctagatttcctcaaaggaccaggtggcttccctggttttgaaagaccctaattcttactatgatcttaagtaaat

SEQ ID NO: 2332 - DNA, 300 bp, Homo sapiens
gagcaaatgagactgttctggtgaaatgatgaatggcagttacaggcaatggtgggagaaagtaggtttcctcctagtcctacatggtagcatgattttccttggcagtaacatattaacttgattacgtgtcaccggctctgtaatttgttaactcatttgattagaacatgttgctaattcagtcaaggtttccagttgtacacattcatttttgcttctggatctttgcatatgctattctctccttctagaacacttgtccatttgtccaccggctcttcacatgaccaaatccta

SEQ ID NO: 2333 - DNA, 300 bp, Homo sapiens
cttcagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggat

SEQ ID NO: 2334 - DNA, 300 bp, Homo sapiens
cctagacacctcgtattggggaaagtcttaagtggttggagcccatgacatttgggtatgatgactagattttttgtacagctgagcctcaataaactcatgcgtacacttgtgagaactcaaatcagaaatgggcacagaaactggattacatttctgtgctctgaaatcccacagagttcataaaaatacacatgtatacacaaaagcaacaaatgtaagttacattttattatggaaattgatattagtgaaattgacagctttctatggttaaagattatcctgtaggtgagccaa

SEQ ID NO: 2335 - DNA, 300 bp, Homo sapiens
gtattctgttataggtaacagaaaacaaactaatacaagtggtaatgtgtccagctaaaaatttgggttctgttaaggttaaaagaaaatttgaggtagccagcagtatctgcctcagatgctgagaagcctcctgagataagagcgtataccatgtccataactgaagttttaacattctctgccaaacagaaccagaatttaagggcaggagaatttgcaagatagaatttgcaatttgcaagagggaattgcaatttgcaagagaggggcaatttgcaatttgcaagagagggcaat

SEQ ID NO: 2336 - DNA, 300 bp, Homo sapiens
cagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggcaagtggaatataagcccctttcgggcat

SEQ ID NO: 2337 - DNA, 300 bp, Homo sapiens
aatcaatgaaacatttacaagaagttcaagtaagatctcagtggtgacaggtctagcttatttcaagagctgcacaaaagccacttaacctggcaacaaaaagttaatgtgttggttccctttggtgtattatattcagtctattaaagttttgattgtgatgttttcattgcagtttttataccggataaaatgtattttagaagtagaacttttggagctgaaatagtctgcagaatgtagcttgaaaaccacggcagtgaactactaagggaaagtttcagaattcaagtctagact

SEQ ID NO: 2338 - DNA, 300 bp, Homo sapiens
ttgaaactgaaagccaacttgaaaatggaggtatggcttataattcagctgtgctgaactgtaagtgattaaatactgtttcatcacatatacacatatatatacttatgtggtatataggtcctgttctcattgtacttatgatatttagtgttgttattgccatatcctgtggggggaaagctaagaacctcagtaatcttagtaaatagtgctatcatcagttcatttactcaagccagaaacacaagagtcaccctcagtttctccgtcatcccacatttaatctatcgccatttc

SEQ ID NO: 2339 - DNA, 300 bp, Homo sapiens
caaatacctaatgcatgtggggcttaaaacctagatgacgggtagataagtgcagcaaaccaccatggcacatgtataccagaaacttcacattctgttcatgtatcccagaatttaaagtaaaatttaaaaaaagaaacgtactggaaaatctgaatagaccctctgctggaagcattatgaaaagtaaataaatggatatactgcatcatcctcagaaaaaataaaaaagaaagaaaatgcctgcccccttctgcccacaaaacagattaagcaggggctcattgttggtgtcagaag

SEQ ID NO: 2340 - DNA, 300 bp, Homo sapiens
gaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaaca

SEQ ID NO: 2341 - DNA, 300 bp, Homo sapiens
ggccaggctggtctcgaacacctgacctcaggtgatccaccctccttggcctcccaaagtgctgggattacaggcatgagccactgtgccctgcctgtaatttttatttaatttttccggtgatggcatgagtgaatgtccacatttaaagttattttggttcacacatggcctttgtttattatttatgagaaaaaattatagaaataatttaagggtggtacagaaatgcaaatctagaggacttaaaatgtacatgaaaactccatttgatatgacaaataatttacaggtcaaata

SEQ ID NO: 2342 - DNA, 300 bp, Homo sapiens
aatggatgaatttttgtttgggttgaagaatctctctgagaagttgacacgtgggggcaatggtttgtttctcttgtatttctgaagttgcaaataatcatgtaagcagttcaaccaggagtttacaccaaacttttaataggcgatatatcattattttttttcccattggtttggataacatccactttaactggcagttagtcatacttagctatttttgttaaagcaggtgatttattgttattttatatttatgacatgattaataagtgaatatggaagattttacattgactt

SEQ ID NO: 2343 - DNA, 300 bp, Homo sapiens
gctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacagccccaaataacaaatgctcttttgtgttttgataggttggat

SEQ ID NO: 2344 - DNA, 300 bp, Homo sapiens
gctccttcttactctagtatctctgcctttggtcagtcagagagcatttgatgagtaccatgctgggctggaccccatcctggctgccctggaagatagagacaggtcaccttgatccctgcctgtagcatttgggctggctgagatggtggaagtgtgaacagaatattccagtccagtgtcctctgtggtagggatggggatggacccgggagaggccctcctgttcctggcaggaggtgggactcagagttaaaagtgaggtcaaggcccagtgcgatggctcacacctgcagtcct

SEQ ID NO: 2345 - DNA, 300 bp, Homo sapiens
ctcagcctcccaaactgttgggattacaggcgtgagctaccacacccagcccataagcctgatttaaacctagtccacaaacacctggctttctctggcataatttgacagttgctttgagtgccagagaatttacgtcattgtgcctgggagctcacactcagcatggtttttgctttgactccacgtcccggtttgttgttgtttttagggaggggctttctctgtatgttgcccaggctggagggcagtggctattcacaggcaccagcatcatagcacactacagggctgaactcc

SEQ ID NO: 2346 - DNA, 300 bp, Homo sapiens
ccactgctacagccttagtccagactttctctttctcttatctaggctgttaatatagcctaataaatgttccgggccctccagtctatttgtcattcaatcacttgtttcagaaatattactaggcacttattttatgccatggcacaattctaggtgctgaagacgacacagctgcgaataaaacagacatgggacctgttcttgtggagcttatactttagtgcgtagagaaactaaacagagaggtatgaaagatagttgatgggacataattctactgaaggttgggtgatcaaa

SEQ ID NO: 2347 - DNA, 300 bp, Homo sapiens
gtcctcaccaatgctctaaaacagagccatgctccttcgctttgtagggcctggtttaagttttactctagaaatatcaagcaacagattgtttccttgcggacagggattcttgtaggttttttcttgatttttctcttttccctcacaacaatattcattccatcaataattcctgtcacctctactttcaaagtatatacagtcaggtatcgcttaatgaaggggataaattctgagaaattcatggttaggcaattctgtcgctgtgtgcccattacagagaggacttaacacaaa

SEQ ID NO: 2348 - DNA, 300 bp, Homo sapiens
gatggaccctttttgccaatatgcagatgtatcatttctagaagatgtactttaattatgaccatttaatagaccaatactgtctaccttaaaacctcctttggtatctaatttcttgcaacatagtgcatctcaaataactggtaggaaattgtttgtgtctttaaacatatttttagtgtctttaaacatatttttgtttgtgtctttaaacatatttttaggaacgtatggcatgatgcatatgtccttttctttgaatctgggaggtggaagaaagcttagtttgaacaagcttat

SEQ ID NO: 2349 - DNA, 300 bp, Homo sapiens
ggcatagtcagaccctgtctcaaaaataataataatcagtaaacccagtgtggggttattcctttagattactattattttgttcttgaacaattgatttttatttttttagactttttagcctttatataatcattctgtgtactctgccttcataataaaactggaaaaattatgagcaagaaataagaggtactagttctgaggaatagttaagattatcatactgagtccaattgtagcagaattttttgttgcttctttgtatgatacttaaaatagttgaaaatttgattggat

SEQ ID NO: 2350 - DNA, 300 bp, Homo sapiens
gttgggcttagaagatggggctgagtagggagagagggtgctgcctgggagctgagccatacaagtgactgcacaggttgacatggaggattaggtggagtgaggcttccaagcagggaggggaatgatggtggggcccaaatgaggagccacatcgaagtagatgagagaatagaaggtgaagtaagggctggcgttgggtagggggagacgccagcagtgatgctgatgcccaggctgtaggtgtataggtgccatccacctggtaaagagagagctgtagcgcaggaatgaggttgc

SEQ ID NO: 2351 - DNA, 300 bp, Homo sapiens
ggcacatgtatacatatgtaactaacctgcacaatgtgcacatgtaccctaaaacttaaagtataataaaaaaataaataaataaataaaaataaaaaaataaaaacacattataaagggggcaatccagatggccagtaaaccattgtaatagccagaaattggaaacatatattcattgacaacatttaagattataatatagtcatataatagtcctgatataacaatggaaataaattacagctacacacaacataatggataagtcttaaaaagccacatgtacagaatacatac

SEQ ID NO: 2352 - DNA, 300 bp, Homo sapiens
gcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataa

SEQ ID NO: 2353 - DNA, 300 bp, Homo sapiens
gggaattcgaccaacatggagaaaccccgtctctactgaaaatacaaaatagccgggcgtggtggcatgaactaccacactcggcagcatattttaaaatgcagttatttctgaaagtttttggttttacacaattttttttttaggtaataagatgtattgtaaggattatgcttacgtatggtacagagtatacttcacattgttcctgtcttttttgtgggggagggaatgaccgaaagcattgggaatgttaaaggcaaatgagtaaaaagaaaactaaaaaacgattacttcttt

SEQ ID NO: 2354 - DNA, 300 bp, Homo sapiens
aaaaaaacaaaaattcccataaaaaaaatagatgtttctcacatgttgagcatatatggatttcatttttaatatgattgtagaaacattagatttaaagcatattgaaaaagaaaacagtatattctttaggagcttcaaaaaagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtatt

SEQ ID NO: 2355 - DNA, 300 bp, Homo sapiens
gaatggccaaagttataattggtctttcagattttttcatatggacaagaaactgacccacgaattataaaatccatgtggaaaagaattgatccaaatcaatgtaacttcaagaaaatgtagaaaactttataaaggagtaaattggctttattctcttgatgaaaactcagtattttggtgtaaactctatttaaacaatttcgttcataaacacaaagacaaaccatggggtcaaaatgtgtcctttgcttttaaattctgtccttcatttacttgaatgacctcagtgcttacgca

SEQ ID NO: 2356 - DNA, 300 bp, Homo sapiens
gaataagtgaattggaagatagctacacagaatgaagcatagaagggaagagatggaaatacacagagctagagggtaacacattgatgctacagacagaacacctaacatacttctggagttctgtaagattagaggagagaaaatagagcaagagaaatgttgcaaggatttttccaaaaggtataaaatgtatccctgaatatatttttagtaatctcaaacttcaggcatgataactaaaaccaaattaacataaaataatacaggacgcaaaagaccaatagaaaatctgaaaag

SEQ ID NO: 2357 - DNA, 300 bp, Homo sapiens
gctcaatcaatatttattgagtgcctacgacatatcaggctcagttaggagctggggataaagcagtgaccaaagcagacacagttccttctccagtgagattataatccagatgggataggctataaataaaggaagaagttaacatatatcaggtggtggttagtgctgctgagaaaaatgaaggaggggagagagaaaaggggatgccacaaggctagggtagagagttctgtttcatacagtggtaaaggaaggcctttgtgttgagtgctttgctctggaacgactttaggatgg

SEQ ID NO: 2358 - DNA, 300 bp, Homo sapiens
tgtacttaactgttgtgtgatgtgtgcttttgttaggcatcactgtgcccaagtatttcatgttcattgtaaagaggaaaaatacagatttctctataatgtcaccacttatttctaattgccacttttcatcttgtggaaatgccatgttttgattcagtcttctgaatttgaacattattcaggttatttccaattgctgggaatatccttactgctaaaataaattcttagcattggaattgctaggtcaaagattatgcatgctttttaagggctttagaaatgtattgccagtct

SEQ ID NO: 2359 - DNA, 300 bp, Homo sapiens
aaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacg

SEQ ID NO: 2360 - DNA, 300 bp, Homo sapiens
tatctgtctgtcttgatctctattctagcctctttttctgattggccctctcccctctcttctgtctgattggcctgtatccttccatcaccccatctgtctgctggattctccctgtctgcctgcagtaatgtatgtgatagcactttataaattataaagcactatgttgtataaaacaccattatcactttgtcttccttcttaccttattttttcttcctttatctgtcttcccttcttctctctttctctctctctctgtttgcctgtctgcatcccttttggtgattttgcctg

SEQ ID NO: 2361 - DNA, 300 bp, Homo sapiens; identical to SEQ ID NO: 1593

SEQ ID NO: 2362 - DNA, 300 bp, Homo sapiens
ggcagagtaagtacggtaatttctgcacccgaatgggtagtgttgcctttgaagtagtcaccttgggaagatgtatgtttattccagtgaagctgaccttacacagaacattcctagaaccctctttagaaactgtcaacttgtaagggtcttcagtgttggtaaatctttgtcctttaagggtagatctattttttgaggaatgatttttttttttaacagctaaagagcattagaaaataagtctgctaaataaaatgggtgaagcagctcaggatgatcttggtgggcaggaggagg

SEQ ID NO: 2363 - DNA, 300 bp, Homo sapiens
cagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggagg

SEQ ID NO: 2364 - DNA, 300 bp, Homo sapiens
cctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagag

SEQ ID NO: 2365 - DNA, 300 bp, Homo sapiens
gcagtacccccccccaccccacagtaaggcgggctccagcagagctgtggtctaacccaaactctgctgtgtacctgctgtgtgaccctggtcaagtttctaacctctctgagctccagcttcctcacctgtaatatgggaatagcagtgtcttcttcatggtgtggctgtgaaaatcaaatgacataagaactcaggtcctgacatatggtagaaactcagtcggcagtagctatttctaacagagtttcccctctcagcatctgatagccttcctgttcccttccaccctccacctgg

SEQ ID NO: 2366 - DNA, 300 bp, Homo sapiens
aaagcatgtgtgttggggggtgccgtatcattttaccatgtgataagcacttttcataggtagcaaagacacattatgtaaacttaggaggaggagagaatgcaaatttgcatgtgaattttattttgattaatcgctttttttgcttttcagcaatgttatttatgaacaacaaaattatagaaaaagtgagaaaaagtcaattatcaattattttctgatgaacaacaacaaagacaaaaaaatggtgggattgatttattttcccctgacagaattgattgtttctttaggttctat

SEQ ID NO: 2367 - DNA, 300 bp, Homo sapiens
tttagatggagctcataattatacaaactcatctcgttcacaaatccctagggctcaatgttaaagtcagccattgtttaaggcagaaattcaggtttagatatagtgtagcaaagattttccattatatgagatatcgatcctattaaacataaaacttttctcttggctttctattttactgtcttttgttgccatcagctgtatgccccttaattttttctagtaataccttggaatttaaaaatgaaattacaaatgtttatgttttagtgtttttaaaaataattcgattaagta

SEQ ID NO: 2368 - DNA, 300 bp, Homo sapiens
attgcacattgattttatctgtaagttgtctttatcagtggttctcaaagtgtggtcccctgctagtatagtatcagcctcacattggaactggttagaaatgcagacttctcaggatccacctaattgcagtagttaattttaacaagcccttcggtgatcctgaaacatgttacagtttgagaaacactgctataatacgtttcatttaaattgtttcaggttgtgggggtagggaataagactaccaatttattcatcttctgtgcaatattacctgtttacctaactcttagagat

SEQ ID NO: 2369 - DNA, 300 bp, Homo sapiens
aaagaactcaaagggcagcaataccagcaagaaggaaaccagttaggagataattgtagtaatccagggaaagaaagatggcagtttatactggggcattgccagtgtggatagaaatagatctcagaagaattttaggaagtagaagtggcaaaacttggtgactgaattgtgagggcagaagtgggagaaatcaaggatagagtttcttaaacaagctttggtgaagacagggactaccctatttgctgtcatgtatccacagcttagcacaaatctttatacgctggagatgcttga

SEQ ID NO: 2370 - DNA, 300 bp, Homo sapiens
gccctctacagctgctgtggatccccccactgacctccaaatcccctcggcctgtctgagttcacaagcagctgtggtgtgtagcaagttgatagctaatgagcttctcatgggggcaccaaggagctggtgttactggcatgcaggcacagttggtgtgtgcactgggggagcatgacgttaatgcccctggaggctgccttctgccagcaggggtgggaggcagggaataaatgccccaggctcttatcctctgctaggatgattctaaggtgagattcacagggtttttcatagggt

SEQ ID NO: 2371 - DNA, 300 bp, Homo sapiens
ctgagtctccttatagatgaggcagcagaggccttttacaaatacctctcttgttccagttacacaagtcataatttactgagcacgatggtaaaatcctttaaaaatgtagtaaaaagaacagagtatgcatatgcaaaggaggagattggggaaagcaaattagaagtctatgcattctgtagacagtgaaagctggttcaagcagaatgaataagaaagtaatttaaaaagaaggcatcacttattgactaaggtcaaacaggaggaatacacataaaaaccagaaactaacttcaa

SEQ ID NO: 2372 - DNA, 300 bp, Homo sapiens
gagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactga

SEQ ID NO: 2373 - DNA, 300 bp, Homo sapiens
ttttagtcacagtgttgggatttgtaatgtaagttatctcatttgacatatccacgtctcagtcggtggatgggtaatgggatgcccgcttcccctactccagatgattgatgaagaaatggaggtgtatggagatgaggtgacttgcccaggatcagagctttaagtgacagaggcaatattggaactgaggtttccctcattcaaaagccagtggtgcttgtttgcactgccacactggagcagactaactgagaccgctcttgatgggtccttttctacgagaggctttgcctgcca

SEQ ID NO: 2374 - DNA, 300 bp, Homo sapiens
caaacctgttggaggttcagcacaggacctccaacagaagagaaagggagggaagttgggtttctactttgcctgttttaatacgcagctacttgagtatgactatagattcgggaggatacatcgaaactgtagttttacccatgcttctgaactttatcgccaagggaatgccagtgtttcctggcgcattgattaaagtggcgttctgactgctcagtactagaaatgctgcgaaaagggcttctggagtgggacggccctcgtttgcattatgtcccccgcttcttcctaggtaag

SEQ ID NO: 2375 - DNA, 300 bp, Homo sapiens
gttgttttcaaagctgagtgagataacatgttctgcataatgaggaaatagtaaatgttcaatatatgggagctgttgttaccattgatattaatattaataatagtccttgcagctgtcttctaaagaacagttgtttgaccctgaaagcaaaagaaggagaaagcataggttttgggtcagatcctgcctggcttttttctgttacactgtgctgctccacataaccctacaaaatgacatacatctatggcttcaacttcattagctctgtggagaggaatattaccattttccaaa

SEQ ID NO: 2376 - DNA, 300 bp, Homo sapiens
gaaaaatatagctaacacttaatgtttgaggtctgagcactttacattaaatatttaacctataaaatgaaatgagaacttacttttattatcctcacttatacagatgaggaaaccaagacacccagagattaataatttgcctaaggtaacaaaattagtaagcatcgtaaccaggatttttggtcagtctacacaccttccccgttccctcactatagtgcctgctgcaaattgtactttaagctatagttggacaaaatattaaaatctatctgggatgataggtgaccaaaaaaa

SEQ ID NO: 2377 - DNA, 300 bp, Homo sapiens
  misc_feature (1)...(300): n = A,T,C or G
ctcggacataaattatttcattcacaccatcttcccttcccacacacacaccctggagcaaacactggcaccggttctaacaactcaaggctgcgtcccgaggatgactgctccagctctcttacgttcctgcctgagagcctgccaagagaatcaactgtttgatagggcccatctcccaggctttgagagagagtaggggcctaattttgttaagctccagntagtaaagccagagagcctaatcgcgttgacagcccccttcctgcttttcagttatttctgcttccctgaatactg

SEQ ID NO: 2378 - DNA, 300 bp, Homo sapiens
actaaaggtgtgagccactgcgcccggcataagtaagaattattaatctgttcttgcttcagaacatctgtcttttcaacttaatacgaacaaatataaatattaaacacttcactttgtcttcaaaactgctcaaaacacttcactttgtcttcaaaactgctcccagaattttcctagcatttttggtgattcaacattcatgtcaaaccaccacacttgggctccccagtttcttcatttcctcattgttgcatgcacaaatttttctctgctctatctcagccacatcctactcct

SEQ ID NO: 2379 - DNA, 300 bp, Homo sapiens
ggttgttctaggtagtttcatgcggatgctgacctaaactagaatgtagaaattagtaggaaagtgaatgcccactaggtggaaacctgaaagcacggggacctgcgatcttgtttactgttatattcctgctgcgcagctcagggtctctatgtaaaaaatgagtgaatttattttctagctggtgcctacaaaataatctgcaatgtatccatactggtttattaatggtaacagatgaaccgtactaatatgagataataggggaaactagatatggagtgtatgggaattctatct

SEQ ID NO: 2380 - DNA, 300 bp, Homo sapiens
ccagattgaaagagtcttgagtactcagcacaattaatgaaaatagactaatgctgacatacattaccatgataagtcagaatactggaggcaaaaagaagactctgtagtcttccagggaggggggaaatgtcacagacaggatcaggagtcatgatgacctcagcagcacttctggaagccaaacaatgaggcagttttcttcaaaggtatgaaagaaaataattactgatgcagccttttcttttttaaccaaacaatgaatgaagtgtgaagatggaatcaagataagttcagaaa

SEQ ID NO: 2381 - DNA, 300 bp, Homo sapiens
aacctctctgtgtctcttattccacatctttcacgtggggttgctgttatggttaattagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaatgttctttaatagtttctgtcaaaacttgtctaaaatttgtgttgtgccaaattggaaatacccactataatatggcgca

SEQ ID NO: 2382 - DNA, 300 bp, Homo sapiens
gcactttcggaggctgaggttacaggtgtgagctgttgcacgtggcccgttttgccgttttatcttcgtaggagttgccgctgctcagtactcccgtctctgttctcactcacgtgtggtgttctctgtggacgctgagcctctgcagaagctgctgactttgtcaggtccgaggctgtgtcctcagcaccaaggacagcacagggcggacactccgcgtatttgagtgagaaaatgaatgctttgcaacaaccatatcgtattgaaccgttctgtgaacgaggcccctttgctagggct

SEQ ID NO: 2383 - DNA, 300 bp, Homo sapiens
gcactttcggaggctgaggttacaggtgtgagctgttgcacgtggcccgttttgccgttttatcttcgtaggagttgccgctgctcactactcccgtctctgttctcactcacgtgtggtgttctctgtggacgctgagcctctgcagaagctgctgactttgtcaggtccgaggctgtgtcctcagcaccaaggacagcacagggcggacactccgcgtatttgagtgagaaaatgaatgctttgcaacaaccatatcgtattgaaccgttctgtgaacgaggcccctttgctagggct

SEQ ID NO: 2384 - DNA, 300 bp, Homo sapiens
tcctaaaccctctgtaggctacatgccttccgccccactgcaaaggtgtttatcagagtcaccaactcaactttgccaaagctaatagttctcaagtctctttttttaaattctccaatagaatttgatgtaagtattccctcctccttgaaatactttcttcacttggtttctaggacacaatagagaacctctttgttgatcttcctcgttttcctaaccctaaatgtttgagtgccccgaggcaatactatcttgtctctatctctgctgccatggtgatctcattcaagagtcatg

SEQ ID NO: 2385 - DNA, 300 bp, Homo sapiens
ttcacattaagtttttactggcagaatattgcttttgtttcaaaaacccatagttgcgttacagttccagatacagcattatctatttagatttaatttcgcttatacatgttttcttgctctctgctgttgtttacactctttatttttctgttactgagatcttcattcttactataatttttgtttgttaggagctcttccatgagtaattttcgttggacagtcttaatgggtagtatagtttctgagctattagacgcccaaaatattttttcatttgcctttacatatgaatgc

SEQ ID NO: 2386 - DNA, 300 bp, Homo sapiens
aagcatggctctgccctcttgaaagactaaagaaatattccatcagcagtttactttagaagaactgaaagaataggttgatactgaacccactcccagagccaggtagctgaaagggcactgtgattgttatcttactaggaacacgtggagtgggagtaaggcagttttctgcagaaaagagggattctgggcagacaaaaactacatatgcactatgttttgttttgtttttttgtttgtttgttttaaattaaaaccagaaaaggcgaagacttggagaatgctcaaaattttttt

SEQ ID NO: 2387 - DNA, 300 bp, Homo sapiens; identical to SEQ ID NO: 1650

SEQ ID NO: 2388 - DNA, 300 bp, Homo sapiens
gcctaaaattagagaattatctgctcagtccttattcctgcagaatacaaatgtcacattctaacctgttaagagattgtcttcaaaataaaactgttattaactacattaatgttagacaaagtacactttagggcaaaaggcattattagggatagatttcataatgatagagttctatagtagaatatagtaatgcaactgaacaaaatgaagctcattccactgcatggaagaatctcacagatgtgatgctgaacaaaggaagccacgtacaaacacttactatataattttatg

SEQ ID NO: 2389 - DNA, 300 bp, Homo sapiens
gtaagatcctgcctcaaaaaaaaaagtttatgttctcaaagtgctcataatctagtggtagtacagtatttgagatattagagcagtttctcctccttttgcaactaaggacatgtatccttaaagcagaaggaatggcagagtcgtgtaataaaccctcaagtaccattacttagcttcaacaactatcgacactctactgttcttgtttcatttatgcctcacctccttcccatcccccacttgaatattctcatcctttttttacagtttttaagataacaattacataactgaaat

SEQ ID NO: 2390 - DNA, 300 bp, Homo sapiens
cctaggttctagagtaaactctgccactacctagctaggttgacctttaacaagtctatttaactttttcttaggttatttctaagagagtttcaaaatgaaaaaaaatactatgtgtttgtaattttatgattataattccatttaagtaaaataacaaaaataacactcgtatcatagacattagagagttcttacttggaaagtttcatttcctaatgacatcactgaaacagcaggtatgacagagggttccctgactttgatagttttaattatcttaatttatcctctgtcctc

SEQ ID NO: 2391 - DNA, 300 bp, Homo sapiens
gcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccgggaggggcccgggagtggcgggcacgccagggtcagggagccgggcgagggagggggcccggggttggggaagggggcccggggagggaggtaaacagccctgcaggcctcggggcaccgttgctgggcggcgccggcggcatgtgctagggcccgtcccgcat

SEQ ID NO: 2392 - DNA, 300 bp, Homo sapiens
ggcaactgtaagaaattcttctttcaaggcagttgtcttcgtatctatcattttaccatacctggttaaaacagagtcccaggtacatattaaagcaagccttcatacatgttggccctctatctaaaagcctcttcccactcctttccctttacctggtaatccctgttattccctagatgcctgctttaaagagatttcctttggtaaatcaccctgaaccctcagactagtccagacctctctttgatattttcctcttgacattcagcatttatcccaattgaaagtaataattac

SEQ ID NO: 2393 - DNA, 300 bp, Homo sapiens
cttcctccaggcattataatattaggttaatttagaggagcatatttatatgtggagttacattgtgttggccattcaggagactgactgtgaaagaatccaaactttatatttctgccttgccagtttttttttccttttcttcactccatttgagacactcttgacctaatccagtaaactctaattaatagtcttggtaaattctgtttcaagccatcctgagtagcgtcactgacacccgatctgtttcagtaaggtcaaattagcatcctttactatttttctggcatttaaatg

SEQ ID NO: 2394 - DNA, 300 bp, Homo sapiens
ctcagatgccagtcacaagtcccaggcctctcatacttctgaccgactggctacaaatcaggggttcccactacctcctcagattagataatttgctggataaaactcaggaaaacattattattaagggcacaactcagcaacagcccagtagaagaggtgcacggagcaagcacggggggacgtggagtttctgtgccctcctagggtggcctcctgcccagctcacccttgtgtgtgcaaggtccccgaatcttgtagttagagtttctgtagaactcaatctctaatcctttcctt

SEQ ID NO: 2395 - DNA, 300 bp, Homo sapiens
gtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtaaggaaggtaagttttttcatagtggtatgcaaacatatcattgaaatattacatagatataaagacttagggaataaaaatagcagcaacaaatacttgatagatttatcctacttgggagaaatat

SEQ ID NO: 2396 - DNA, 300 bp, Homo sapiens
  misc_feature (1)...(300): n = A,T,C or G
aaactcttaagtatacgctacggtctgtgtgtggtgctttatacgcaccattttacttaatcctttgttaagcagtattattttgaggaaacagattgagagcgattatgtaacatggccaaggtctgacacttagtaagtgataaacttgggtcttaaatactagtcttttggacttgggcatttaaggacgactagcctgtattacctttcctttgagatccttcctcacataggaggtgaatttaataatctggatttcttgaaataanntanactccaccaaaacaantcctgcct

SEQ ID NO: 2397 - DNA, 300 bp, Homo sapiens
atgaatttgtctctgaggatattcaaagaaagcagcagtagtagtgttaaagggtcccagctaggccttttcagttctttcctatcattgttaatgtagacaaccatttcccagatttttgagataaatcaatttatttatttgcaatatttacatgcctacatggttttttaaagttattttaatgtatttttaatgattaaaaaattatgtcccgtatttattagtcattcattacttaccattatttgcatttaatccttaaagcagaagtgtacaaaaaagagattaatgtaaagc

SEQ ID NO: 2398 - DNA, 292 bp, Homo sapiens
  misc_feature (1)...(292): n = A,T,C or G
gcgagactgtctcaaaaaaatcaaaaaaaagaaaggggatgtaaaataatcgctgcaagttacagtgtttttcattaatgacttccaaatgtctcacatgtattgtctcttcccagtagcataaacaaagatgcagggaggtgcaatgagttcctacaggccctagagctgacggtaggggtgggaatacagttcacaccgcgtcttcagctgngttccttgtggatgacnnccactgtcagncanntgatnaaancagttntcaatnctaaantgctgganantnactgct

SEQ ID NO: 2399 - DNA, 300 bp, Homo sapiens
attttaagtgtgcagctcagcccgtatttagtgtattcacaatgttctgcaaccaccagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgactt

SEQ ID NO: 2400 - DNA, 300 bp, Homo sapiens
ctcagggtattgaaatctgagaccttaggcttctatttcactgaattcttataataccactgcaagttgaggtatacatttcctgattttatggataaataaactactgttacaataatactgtggaacaagcaaccacaaaatctcagagtcacaaacatttatatttcacttgggcacctgtaggttggctgtgatttagctcatctaagctggactcagctgggctgggttccaggctctgcagtaggtccagtgtatacagcacccttgatgtaagtaactccatcttagaaaaat

SEQ ID NO: 2401 - DNA, 300 bp, Homo sapiens; identical to SEQ ID NO: 1700

SEQ ID NO: 2402 - DNA, 300 bp, Homo sapiens
ggtgggcaaaggacagtccgccgaggtgctcggtggagtcatggcagtaagctcataaagaagcaagataatggaatacacaaatattactacgactttatgggtggcataccttgattcttgatccacgtggctgtgttcagatctggttagcacacattgacatcaggggctgagccaccagtgagagtcaaacccagcagccctgtcagtctaccttctctcttgacttgatccagcctcataacttcactttccgcaggagaaacacacctcttgaggtcctctgtcacaaatagg

SEQ ID NO: 2403 - DNA, 189 bp, Homo sapiens
cagaactcatatagtgtttgaaggaatgcaaagttgcaaagtggtacagtgtttttgtaacgtaacagtttttaacatatttaaacatacacttacgatgtgacctagccattcccctttgagatatttgctcaaaagaaattaaagcggccaggatggtggctcacacctgtagtcccagcattttgg

SEQ ID NO: 2404 - DNA, 300 bp, Homo sapiens
gggccatgtacctcccggacaccctctctccagccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacag

SEQ ID NO: 2405 - DNA, 300 bp, Homo sapiens
gagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatg

SEQ ID NO: 2406 - DNA, 300 bp, Homo sapiens
atcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaata

SEQ ID NO: 2407 - DNA, 300 bp, Homo sapiens
  misc_feature (1)...(300): n = A,T,C or G
cttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaanccatctcatcgaggtgtggtaaagccattggatgaggaggggactgccatggaaaggagagtttgttacttacggttctgagaggaggggccacataggaaagcccc

SEQ ID NO: 2408 - DNA, 300 bp, Homo sapiens
ggtaaccaagcacttcgtagtggccaccaatcaggaggaagtccctgattgacctagctcaggtcacatggccattctcagtccagtcaatgtggccaggcataagtgaggggggagaatagggtctggaagcagggaacctaaggctgattcacgctgatttcctagaatggaattaaaaggaaaaccccaactttccatgcccaagtaacaaaaggatcataagctacttcctttgcacccccacccactttttcttcgtggcagatggaaaatggaaagtactctgattggtcccct

SEQ ID NO: 2409 - DNA, 300 bp, Homo sapiens
aagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaagg

SEQ ID NO: 2410 - DNA, 300 bp, Homo sapiens
tctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcgg

SEQ ID NO: 2411 - DNA, 300 bp, Homo sapiens
ggtggtcatccctaccttgttcctaatcttagggagaaagaatttgtctttcaatgagtaagtctgatgttacctctgggattttttggtagatgctctttatgtgtttgaggtaaatcttgtctagttctagtttttttgagtgtttttaccttgaataggtgttggatactttgtagatattaaaaatactatgaagggagactggattattcttttttagctggaaatagagtagtatgtgaattagaatgataaagtctgactgttgtctcaggcatacaatacttaaggcaccaa

SEQ ID NO: 2412 - DNA, 300 bp, Homo sapiens
ggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggct

SEQ ID NO: 2413 - DNA, 289 bp, Homo sapiens
  misc_feature (1)...(289): n = A,T,C or G
gtccatctttgtagctgacatgacacattttaaaaatttcacattaaaatgaaggcatctaatggctccattatgtcttttagagtggtctggcccagctaattgcatattgaaatacattagatttgtcataaattactttcctttattgtcttttctgtcaatcttaggacattaaatgtatatgtttgaaattgtgtttaggtaggttatctgagcattnggttcagatanntanagagagcgntatangttcactgtnntccccacnggcttngcgactgatatg

SEQ ID NO: 2414 - DNA, 300 bp, Homo sapiens
gggcaggctttgagaggatcgactgcaattttgaaagaagttgtaccgtgagtaaaatgcgatcaaacagcattgcatgcttcagagaaatctttcttcacaaaaggaacaattggtgcagcaaaattaattttcttattttaagaaattgtcagccgggtgtgagccaccatgcccggccgacataggctattttttaaaatgcaagctcttctgaaccatataatatgatgttttaaaatatagactctgaagacaaagacctgggctcagaatcaggccccaccacttattttcaat

SEQ ID NO: 2415 - DNA, 300 bp, Homo sapiens
cccaagtcagactttgggccttacaactgataatggtctccacaccttcacttctggtggttttacatgtagcctatcatgagggtagagagaaaaggcacagaaagaaactctatgtcagcccaggtacaatggatgggggcctatggtacgcttatcttatcagcctcattgttaaaactggttttgaaattggcttccttgttttattttataagctatatgatggctttagtgttccctaccttataaagtgtgatttgaagccttgtcccaacactgtggactgcttcatctcca

SEQ ID NO: 2416 - DNA, 300 bp, Homo sapiens
ccgggtctagccaacatgtgactacaactgcatgaaagaccttaaatgagacctactcagccaaactcttcctaagtcctgtccaaacaaaaccatgaaggataagaaatggttattattattttaagctaccaccttttggtgtgattattatatgcaataataggtagcagacactggctttggttggacatgtatgttctctgcatattctgcttttgtgcatgtggagaaatgggctttctgggctgctgacaatgaggaggtagagatgttgttcaggcagatgcgtttagactt

SEQ ID NO: 2417 - DNA, 300 bp, Homo sapiens
agaaactacttctatgatttcagctggagtctgaagatacttgtttctgttcaagtcccactttaaattatgtcttaggagactgaaagcggaatcttctgagcattcctagatatctgcttagaaatatcatgcgataaagagggaccttcttaatacactgatgttcttcactaaatggatggccacaagaaaaataaagtagcatgcctataaataattgaaccataaattttcatgtcatgtgatactggaatatgggatacttttcatgtttatatatatatatatatatgtcta

SEQ ID NO: 2418 - DNA, 300 bp, Homo sapiens
tctagctcagggtctctcatgaggtttcagttatgatgttggcttgtactgtgtcgtctgaaggcctggctgggctgaagcatctgcttccaagctcactcatgtggccatttcccagaggcccagtaccttactggctttttgccagggaggccttaatttcttacatatgggcctctccatagggcagcatgcaacttggcagctggtctcccttacagtgaatgatccaagagagtatgagagagtgtgccacaatggaagccaggtatctgttataacctcatcttagaaatgata

SEQ ID NO: 2419 - DNA, 300 bp, Homo sapiens
tggaaaagaaaataaaattggcagctcactcttctgtcatttgatcttctgtcatttgcttttctgagttttggccctcctgtacaatctatctggtcgggtttacttttctccatcttcaagcagggtgtgtcttcaagcatgcatgtctgtgttttgattcggaattgatagttataatagaagcatgagctgctgggaaattatacctcctgatttgtgtggttttatttgttcatcttgcaggtttgagtagtttttggtggatgtgttgggagatttgaatgttacttagctgtt

SEQ ID NO: 2420 - DNA, 286 bp, Homo sapiens
  misc_feature (1)...(286): n = A,T,C or G
actggctgctctaatttacattcctaccaacagtgcataagagttcctttttctccagctactcaggaggctgagggaggagaactatttgaaccctagaagcagagggagccagattacaccaccactgcactccagcctggacggagagtgagattctgtcaaaaaaaaaaaaggcccntttttttnnngttttngnnanntttngtaatttnggnctttttnnnaanncccnncnnannggatnnaaaagnnnccctnannggggnttnantaannnttcctt

SEQ ID NO: 2421 - DNA, 300 bp, Homo sapiens
gtcaagcattccacttttcctatctgcaaaacagggcttaaaatagtatatcaaacaataactagttagaagatacaatggaagaaaaagtgccactttcaggagcaacaaagatgagataccagaaataaacttaacaacaaactctaaaacctacatgataaaaaatgtaaaacatcattgaagaacataaaagaagtttggaacaattgaagaatatgtcttcttcataactggaaatacacagcaccataaagatgttagtttaaggtaatttataaatttaatgtgatgataaga

SEQ ID NO: 2422 - DNA, 300 bp, Homo sapiens
gccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcatttt

SEQ ID NO: 2423 - DNA, 300 bp, Homo sapiens
ctttagccccagtcaagttacctcagcaaagactagctgaccctgccaagccctgcccaagttacagaatcatgagcaaataaatggctgtttctgttttaagcttttaaattttgggggtggtttatgtgtcaataataactgaaacagataatatatacagaataaactttagttttaataatctaagtaaaagcccactaattcattatgcagaaaaaaatgatttttttgagacggggtctcgctctgttgccaggctggagtgctgtggcacaaccatagctcactgcagcctcc

SEQ ID NO: 2424 - DNA, 300 bp, Homo sapiens
cagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacag

SEQ ID NO: 2425 - DNA, 300 bp, Homo sapiens
ttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtatcaaagctattaacataatgaaacagaaactgcatgacctttatcatgatatttttagtagattaagagatgaccaaggtaggccagtcaatcccaaccac

SEQ ID NO: 2426 - DNA, 300 bp, Homo sapiens
ctttgtcccaatatttgtgacaccagtgtaatgacttggttaagttgggttgaccaggttcctccactgtcaggttatactttttcattctgtaattaatgtatcgctatatattttatatactttgaaactgtaaacatcttgtcctcatcaaaccttcacctactaattttagcagtcattgctaattttttaaactcccattctttctacatttagtagttggcattctactataaggaagaattttccctttttccttatttgtgtatacttatttattaatatttattatttatt

SEQ ID NO: 2427 - DNA, 300 bp, Homo sapiens
cctgtgtccaggccactttccaacacagctcggcagctcctcccataagagggagagtccctctggtcaccccttgaatcttggctggtcttgggacttgctctgacaaataggatatggcagatgtgacattacggtcatcctgaacctaggcctcaaggagccttgctgtttctgctcactctccaggaaccctgcctacgccatgaggacaggcccaggctagccttcggatgatgagagacctgtggccctgctaagcagcagacgtgagagatgccatcttggagctgctagctg

SEQ ID NO: 2428 - DNA, 300 bp, Homo sapiens
agacactttagcaactgcctaactatcacctgatggttgccttcctctcctgccctgctcatgtctgcttaactacctactctaacagcagcagcagcaggaataatagtactctttaatgataaactgccttggaaggccttatttgtacatgcaatgttgaatcttcagtttccaagtggaaaatgttggtcataagcatcttccttgggcttgttttctagattatatgtatagtctttttattttgaagtcatctaggacccaccgtaagttataagatactacagagaatttcca

SEQ ID NO: 2429 - DNA, 300 bp, Homo sapiens
ggagagagaatgtcttttcgaggcggaggtcgtggaggctttaatcgaggtggtggaggtggcggcttcaaccgaggcggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttat

SEQ ID NO: 2430 - DNA, 300 bp, Homo sapiens
gaaagcttcatgttccgcacctggggggcggatgttatcaacatgaccacagttccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagg

SEQ ID NO: 2431 - DNA, 300 bp, Homo sapiens
taattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtgg

SEQ ID NO: 2432 - DNA, 300 bp, Homo sapiens
ctgaagtgaggttgaggtgggtgcacggagcccccatgccctcagtgggtacaccagcctcccagcacttcctcatgttcaccaacacggaagcttatcagagcttgttgtttcagaactcaattgccagctcactgctgaagagattggtgggtagggctgaaagaaatatcagtgggtctttgtggtattcagccccatcctgagatggcctatccaggggctctataagaagtcacctcattagcataaactcacatgtgaccaaaaggatcttgttatgaataacaaaagatgttc

SEQ ID NO: 2433 - DNA, 300 bp, Homo sapiens
cagagatctgcaaattacagcccacatgccagctgcttgtttttgtaaataatgttttaccggaatccagccactcccacttgtttacatatcatccctggctgcttttatgctacaatgaagtggagggttgagtagttgaaacaaagaccttattgcttgcaaagtctgaaataaacacactcacacacactgatttatgtatagaatatgtatacaaatatatcttttatttatctatttttttgagattgagtctcgcttgttgctctgtcgcccaggttggagtgcggtggcaag

SEQ ID NO: 2434 - DNA, 300 bp, Homo sapiens
ctcaggagctgctgcttttcccatgcctgaaaatttttcagttaagttctggattttgtcacagaacatatgacctgcccttatgcataagtttgattgaattggaaaatcagcaagagtggcatgaaagaacctagaaatctgagtctggtcaaccatctcctctattgttcttactcttgattgtagaaccaaaggacaaccagcgttgtgattcatagggctgctcttgcctctgcaagggtggtccaaacatgattttagtggtaggttcatcatgggtatgcccaagcgatcaga

SEQ ID NO: 2435 - DNA, 300 bp, Homo sapiens
cccctgtgccccttccccaggaaatcaagtcctaaggaataagagtttgttggacagagttgagccttggagggacacaaaacattgtaatatctaagatttttttcatactctcccagaaagaaccaattttcaccctggggtggcggggtggtaaaattgcccctgttcagaatacatgctctaataagcggcagccatgggattttatcctaatactgagtctagatgccaaatctttttcaccctgtctcaaaacaaacaacaacaacagcaaaaagatcactttggctgttttta

SEQ ID NO: 2436 - DNA, 300 bp, Homo sapiens
caggtgtgagcccccacgccctgcatgaatatgtatttcttaatgttatcactcattgaaaagtttcttttaaaattatatatatggcccaatcttgaactatcttattttggaaggttttatctatttttaatttatgtcctcccgcctttctcatacccagctccacaagaaaatacagatctgcagaaaatgatttgaatgcctactttctcactcgtccaaggatgatgctgcatagctagtaccactctagatgcttggaagaaaagttaattcaatcaacagatagtgcattag

SEQ ID NO: 2437 - DNA, 300 bp, Homo sapiens
  misc_feature (1)...(300): n = A,T,C or G
attgcactccagcttgggcaacaagagtgaaacttcatctcaaaaaaacagaaacaaacaaaaaggcagctgggttgtcactgatgggcagcatttgagcctgccacactggcctggaaggtcnccttccagncnggatntnnnangctantttnttacanntaangctgtcacgantganacctngctatcactgtcagctgnatatggtcatcctatcacgacatgctatatggnccgtcaacagagggcccntactttacnagttnggaccnaacacacttcaggnctgancttggg

SEQ ID NO: 2438 - DNA, 300 bp, Homo sapiens
gtcgtcggttttctgagggtacttcagctgacagagagattcagagaacgttaatggaggtaatatttggtaaagggggtttataaagaaaccaatgtttattaaatgaagaactgaacattgcatatttgatagtcaaaatatatagaacattttaaatgaaatatgaaatttgaaaatattgtcaggaacaaacatgtttctctatcacaaactctaagaaaatgactactggaaaataaggctatctgccaaattccatttggtatacacctgtactattctgtgttttttgagtag

SEQ ID NO: 2439 - DNA, 300 bp, Homo sapiens
taacagactaaattttctctgtaagaggttatttcctagatagttaatatttttggtactactttgtgctgtattttataactattaaggaatgttgcagagaaatgctatcaattgttaaaattttgccatgaatacagcagcctcactgaattctcttagtagttctaatagcttgccatttgattctaacaggttttctatgtaaaagatggtgtcatcttcaaacaatgatagtttcatttcttctctttcacctcttaccttccttgtgtttctttagcattgggcaggtccttc

SEQ ID NO: 2440 - DNA, 300 bp, Homo sapiens
agtgctgggattacaggagtgagccacttaggctagccctgaaatgcttttgtttttgtttgtgttttttgttttttaatgaaaatacaggacatggagatgtggaaagacaccttgctttattactgttgttattattattattactacagtataattcatgtatcacaaaattcacgatttttaagcatacctttcagtattttttactatattccaaaagtttgcagccagcagcactacctaattccaaaatattttcataatgccaaaaagcatgcctgcacctatgggctgtca

SEQ ID NO: 2441 - DNA, 300 bp, Homo sapiens
caaacccctcctttgtactcgcccttcataatcacttttgcttcacacacataacctctgacagccactgatgtgctctttatgactatagttttaactctggaagaatgtcatgtaaatggggctctgtgttttgcagcatcatgcagctgtaacctttgattcagcagataacaatgtgcatggcctctccactcaaggtaatgcctttcagattcattcaagtggccgcatctatcggtagttctttccttttcattgctgagcagtattccatcacaagggtgtaccacagtttgt

SEQ ID NO: 2442 - DNA, 300 bp, Homo sapiens
cctaaagtgaagatggcagcctggaaagacgtttcaaggtcagtgtattagtggctcatgcctaggggaaggaataacatttggagcaaacaggagacaaattgaaaagcttcaggaggaaaggctaggaaataagattctttgggcgagaataaggactttaaagagattccacatattcctgggaatctgaaagaccatacacatgcctagggctgggcatgtgcttaaaaagacttgagagggccctatgctgtcacctctgcctgaccttcaggctctgtgcaagcaggaagtgaa

SEQ ID NO: 2443 - DNA, 300 bp, Homo sapiens
tcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattct

SEQ ID NO: 2444 - DNA, 300 bp, Homo sapiens
cagaggctgaggtgggaggatctcttgagcccaggaggttgaggctgcaatgagttgtgattgcaccagtgtactctagcctagacaacagaggaataacctgtctctcaagataaagaaataaattaattaataataataataattctataagtgtaatgaaagaggaaagggaaatcagtaataaggaaggacgtgtatttcaggaccattttaggaatcaggtggcatattgaaggttgatgatggattgagatttagacgttcactagggaaatatataggttaaagcatatgatt

SEQ ID NO: 2445 - DNA, 300 bp, Homo sapiens
caccccttttaggatttacattagttctgttccagtaaaggcttaggtaggaagcacaggatgtagagctgagttgaacctattcccctgatcttactaatgaggtgcctgatattcagagagaccaagggacatccccaaagtcaaccagcaatccattagagctgagcctagtaccttgattctcagacatgaatgctacttgttgaattgaaaattgcattcataatacatctcttcatagattcctggccaggaagccccagagaccaaaacagtctttatcaatatttagaatat

SEQ ID NO: 2446 - DNA, 300 bp, Homo sapiens
gtgaagtggagatatgtgattgaccttgttcttttatttgaaatatattttcctatgtcttcattttccttcactgtctgtggtgatttatgtacatcagataagacaaccacctctcccagtctcgtcagactggtctcatacaggagaaagatctcaacaatgtatcctgccagagattttaaggtccttctccaatctcaaaaacagactgctatatctcctttttgtggcccactggagcttagaatgtgttatgtcctgtcagtaccctcatgaatagtatggtaggagcaagac

SEQ ID NO: 2447 - DNA, 300 bp, Homo sapiens
ggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatg

SEQ ID NO: 2448 - DNA, 300 bp, Homo sapiens
tgaatctgtagatcagtttgggaaaaattaacatctcaacaatattgagtcttcaagtatatgaatatctctccactctacttacatctttcatttctcccagcagtgttttgtagtttttcgtgtataggtctttcacatcttttttgtcatgttatccctgaatgtttctcatgtttcagttctattgtaaatggtttccccggaccttcagctccatctcttccacccagggagtccactgggctcttcttcaccttcctgcccatgacctggagcctctccccaggcagtaagtgg

SEQ ID NO: 2449 - DNA, 300 bp, Homo sapiens
gctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgc

SEQ ID NO: 2450 - DNA, 300 bp, Homo sapiens
ccatgcccagctgtaatttcttattaggtgccagacattatgaattttaccttactgggtgttgggtacatttggatgtctttaagtattcctgagaattattctcaggtgcagttaggttacttatgaatagtctaattctttagagtcttgctttcaagctctcttagggcaggagcagcctttagtttatgactaatatggccctggtactgagacactaccattctaagtacctaaatacccaatgccctgtgtagcatgaggcatttcactctggctgataggactgtgaactag

SEQ ID NO: 2451 - DNA, 300 bp, Homo sapiens
ggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggatttggtttaataaaagttgaaata

SEQ ID NO: 2452 - DNA, 175 bp, Homo sapiens
ctgaatccagtcagacttagaagtagaagctcgcagagaggaaagtctgcgtctcttcgcaatttgttcctggcgcttctccttctaagtctgaatccagtcagaaataagattttttgagtaacaaataaataagatcagactctgaaaaaaaaaaaaaaaaaaaaaaaaaaac

SEQ ID NO: 2453 - DNA, 300 bp, Homo sapiens
aggacctccagttaaatttgaatttcagatgcctatgaatagttttcagtataagtatgtcccatgcaatacttgggatacgattgtgctgaagtggttttcattgtttgtctgaacttcaaatttaactggacatcctgtatttttatttgctgtcttgcaacttggttctgagagagagacccgagttcttcccattcacactgtgtgttgggcagggcatttgggccacttgatgttggctaggtaggttctcatcttgagaaaccaaatttctgattcccagctctgtgccggtac

SEQ ID NO: 2454 - DNA, 133 bp, Homo sapiens
  misc_feature (1)...(133): n = A,T,C or G
ctccaaggatcacagtaggatcctcgttggtgacagtcgaggccgagttttcagctggtctgtgagtgaccactccaggccgttntgctgctgatnactggtnngaaagatcaagcttacgaanaaccttctg

SEQ ID NO: 2455 - DNA, 300 bp, Homo sapiens
aagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagc

SEQ ID NO: 2456 - DNA, 300 bp, Homo sapiens
ggtcagcaatttgctttttctgatgagatcctggtgagagtcatgttcaataaagtatttagtcacgtggggctccagtgatttctctgtttacaagctcattccttcctcattttctcagaactttggtgttaacagcctgtttcctatttgtaggggctgactttgacttagcagatgcctttcgtgatggaggaaataacgacccagcacctcttaattcacccaagctgaagccaaatgcgaaccctgagcagcctggattcattgacgagccagcaccactgaacccacccaaac

SEQ ID NO: 2457 - DNA, 300 bp, Homo sapiens
ctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgagg

SEQ ID NO: 2458 - DNA, 300 bp, Homo sapiens
gaaggacaaaaatatggctatctgaatagatgcagaagaggcatttgacaaaatctaaaatattaagtaaagaagattatattagtccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcgctcgagctctgctaagggatggactgcctcctcaag

SEQ ID NO: 2459 - DNA, 300 bp, Homo sapiens
tctagactctggtcgtcaggaacgggtcaaggccttcaccatgagaagagcaccaaagggagttaatatggggttgaccagaggtaggcaaaggaaggcctgtgggccaaatctggccagctacctgtttttataaataaagttttattggaacacaaccatgctggggtttgtttcatatttcctgaggctgttttcacactgcaatggcagaggtgagtggttgacacagatgccgtctcaccaaagcctatgatatttactgtctggccctatacagaaaaagcttgctgacctctg

SEQ ID NO: 2460 - DNA, 300 bp, Homo sapiens
gagatgtgtccagcgccccctgtggtgtgtgagagaaagcagctgcaactcaagtgactaggtgggcccagctggcttcgtgcaggagggcacgtcactgcatacgacccggccacccgtgttctgaaggacagcgccaaagatgggttagagtcactgctgtgggagtcttcgtccccacacagaggacaggctgctcagctccactgtgcaagatgatgcacacccagaccagtgacgtcaggacgatgctgctcacgacagcaatggtgaagatgcctaccgtggtcccatccttcc

SEQ ID NO: 2461 - DNA, 300 bp, Homo sapiens
gaaaggccagtgacatttcagtattagtgacatccagggttcgttctgtaatacttcaagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattct

SEQ ID NO: 2462 - DNA, 275 bp, Homo sapiens
  misc_feature (1)...(275): n = A,T,C or G
gtacttcctaggagtggttgcatttgggaatggaattgttaaaacttgatgcttaggagcgaatgcagactattcattgggtgtttggggtgggggaagggggggtgntcaccccatngtccatcaccttcctcctctgntctggntgntaangnaagcccttccggttcccncaggctatgatgctgcatggcanatnctgttataactcannnctacatantggaaattttttanttttctaaataccnatncngttttnctncngttacaat

SEQ ID NO: 2463 - DNA, 300 bp, Homo sapiens
gcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttaccgtcgatcacaacacgctcgcaaagaaacagagttcttacggctcaaaaggaccagacttggcttggatgact

SEQ ID NO: 2464 - DNA, 300 bp, Homo sapiens
ctcagctcatgggaatctgcctctcactggtcctcactgggtttatcccagtgaccaattctaggatgaccagaagaatgattccactgggcttgggagtgtttgctggtacctctaatctctgtgtagagttcatggtacctgtgtgctctgtggctaggtcctcagagtcagtccctgggcaggtactgtcagccttcagttttccccacagactgtgttcctgggcctgaatcgctcagactacatgttccagcgcagcgcagatggctccccagccctgaaacagatcgaaatcaa

SEQ ID NO: 2465 - DNA, 300 bp, Homo sapiens
ctgccttccaacaaaatcgtctagcgggcagaggagttggtggggcaggagttgccttattcgctgaccagtgacaactgcgagcacttcgtgaaccatctgcgctatggcgtctcccgcagtgaccaggtgcatcttcagcctgcatccccttcccaggagccaggccactccctcagctgccagaggctgggtccctgctggggccagggtgggatggaaatagacatgagcaagacaaaatagcagatatgaaactgttgtccttgagggtgtcacatttggggtggggacaagggt

SEQ ID NO: 2466 - DNA, 300 bp, Homo sapiens
gccatacaagagactccagatatgcagctagagaaacttaaggaaggtgagcttatcaacgtgcattcagaaagtggttatgattacaagaatgaagatatcccagaggaattgacattgtcagaaaacttcacattaatcgaattctcagagatgtctcacaacattgaaagcacaaaagatgaaatgttagaagctggtgcacagtaaggataaaggagtatggcagttcaccaaggcatggaaaagatgcctgctccatattgttaagttatacagtgagaagaaggaggcgaacat

SEQ ID NO: 2467 - DNA, 300 bp, Homo sapiens
gtaaaaaccctctgatgcaaaaaaaagtattaactttcacaagctgtttgtactcaaatacattttctcagtttcagatcctctgctgttttattgagtggaaagttgagctaaaacggttcaagaagaataatgttgcatttccttatgtctcaggaaacactttttatggtaacttgtcagattgtctatgaacaaacccacttttttagacattgataaagtcttcttttcttcacgtgatattttatacaagagcacttcagatgtattagatgtgactgattttaacaaatccta

SEQ ID NO: 2468 - DNA, 300 bp, Homo sapiens
ctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccg

SEQ ID NO: 2469 - DNA, 300 bp, Homo sapiens
gaaagcagtggaccccattaataatcctggccaactctcgtagtggaactaatatgggagaagggctgttgggagaatttaggatcttgttgaatccagtccaggtaactaaagaaaaaaactttttatattaatgttttcattttccccaaaatgcaatgattattaatgcttcaagtcactaatcacctgatcataggaaagaataataattacaaaaagatcagccatttaaatatgtggataaacaggcactcttgtgggaatataaaatggtacaacctctttagaagacatctt

SEQ ID NO: 2470 - DNA, 300 bp, Homo sapiens
gagagtctcactctgttgctcaggttggagtgcaggcatgtgatcatagctcaccgaagcctcaacctcctgagctcaagtgatcctcttgccttaacctcccaagtagctaggaccacaggtgggcatgaccacacctggctaagttttaaaatttttctgtagaggtggtgtctcactatgttggccagactggtctcagatgcctgggctcagcagtcctcctgcctcaacctcccaaagtgctgtatgattgttttaaataggaaaaaatttagaattttataatatcaaggcact

SEQ ID NO: 2471 - DNA, 300 bp, Homo sapiens
ttctacttgtggactaattttggtgaccatctttctgtctctgcagtctcttaagcagattgactatgatgcatgtcacataaaacagttttctttctgttctattgtggagtttttctggggctggagaacattcttttgttatttccaaacactgtctataattaccagacatgatataaacacataaggtgccaactggaatttactctagaggggactttccctctcagacttccagtcaactcacacttgtgcaacaaagtgcatgctgtcccctaaatatgcaagcagaactgt

SEQ ID NO: 2472 - DNA, 300 bp, Homo sapiens
  misc_feature (1)...(300): n = A,T,C or G
gctttaatttgtgttatttctttattgacgggaagaggtacatctttttttccttactgaaaacaaatatggattaattgcctcaaatttgcatanntgattggctanngattcttgcntgcaganngtnnagnngtanagacnctatcngnngcangccgntnctnnncnaccataagatcgtgcattatcctatgacaagatgaagcccacagatatgcccgagnnncagancacttcctgnncccctgcgnaancngannnagncctggncgtnannctggcntccctacgcgacac

SEQ ID NO: 2473 - DNA, 300 bp, Homo sapiens
aagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagcca

SEQ ID NO: 2474 - DNA, 300 bp, Homo sapiens
catcgatcttctggtggcagtcctccttgaagaggttgctgatgatgttgctgcccgagggacacaaattgttcttgagcactgaggtggtcaaagcagtcagtgttcttgagcactgaggtggtcaaagcagtcagtgtgctggagccacagcagtcaaggcctctagaactatagtgagtcgtattacgtagatccagacatgataagatacattgatgagtttggacaaaccacaactagaatgcagtgaaaaaaatgctttatttgtgaaatttgtgatgctattgctttatttgt

SEQ ID NO: 2475 - DNA, 300 bp, Homo sapiens
  misc_feature (1)...(300): n = A,T,C or G
ttcaggagttggacgactgctctttggccggattgcagattatgtgcctggtgtgaagaaggtttatctacaggtactctcctttttcttcattggtctgatgcccatgatgattcctctgtgtagcatctttggggccctcattgctgtgtgcctcatcatgggtctcttcgatggatgcttcatttccattatggctcccatagcctttgagatagttggtgcccangatgtctnccangcaatngnanttctgctcggattcatgcctatacccatgactgttgncccacccattgc

SEQ ID NO: 2476 - DNA, 300 bp, Homo sapiens
gtgtgggtcacagacatcaagtactttacaaggtaatagaatatcacaaggcaagtggaggcagggtgagatcacgggaccagggcgaaattaaaattgctaaatgaagtttcgggcaccattgtcattgataacatcttatcaggagacagggttttgagatcaaccagtctgaccaaaatttattaggcgggaatttcctcttcctaataagcctgggagcgctatgggagactggggtctatttcacccctgcagtttcgacagtaagagacggccacgcccagggggccagttaag

SEQ ID NO: 2477 - DNA, 300 bp, Homo sapiens
gacaaagcaaaacatcaacattaagtcataggctaggattatacaaatgagaacccccaccttatacattacttaatataagttaactacaaagagcctctccacttacatttttatcatgcatcttacattttaatgtccttattcttttatagaaaaggtcataatacccaataaaaaagaatctgtaatatccctgatgcagcaacaattgatcacatgctttcacatgtgaccacaataggaataaaataacagcgtaaagaaatttgaaagttgtattacatcattattcactgg

SEQ ID NO: 2478 - DNA, 300 bp, Homo sapiens
catccatgtaacgttgatattaaggccagcatctgggcccctgtgtcagattaacaagattttcttggagtattaactaacactttaatttaaaaaattgtaaaatattataaaaaagtttatagaaattatatgttatagtcaagtgattaaaatttaatagatttgtttataagatttgtgagacatttaattggcctcatgctgtctttatcagggcttattgtttggggaagtaagtctcctctctcaaagaataaaggtttttgccttttttttgaaatcttcgagttatcactt

SEQ ID NO: 2479 - DNA, 300 bp, Homo sapiens
ttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgc

SEQ ID NO: 2480 - DNA, 300 bp, Homo sapiens
ctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttt

SEQ ID NO: 2481 - DNA, 300 bp, Homo sapiens
gtacccatatacacatatacacatatgtgtacccatatacacatatacacatatgtgtacccatatacacatatacacatatgtgtacccatatacacatatacacatatgtgtacccatatacacatatacacatatgtgtacccatatacacatatacacatgtgtacccatatacacatatacacatgtgtacccatatacacatatacacatgtgtacccatatacacatatacacatgtgtacccatatacacatatacgcatatgtgtacccatatacgcatatgtgtacccat

SEQ ID NO: 2482 - DNA, 300 bp, Homo sapiens
ggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcagcttttccagcgcgctcgtcatttccggactctctgctgcggaggggggcaataccagtgacacccagtcatccagcagcgtcaacatcgtgatgggcccctcagccagggctgccagccaggcca

SEQ ID NO: 2483 - DNA, 300 bp, Homo sapiens
aattccgttgctgtcgctcagcccgcctgcacccaggtgaaatagacagccatgttgctcacacaaagcctgtttgctggtctcttcacactgactcgagtgaaatttggtgccgtgactaggatcgggggacctcccttgggagatcaatcccccgtcctcctacactttgctctgtgagaaagatccacctacaacctcaggtcctcagaccaaccagcccaagaaacatctcaccaatttcaaatccgtgatagatcacaacaagagattatgaagagggcatggccgccatgtcat

SEQ ID NO: 2484 - DNA, 288 bp, Homo sapiens
  misc_feature (1)...(288): n = A,T,C or G
cccagctacatgggaggctgaggcaggagaatcacttgaacctgggaggtggaggttgcagtgagccaagattgcgccactgcactgcagcctgggcaacggacagtgactccatgtcaaaaaaaaaaaattaattaattgcctntggnttaaacgtaaaancntttnttggancagcntaaangcntaaaatctgtttttgttccaggnggttgttaacaggactcattttttnggnctttganaggatcccggttactcaacanaantgaaggaggaatntgtaaa

SEQ ID NO: 2485 - DNA, 300 bp, Homo sapiens
gtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcc

SEQ ID NO: 2486 - DNA, 300 bp, Homo sapiens
ggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgcgtttgacacaggcttgcgggacgtgcagccctacctgtacaagatctccttccaga

SEQ ID NO: 2487 - DNA, 300 bp, Homo sapiens
gaagaactaatacagagagatattgtatacattttacctagtttccctcaattataacatctttgcaaactacaataccatatcacaaccaggatactgacattgatacctaagacaaagaagataaactgatagatttttaagtaacttttgtcttctttgtcagtgattgtcaattagagagagtcaggctatgagaggtaggctacctgagtgtcagaatgaggtaataagaataatgcttctcctcatctctactaaaaatacaaaattagctgggtgtggtagcgcatgcctgta

SEQ ID NO: 2488 - DNA, 300 bp, Homo sapiens
ggacagcatgagcggcggttggatggcgcaggttggagcgtgacgaacaggggctctgggcctggcgctgctgctgctgctcggcctcggactattcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagg

SEQ ID NO: 2489 - DNA, 300 bp, Homo sapiens
  misc_feature (1)...(300): n = A,T,C or G
gactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtcttancnntntcttgntctaggnttnatggnaaccanttnttcacntttttannatnccttgntttatnncagtttntttngtctgttnnngagtntgtntgtctattttttattttctttttntgtttt

SEQ ID NO: 2490 - DNA, 300 bp, Homo sapiens
  misc_feature (1)...(300): n = A,T,C or G
aggaagattagacactgtggccgagggcacgtctagaatcgaggaggcaagcctgtgcccgaccgacaacgcggagactcttctgatccaaccgctagaaccgcgttgggatacagcctgaactctgctgcagtgttcagantgtcacacagcccaactttagcccgcatctncaancaggctttctaccatacccancccacagcatctggtatgacagactcccggtttagctnacacctaactccattgcctattgntacttgncntttgcncatncatccnaaccttnanggtcca

SEQ ID NO: 2491 - DNA, 300 bp, Homo sapiens
gaaagagatctgacctaaccaactttatcttgccttaacttccaaactgcccttagtcattgatgggcatgggccaagctaacattgggagaaatttatttcatagtttaaatgataatagccctttcaaaaactaaatgtcctttgttaaattaatgaaaagccaccagatggggaggatgacaggggcctgaattctgctaagatgtaggcatagttaaatgattaccagtcattattctggaggtcccaatatttgcaatttccccaattacttctgtaaataacatcattattata

SEQ ID NO: 2492 - DNA, 300 bp, Homo sapiens
ctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcc

SEQ ID NO: 2493 - DNA, 300 bp, Homo sapiens
ggaaaagttccaggaccctgagacatcttgggattcctgtggtttaggaaagacctttaactaccagctggtagttgtctcagcattcttcaaatagtccggtcttgtttaatattattattattattgttatttaattttattttattgcaactgtacttagagaatagtctggtcttgagaccttttcactgtggtctgttctggtgtacggctcccaccagtgtgaagcagaaggatgactttgctctgttgtcaggacaaccttgaaggaaggagccaaatgtgtggaggtctgtg

SEQ ID NO: 2494 - DNA, 300 bp, Homo sapiens
attcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagat

SEQ ID NO: 2495 - DNA, 238 bp, Homo sapiens
aattcaaggcctctcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcaggggaggtgtgggagg

SEQ ID NO: 2496 - DNA, 300 bp, Homo sapiens
cgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacc

SEQ ID NO: 2497 - DNA, 300 bp, Homo sapiens
atcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtg

SEQ ID NO: 2498 - DNA, 300 bp, Homo sapiens
acaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacact

SEQ ID NO: 2499 - DNA, 300 bp, Homo sapiens
ccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattaca

SEQ ID NO: 2500 - DNA, 300 bp, Homo sapiens
taaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaat

SEQ ID NO: 2501 - DNA, 300 bp, Homo sapiens
agcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatct

SEQ ID NO: 2502 - DNA, 300 bp, Homo sapiens
gacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacat

SEQ ID NO: 2503 - DNA, 759 bp, Homo sapiens
  misc_feature (1)...(759): n = A,T,C or G
aggntnnttcnaanagccaggctcttgttctttttgcaggatcccatcgattcggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcangtcgggtggctgcagggaantgcttncgcctgtataccgcctgggcctatcaacacgagcttgaggaaaccacagtgcctgagatccagangaccaacttgggcaatgtcgtgttgctgctcaagaacttanggatccatgacctaatgcactttgatttcctggacccttcaccatatgagaacacttgttgctggcttttggancaacttgtatgctctnggaaccccttaancaccttggggagcttaccacgtntggtccaaaagatggcanaacttgccggtgga

SEQ ID NO: 2504 - DNA, 725 bp, Homo sapiens
  misc_feature (1)...(725): n = A,T,C or G
gnaggnnnnntttnnngggntntatgcagctcttgtcttntgcaggatccctcgattcgtttgaatatggactatagtttagataatagtcttaggtaatagttaaatgtcctgggtttgattattgtggttatatgggggaatgtccttgtactcagaagacatatgctgaagtacagtatttagagataaaagtgtcatgtttgcaactaactttcaaatagttcagaaaaaaaaatatgtatatatgtgtctgtgcctgtatatgaaagagagaacacaaatgtggcaaaatattaacaattggtgggccaggtatggngggtggctcatgcctgtaatcccagccctntgggaggctgaggaggtaggattccttgagcccagcagtttgagaccagcctgggaaacatagggagacgctgtctctataaaaaataataattcaatttanaaaaaattgatgaanataggtgaagggtatatgacctttcactacactatncttgaaatntctctgaangtttgaaatttatcaaaatataaaaattgagaaaaaattttcaaactgccacagtcaataattgaatttctcagcctgcacagtggctcatgcctgtaatcccgcacttttgggangccaaggcgggcagatcacttgaggtcaggaattcaagaccagcctggccaacatggcgaaccctgctntccaaaacccaaaaatt

SEQ ID NO: 2505 - DNA, 742 bp, Homo sapiens
  misc_feature (1)...(742): n = A,T,C or G
ttnnaatacaggctacttgttctttttgcaggatccctcgattcgctgaattgtatccttgaaaaatgctatgttggaatcttaatccccaggacctcagaatgtgaccttacttattaaaaacagggtctttacagaggtgttgcagttacagtaaggtcattagggtgggccctaatccagcatgactgatgtccttaaaagggggactttggagagaaaaacatgctcaaggaagaggatgtgaaggctacgtgaagagactggagtgatgtgtctgcaagccaaagaacaccaaaaatcgtcagccaccacctgaagctggaagaggaaaggaaagatcttccctagggccttcagagggaacacggccttgatctcagacttcccctctaagaactgtgggagaatcagcatcttttgtttaagcctcccatgttgtggtctttattgtggcagcctgagcaaacacagtggctaaggaaactaatttcaatcagagacaatattcaaaattcagcactggatattggcaggactaggcactaaccagtcagaagagatgacagctttgaactactcacacaggtgggccactgtggggcacagagatgatgtattggnaaccaggagtcacataggacgatggctcaatgacatgagaaaacagggttgganggaaggaacttaagaatgctcaataccttgnaaatgggnacaaaagaaagattanttagatccn

SEQ ID NO: 2506 - DNA, 752 bp, Homo sapiens
  misc_feature (1)...(752): n = A,T,C or G
gaggggggnttnaagacccttgctacttgnctttttgcaggatccctcgattcgaattcggcacgagcctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataaccctttcccgaaacttaaccacccttgtaatactgagagaccaccaggctaggagganganangagcctaaattctgctaaggggtagacaaaaacaattgtgangcgtttttcaaaagccc

SEQ ID NO: 2507 - DNA, 733 bp, Homo sapiens
  misc_feature (1)...(733): n = A,T,C or G
nnngggnggttttanatcagctcttggctttgcggaccctcgattcgaattcggcacgagaagaggaaggtaagtagataaatagggaagtaaaccaggtttctaattcatgggtgaatccgagagaataggtatcagattagggattacaaaatgtagcatgggtactaaatatcagtacaaagcagccacaataatattgatttatggatttaagtaacccgaccaaaccttgatgtatctcatcatgttgaatttctgctccagataataaagtattgtttgatcttgtgcattggccttttatttttcagaatgattcaaaggatggctttggggattcactgtaagattttttgtcatctaaattatacttgaggtggagaggcataatttaaacaacttcataggcaaagaaaagagctatacacagcagatcctggattaggaaaataaatacgttttattattcagaacatgcttttatgaactccttttaaaaaattgcaagccttgcagtgagctgagattgcaccactgcactccacctggatgacagagaaagacttcgtctccagaaaaaaaaaatgaactccagtacagataacccccgcggggccggagatttctaccttctgccttactcccatcagaagaatcgagtttatgcatcacagtnacatgtcactggccttcagcccccggcccatccgtcaccttgctgngtcgtgag

SEQ ID NO: 2508 - DNA, 750 bp, Homo sapiens
  misc_feature (1)...(750): n = A,T,C or G
gnggnggnttnaaatanacangctacttggctttttgcaggatcccatcgattcgaattcggcacgagctggtcagggtttgactcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaagctaggatagtgtgtcgctgctgctctgtggcaaagaacagctcctttctaagcaacagcctcactctactagaataggtctgagcgcgcccattcatggctgattgcaacttccactgggtgggatttcagatctagaatctgttttcagatgccttaaagagaagacatagaaacacattcttaacagtttcaggggagatagttgggatagtttgtagttttgcttaagttatatgtgtctgntttctgcttttggtggtaacngactaacccttaatttgggtggttagagaantgatgggaagacctnaagaaagctcanatgacatttggctttgctttaaatgtgtagttttctctcacaaggctagtcagaaaat

SEQ ID NO: 2509 - DNA, 745 bp, Homo sapiens
  misc_feature (1)...(745): n = A,T,C or G
gnngggtntttananccagnctctgttcttttgcaggatccctcgattcgaattcggcacgaggtggcatttgatgctgtgggttggagcccagctttggggtcagacacacctgggtttgaatcacattgctgccccttccaggctcacatcattttatttcttttttctttttctttntttttttttttttgaggcaggagaattgcttgaacccaagaggcggaggttgtggtgagccgagattgcacctttgtctccagcctgggcaacgagcaaaaaactctgtctcaaaaaaaaaaaannnaagaaaaagaaaaatggcttccaggacagagcatgctcatttgctggcggacagttccagaaacagaccctgttagtccttctacttacctgctggatttttcaagccctaaatttataactttttgaaacaaaataatgngtaattttccatttgggggcaaactctattcttgngagcattattaaaatcttggttggtaaatatattggctttctcttaatattgctctgggtcaggaagaagctgttcacggtgtgataatactctttagatgggctttcattattatagatgcatcatgtcttctgctttcacgtgtctggggatggggtcaaaaatgcatccttcagctgacagaaaaatccaggatgagatccgaaggatactggggtttctgacttttccaaaatacttggtnggtttcattaaaaaaaa

SEQ ID NO: 2510 - DNA, 745 bp, Homo sapiens
  misc_feature (1)...(745): n = A,T,C or G
cttggctttttgcaggatcccatcgattcgaattcggcacgagcagagcttagacatccaaaactaatcaatgctgaggtggctaaatacctagccttttacatgtaaacctgtctgcaaaattagcttttttaaaaaaaaaaaaaattgggggggttaatttatcattcagaaatcttgcattttcaaaaattcagtgcaagcgccaggcgatttgtgtctaaggatacgattttgaaccatatgggcagtgtcaaaatatgaaacaactgtttccacacttgcacctgatcaagagcagtgcttctccatttgttttgcagagaaatgtttttcatttcccgtgtgtttccatttccttctgaaattctgattttatccattttttaaggctcctctttatctcctttcttaaggcactgttgctatggcacttttctataaccttttcattcctgtgtacagtagcttaaaattgcagtgattgagcataacctacttgtttgnataaattattgaaatccatttgcaccctgtaagaatggacttaaaagtactgctggacaggcatgtgtgctcaaaggacattgattgctcaaattttaaggaaatgggnccaatgaaccgtnggttgtggggaaggggaaagangaaaccngagcttggtcanaatgtggaaatnggatctggtggnaataaacatgtttaaaaccaanccnnnnnnanaaaaaaaagncctttttta

SEQ ID NO: 2511 - DNA, 775 bp, Homo sapiens
  misc_feature (1)...(775): n = A,T,C or G
nggttntttananncaggctcttgtcttttgcaggatccctcgattcgaattcggcacgaggtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaatttgtgtttgactaacaacctcgatgggatcttcttcaaccttccattaagatccctgcagnaagaaaatnggaaaatattcaaatanttgcaaaggtggtaaattggngaagaccaacttaattattaataccgtggttnaaggtttcttacttgggacccccattggnaaatggganttaaagaaaaa

SEQ ID NO: 2512 - DNA, 821 bp, Homo sapiens
  misc_feature (1)...(821): n = A,T,C or G
ggtangnatggggtttttncagcacttggtagttttgcaggatcccttgattcgaattcggcacgagcctgcatgcnntgntgcnnagtgnntgangnctgaaactcnggtatnncncatangnctgtgancantgatcantagggacntaagatncatatnntgctgctngnnactgaannncntgtggngntntagngnngntgtatncctcngngganantntccanncatngtggcaggcacctntagtcccagctactcgggaggcatnaggcaanagantggcgtgaacctggnaggtggagcttgnagtgaagccaagatcntgccactgcacttcagcctgggtgcagatgagactccgncttaaaaanaaacagaaaatacgctcaatnantaatacatttctgcccaagataagagncttcccttttgtggaatggntatgaaaaatattttnaagannnttttttaattaaccaatantgtcttgattacttnnncctttcatttgcctggatcatcatntnaatngnccttgggaaatgtgatgaaaaanggtaanccctttggntatggaatantngcntagatgancattngaattttagggganaagactattgnttngggaaancttgtaacttncttttttggcntnnaaaaattgtcnnagggttttanaanaaaaantttnggattggnttccgttgngtnattactngnaaatnctannaactttcggntagggcccanntttaatgaattttttntancccctntanntttcntaanctaanncttgtcaaanaaanant

SEQ ID NO: 2513 - DNA, 821 bp, Homo sapiens; identical to SEQ ID NO: 2512
  misc_feature (1)...(821): n = A,T,C or G

SEQ ID NO: 2514 - DNA, 747 bp, Homo sapiens
  misc_feature (1)...(747): n = A,T,C or G
nggttttagatcagctacttgttctttttgcaggatcccatcgattcgtccaaccctggcgatgtcaccagcatggtggctcaggttagagctctctgaggacccagcatagagcactggtgccagggaccaaactgagaccccaccaccgtcatcaacacttacataccataaaggtcttcagagtgccttggccctagacctcccttcattctttgtagagatggaatctaagaatgaaacatctccactcagtcctgcaaatatggaagttcttgagatacctttttttggtagatacttgtgctggtattctgagagtcactttactctgatggtttgcaagattcctaaaatcaactccagagcttacaagacaggtttgagagagggagaaaggaaaaccaacttactggcccccatgccatcttttcccgtttagccattggtaggctgggctgcacctctgtcaagtgtcctcatggtattctctctgttcctctcctcaggccatgggtgtatatggagccctcaccaaaagccccagtgccagggactncagactcactcttcagtgggagcagcagagatgtccagggtacagatgcaagtcttgatgaggaacttgatcgagtcaagatgagttantggaactgggcttggccagggagtctggggacaaggaagcagatttcctgattctggctctactttcctgccaagatttggntttaatttttaattgga

SEQ ID NO: 2515 - DNA, 746 bp, Homo sapiens
  misc_feature (1)...(746): n = A,T,C or G
gntnggttaanccagctcttgtgctttgcaggatcccatcgttcgaatncgnctngagagacagantnctgantggaggggntgaaacttcnnagggncacagagctgtncnagncctgngngctgcntatgagcactgggttcccngaganaagatcctcncnactaatactgggtcttcagagctttgcaanntggcnncaantgcttttcttgcccanagaataancagcatnaactccatangngctctgngtgaagcancangagctgatgtatancangtagcnncagcnattggaatggaccatanaatnggaaacaagtttctaaanccanngtagggntaggtgggagctgttancnaacggatgntctgaattaggatnatctntgtgangctctgaattgccanaatncnctcgttattggcancaggtnatagacatgantgactaccataggangaggttcgcttnccggatcatagatagcctgtctaatacctaactgattanaagatcctatcttgggattngcattcaaaanngacactggtgattcaagagaatcttctagtatatatcttagcacatattncgatggatgaaggtgcacattnacntatntatgaatccanaagtncctanggaacaantngtngnggatcttgnctatcaagtgttttagaggatgaccaattntnccggcttggngaccatttcnaagnntccttttgaagcnng

SEQ ID NO: 2516 - DNA, 761 bp, Homo sapiens
  misc_feature (1)...(761): n = A,T,C or G
gntnggntcnagancagctacttgttcttttgcaggatccctcgattcgaattcggcacgagcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaactacccaagtnagatttactggattaaatggcccttcgggtctgaaaaagcttttttaacttcttngcttaaaatgccgtttaattttgataagatncttnaaatngcctccaaaagtgttananccaatcatttnaaataaaccnggntgtatattgcatnatgtgtacatgcntatncccttctggttaaaactnaaaaaaaaat

SEQ ID NO: 2517 - DNA, 750 bp, Homo sapiens
  misc_feature (1)...(750): n = A,T,C or G
nggntctatagcangctacttgttctttttgcaggatcccatcgattcgaattcggcacgagctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgctgacccgtctcactgctccttctcacccgctcctggctgtggcttctcctcgaggctggtgctgcacggggcgggcagtgcatggccatgtctccttgtcagcgtcctacttacaagttgaggaagcccacagccaggaagtgacttgtccagggtcacagggaatgtggagagagaataagaaggctctggcttctanggganggangcttataactctacactttcctggccaggatcaccagggtctgttggggaacacataagtccctgcctggatggtaacccttttgccttcttccaaatgtncaatgcctggaanacggtggcctgccgggggaccaaggaccaactttttatgcaggaaaaanccccggaacttctgggcc

SEQ ID NO: 2518 - DNA, 749 bp, Homo sapiens
  misc_feature (1)...(749): n = A,T,C or G
gggnggntcnaaagccangctcttggcttttgcaggatccctcgattcgaattcggcacgagctaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccggatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacataccgttattgtacatttgtaaaccatttactgtctgggcaatagtgactccgtttaataaaagctttccgtagtgcattggtatggattaaatgcnttaaaatattcttagactcgatgctgnataaaatattatgggaaaaaaaagaaaatccgtattttgnctctnaacttttattgaagtttt

SEQ ID NO: 2519 - DNA, 796 bp, Homo sapiens
  misc_feature (1)...(796): n = A,T,C or G
gngtggnnnnnntttctnaaatagcgctcttgtcttntgcaggatcccatcgattcgaattcggcacgaggaaggggtttaaaaaggaaaaggtgtggaagagatgcaggagtggtgcaggtctgaatgtcttgttgtgatagttatattgagtaattgcccatctggaggtatggtttgtgtcatcttgacttcagctgggtaatgctaggctaactgttcgaaactccccccatgcaagaggagtctgcaactccatctctgcttggtttgtttcaaaactggcccctgaaatttctaagcaagtacgtaattagataagtgaacactgttcatggacatgcctggtgggaaagggagaaactaagggtttcaaagtatgcttccaggctgaaagcaaaaaggaaaaaaaaatgttctaaattgcattttgagggttggatactcggtctatgaaaagtgatgaattagcttctctattagtaagactttataacatctatatgnttttaaaatttttacttatttattgggtaaaagaagcatttaaatgtggccaagggctnttgacaaagttcttangtaaccaatgttagggaanaatgactttttggggcaactttttgggaaaaattgaccttgcttaaaaagccaaatttggttaanncnacccccaacccttgacaangggtttcngnaantnnatngggggcccgcccaaanggnggaaaccttggggttcccaaagaaaccttcccttgggggccccttgggncttancccantnaaattgggc

SEQ ID NO: 2520 - DNA, 979 bp, Homo sapiens
  misc_feature (1)...(979): n = A,T,C or G
gngnagnnnnnttnnnngnngcgnggnnnnngnnngntttttngatcagctcttgttctttttgcaggatcccatcgattcgcacactccaggctgagaaaagagtaattaggaggcctgaggaggggcccgaggaaaggctgttggggtgtgctggggttggtacccgagcgccttcccctcacctcaaccagagaagagcntccggttgctttttaaagcttttagcctgccctancaaggacaaagcatgttagattagagatgcttctgctgatcgcaggggttcttatttgaaaacatctatgatgggggtggggtggaaggaacaggttgtggttntgcaggaaannntgnnctaaaaattntgantnngngggtnaggnnnnnnatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2521 - DNA, 715 bp, Homo sapiens
  misc_feature (1)...(715): n = A,T,C or G
gcggtcnatgctgctcttgttctttntgcaggatccctcgattcgaattcggcacgaggtgtgagttgcatataacatatataaaagctgtaacctgggaaaaagttattatctggaagctttagaaattaatgttattctttcttaagtatcatcaggaaattaatcaaaatggccaccttgataccaaaaataaggttttggggcataacatccttatgaattcaaatgttagtcatttcacatatcttccactttatttcattaagtccttcctagtagacactgttcaaacattattcaccatttactaatgctgttacaacattattttagaagatggatatggatagctgttctagcttttaaagttttcagtgtaaagcaccatgtgctaaacattggccaggatattctgtatgaaatggctttagttacaggcctgtctgacaacagttttcatcagaaaagtatgcttattttcctttcttttagaaaatttggctgaaagcaattttggcaaagtcagcatagccttaagtgtcacatgagaaagatggaattgaagtggctgttaggtagacctgacctgggtatggtgactgtggtgacatgagtcctttggaggacacagcgtctctncagcatctctcttctgagggtcactctcttttgtaggggcttacccccttgncaatgctacacacaaaaaaaa

SEQ ID NO: 2522 - DNA, 726 bp, Homo sapiens
  misc_feature (1)...(726): n = A,T,C or G
gnggttttntcttgngcaggatccctcgattcgaattcggcacgagcccctctccacattgacctctagaagtgggcctgtccaactcctaagtccancnttcccacaccgggcagaaagctttttactggccccgttgctcccgggtgaggcctaaacacttgatgatgatgaagatgaatatgngatgatggtagccatcacacagnntttcccntgtaaccctncgaacaaccctgcanggcaaatagtntcaccatcctcntttggcaaatgaaaagctgatggctcanagaanttaaatgacttgcccaaggtgactgagccantangccacanacaggctccaaatcccantctggaccgattggatgggcattcctgggtgggccggctccctctctggcaaggctgtcatgctcccccagtgccctggcttcagctntggctggatcagtaaaganccaagtcgaagatcaagtcagggaaaactcatgttttgnggctaagaantattgctacccttaatctcttcactttctcttnagctncatgaaggagcatttaacttttngaaggagtcattttccacaaaggaaacagttcttaaaaatnctgnggggttgggctcactggctnacacctggatttccagcacttcaggangccaagatgcagatcactcgagccttaanaagttcaagaacagncccgggtaacgtggca

SEQ ID NO: 2523 - DNA, 868 bp, Homo sapiens
  misc_feature (1)...(868): n = A,T,C or G
ggcnggtcttgcctttttgcaggatcccatcgattcgaattcggcacgagggccagtaggtgctaaggtggacaccaccccttcntccctntncagacccatcccaccaccgtggntttgnccnttccnagctgcntaatcactggaccacctggnattacnngngtganccancacaacngtcctgtacnctatgntggatncctanttagatntcctgnctntntggatannnnannacntnancagacnatgaacngtntgnacatattatatnacatgnangatggttgtganacnnttngtacngtagaagtgtctcttctgagcccattgnntcnttccnagatatanntnggacntgattttgacttgcattcagcattntanaanacttttacagttgatgnnactnattaccnancgnactgctnnttcattncaaatnattattcagggtaccnaagggtatttttctaaaccattgtantttataaatccaaggggaaatttccccnttccctnnntnttnttngaaatnttggnngccnanngaaanttttnanaanaaaccaatgggctttaaaaaaaatggggccnttaaggattattaanccgngnttnattttccaancagnagggaataaaaactgccanatgnggcccaatnnanacccntgatnaaagggtggtangtatgcctngggtattnaggagggatttaanttccctttgttttnccaccncttnttggnaaacccnnncgggtaaananggnnttannttggggtnnnnggnttannncncttttnaacntnnantnnnnggctncttcccgtngnatcctnancttgatnngancccattc

SEQ ID NO: 2524 - DNA, 737 bp, Homo sapiens
  misc_feature (1)...(737): n = A,T,C or G
gnagnnnnnnnttttnnaggngcgctcttgtctttntgcaggatccctcgattcgaattcggcacgaggtttctaagcacttcctgtattgcatatcaactcatttaatcctcacagcaatgtgagatacatactatcctccccattttataattgagggaactgaagcatagacaggttacatagctggtgactggcagatgaattgacttagccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttacattgcaaatacaacagatttccatgtcttattagaaactgcttttcttgaattactacatgtaacttgaaggattggtgaatatttacagttgttgaaatacaaaaacaggtggctgaacttagaaaccaccaagtggcaggtgactttgcctgacatccgtgttcacagacctncacagcccctggtgaaaaccacttcttcatgtcccacgtccatctaattacatgtgttattttttgncatttgcagagtcaacggttgcaggaaagtttgaaagaaagtgaattacatcaaaatcttggnatagtatataagtcatctggtttcaaaatataactttttttgaacctcagcaactttgaatggat

SEQ ID NO: 2525 - DNA, 835 bp, Homo sapiens
  misc_feature (1)...(835): n = A,T,C or G
aggnntntganccagctctgttctttgcggatccctcgttcgaattcggcacgagaataagcttttctttaaattaattagaaattacttgtaggaaatgtatagaataacaatgatcattttttttaactaaatgatttacaatagtgagaaagttgaccttgagttacatgttgaaagaatagtatgtaagctggcaacagaaattgaaattgagacagatttcagcaccactgttggtaacaggctcttattccagaggaaacatgtcagttttttattagtgagtaaaggatttctgcgaagctttaagaatatctcatgttgagtattgacatgtattttgaatgatgattttatgaaataacacttgggattatttttcttattctgnatcccccaaattaccttaaaaacttacatcttttgttttgggagggatcctttagcaaatatgccttttgtatgggaaagatccttttatgaaaggtatacctattaaatattttagtttctanttaccaatatcacntattccgaaggatantttantaaaaaattggccaaaggtccaggacctcnttttaaaaaccaaaaccttttaattttaaaangaatattnccaagggattacccttaggaatttaattcccaaggaaaaatcctcaattttccantcnatggtttttggccattttncttctttttaaaaanccaatngggttnaatggcccttggntaatttgggtaataatngccntanctggagtggacctggtaggnccttggaaantnccggatctnggggttacctttggnatggactgggataacc

SEQ ID NO: 2526 - DNA, 740 bp, Homo sapiens
  misc_feature (1)...(740): n = A,T,C or G
gngtgtgnnnnnntttnttaaatgcggctctngcctttttgcaggatcccatcgattcgtgcacactaacatggcacctgcntaaaanccacagacnggtaactttagggacttcacagtggactcaagcagactgatcccagattgtaggtagaagtgtgtttgcaaaggccagaggagctgttaggacataatgcgatggagacaatttgcaacaatcactgantccacgtttctgctgtttaagggtggctgaaaggatggaggtntagcttgtaatgcaaaatatacgcagaggttcatagtgaagctgaggaggagggccttcaaaagttaagtgggagatgtttaggtcagtagcaaatgggcccagtgggagagagtatgcccagagtttggagagggtcanggtgtcnggtgctgggatgagggcttcatgtttggaagacgcaaggtagagagccangagaggaggaaaggtagaacaggatgganggcaagacctgtgtaagaagaagtcttaaactgtcaacccaacacaggcatgctcataaggaaaggttaaaaaaaaaaaanaaaaaactcgacctntanactatagtgagtcgtattacgtagatccagacatgataagatncattgatgaatttggacaaccacactagaatgcagtgaaaaaaatgctttatttgtgaaatttgngatgctattgctttatttgtaacctttttaacctgcat

SEQ ID NO: 2527 - DNA, 752 bp, Homo sapiens
  misc_feature (1)...(752): n = A,T,C or G
nnngaggntnnanancagctcttgttcttngggcaggatccctcgattcnaattcggcacgaggctagttcgagttttttttttttttttttttttttttttttttaaataaggggcaagtttccaaagatcagtgtggagtgctacagaaataattataggagaggaaatcataatcacagaaggtntaatgcttgtttgaggctccggaataagaactaaaaaaaaaacaaaaaacactggtttcatgcttacggggtacacactttggngcatcccgtgaacacaaattttaataccaaacaatccttgatgcttcacctggggctgccaagcagtttgtaaaacagaggaaaacatttagtgcagtctgtattatccttttccaacttttctgtttgtgcaagtttttgaanattcattggccaaacaatgaacaacaaaggntttctgagagaagacaaggtggacttttcattttgttagtaaataccagtggcactgttgaacgaaacaaatacttttatctcagtctttcaaatcagtattaatgtctgngtttccttccactgacagctcttcttctagtttcactgaaaaaagggtgttagtatttttatcttggcactctnttccaaatccttnagcagctcctcttctttatattctgccacatngacctntnaaccggaattgncctttantttgccgnggngctttgaaaaatcccgtngttcttaaaaacttgttga

SEQ ID NO: 2528 - DNA, 734 bp, Homo sapiens
  misc_feature (1)...(734): n = A,T,C or G
ggggnnnnnnttcttaatagtgcctngtctttgcaggatccctcgattcgaattcggcacgaggcaggtattatattatgaactactagcaattcgagagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatggggcgagatccacaagctcttgccaaggcttgtacagattcaccaagataccttacgcacaatgtacttcgcttaaatagtccaagtatattctctgagangaagtactgaaagatgaattgacatacaacgtatgtttccagtgaaagtcaattgagtaaggacaccttcagccatacagaaaccaacactgtgg

SEQ ID NO: 2529 - DNA, 682 bp, Homo sapiens
  misc_feature (1)...(682): n = A,T,C or G
gnnctnntnagtgncatccgttcnatcggacnaggaaaaacaagnatactaggcttgtcaggtttagcccnatgtttgcnagctagctgctggtgcagaaatacaagacataaatattatttcgtagacagttattatttccttactgtgaatttagcagaatttatagaagtcttttgggtagtaaagctttggttaaattatttgtttttaaaaaatcgcagttcatgaaacatttctacttattaaatacaatgtgaatactatatctattcttgctactgggtcataattgttagccctctcccatgcctcttctcctcccctgaatataacatgcgtattagaaggtttctttgtgttggatgctgctcatgaaccatatgttaagaggttgtcatattcatgtatttaagccccattgtgtgttgtgatttcatgacttttatatctaaaaaaaccatattgtagatgttctttagcttgaaacacgagtgctttgaaattttccctttacctttctatttgggcattcagtaaatctacacatctgntttangctctagtttaaatagatgatgtgatgcatttctgngatggnctggttgctgatttttttggtaatggttttaatagtgaaatttctgggtcatgcttacctggtgagttggtaagtcgttat

SEQ ID NO: 2530 - DNA, 714 bp, Homo sapiens
  misc_feature (1)...(714): n = A,T,C or G
gggnnnttgtctaatgcaggatccctcgattcgaattcggcacgagagtttccatttagtttgattttaaaagctgcctttntgaatatctaataccaattataaaataaatatgtgtaagtaaaataaaatggtaacttgttttttataagaggggaagttggttggttttataaattaaatgaacatttatgcggncggttatttttacgtaaaaatagttgttatattctaggtaacagaaatttagaaacctatttttctgtagaagaaaggtgttgctatctgcttttgatttctcagatatttgcttctccttagaatgctatgatcagatttttattagaatgaagttttctaaaggctttgattggcattagcttcattacttatttgcttaggttaagattagcccaatagacatattatctttatggaccattgcaaatttttctaatatctaaccatttttaaccttttatatatgaataattaaggaaacattcaattataataaaatttattcctggcactatgtaggcactcaataagtatttgttaattgagtaaatgatcccagtagataggtacatacaatatacagggaatctttttctactacgtgtgtttttcctcaaaatatttttttagttccacttcatcatgaaaatacttggaaactgacacccaagagaatcatgtttngggcacagt

SEQ ID NO: 2531 - DNA, 740 bp, Homo sapiens
  misc_feature (1)...(740): n = A,T,C or G
tggggttntttaganccagctctgttctttgcggatccctcgattcgaattcggcacgagaattttccttatatgttctttgacccttgaattacttagaaatgtatttnttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtgggtgaatcacctgaggtcaggagttcaagaccagcctggtcaacatgacaaaaccccatccctacaaaaaatgtaaaaattagctaggtgtggtgacacacacctatcagttacttcagggggccgatgtgggagaatcgcttgatcttgggaggtcgaggctgcagtgagctatgatcatgccactgtctccacctgggcaacaaagtaagacactgtctcaaaaggaaaaaaanaataaaatatgagaaaggttatgatacaatgttaaatgccaaaagtaaaatgtaaaatgatagctagtgtttaatctcaatcatgtaaggaaaanaaaaaaaaaaactcgagcctctanaactatagngagtcgtntacgtagatncngacatgataggatncatgntgagtttggacaacccaacttgaatgcagg

SEQ ID NO: 2532 - DNA, 745 bp, Homo sapiens
  misc_feature (1)...(745): n = A,T,C or G
ggnggtnttttaacccttgctcttgtctttgcggatccctcgattcgaaaaaaaattgtggtgattcacacctgtaatcacagcactttgggaagccgaagcgggagggtcctttgaggccaagagttcaaggccagcctgggcagtataatgagaccctgtctctacaaaaaatttttaaaagtaaagaaattttaagataactaaatactacatagtcatatattttaaatatttattacataaaggtaaaccaaatagaagaggaaataatgttatgccctacttcatatgaccaaaaactggaagatagtgtctgaaaatgaaaatgattgtattgggaaggtagaattgtggccttttttttttttttttctcagttttcttctcattacattttcaatttagtctttgtatatagattttggtttattggagaatatataatgtgctctattaatgtttaagtcataaaaatataaatttcaagtaatttaagctccaatagttatctaacctgccttctaataaatgggaaataaatatttactttttgttttgataaacatatatttgttggcaactagcacatgattttaaaagtatagtggaactatacatttatgtcttaaaattaaaactataaagttatgtgactgggaaaggaaaaataattcattcaggattatctgacatcttagtattatagtagtggtaatactacnttttngggaaatgngtatcc

SEQ ID NO: 2533 - DNA, 748 bp, Homo sapiens
  misc_feature (1)...(748): n = A,T,C or G
gntnggntttttnananncaggctacttgtcttttgcaggatccctcgattcgaattcggcacgagaatccttcttgggaaacatgttattgtcctcattgtccagattagaaaactgagtgtaaagtaagttaaattatagtcctaaggttgaatgctaataaagacagaatacaagtccaatatattggactcaaaagccctcacttaactatggtctccatgggcttcccttggctctctctgcctttttttattttttcttattgcttgaggccctttctggaaggtaagtctggattatctacttcacactgttttagagaagacttgtggtttccatttaccccttactccctccgctccatggcctttcagggagaacactgtgggtatcatgctgggtggcctggagggtccaagtaacaggaatctanaaggatggaccagatgtgaacaaaagaaagcctgagtaggacacaaaacagagaagtggggctgtaacatctctaagatattacagcttgctacttccactctctttgcaaatgtggtgaaacccangctggagtcataaaataatagcataggatcattaactaaagtttgtctagtgcttccttgtgttcacacattatctcattgaacctctgacgatgctaggaggaggtaaatagggtttcctcttaccttgggtgaactgagtcttctgactaagtctcaggtcctttctaccattgngctgcan

SEQ ID NO: 2534 - DNA, 737 bp, Homo sapiens
  misc_feature (1)...(737): n = A,T,C or G
gngngngnnnnntttttnaanncgctcttgtcttttgcaggatccatcgattcgaattcggcacgaggcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtgggtgcacctcgcctgcatctgtcactcattccactacatcaagcacccggaataaagcccgcctgccccagtcggaaaaaaaaaaannannnnnnnnnnnnnnnaaaaaaaaaaaaactcgagcctntanaactatagtgagtcgtattacgtagatccagacatgataagatacattgatgagtttggacaaaccacactagaatgcagtgaaaaaaatgctttatttgtgaaatttgngatgctattgctttatttgtaaccattataagctgcaataaacaagttaacaacaacaattgcattcattttatgtttcaggttcanggggaggtgtgggaggttttttaattccggccgcggggccaatgcattgggcccggnacccagctttggtccctttantgagggttaattgcccncttgggggaaatcatgggcataactggttcctgnnggaaaatggtatccggttanaattncacn

SEQ ID NO: 2535 - DNA, 753 bp, Homo sapiens
  misc_feature (1)...(753): n = A,T,C or G
agnaggnnnnnnnnnggnnagnnnnnnnnngnnngnnttntaatcggnatttctaatgctnggctctngttctttttgcagatcccatcgattcgaattcggcacgagccttcccaccttgtgagttctcccagcagttcctggattcccctgccaaggcactggccaaatctgaagaagattacctggtcatgatcattgtccgtgggtttggttttcagataggagttaggtatgagancaagaagagagaaaacttgggctgaccctgttatagtggttatagtggtgtccctaaagggaggaaatgatttcancaaaactggttgaacagcggatgaagatatggaattcaaagctctaatggacctttttgaagaagaagttgtggcttatgtgggagttacatgggcctctgatggaagaaactaatctgttaagtatttgtgcattttactaaaatggcagcttaaagttgtgtatctgctattgtgatgccaatgcccggtgttttaagtggaaaaaaaaatgacctctttgatttgtgctgngtacacaagaatttctgggaaaagtaaagaaaaacccttttttatggctcacacacttaagantagctgctcttaaacgtgcgctcacagttgaactgctttggttaattctaaataaatngttctttgaggaaaaaaanaaaaaaaaactcgacctntanacctatgggagtcntattaccgtnatccanacttataanan

SEQ ID NO: 2536 - DNA, 779 bp, Homo sapiens
  misc_feature (1)...(779): n = A,T,C or G
gagnagnnnnnttttngaaagccnnnnnnaggnagntttnnagaggnntttgaagccctnctacttgttctttttgcaggatcccatcgattcgaattcggcacgaggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcangacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaaattaaattctccagaagaaactgcttttcagacaccaaaatctagccagatgcctcggccttcaatgcccccattagttaaaacattactggtttcttcaaaattatctacaccctgatgtttgtgaaccccattttgggacccccatttggcttntantggtaatggaatcggattggcttggaatttttggntgtnaacacctggctattgggcacccgcaaaagtct

SEQ ID NO: 2537 - DNA, 769 bp, Homo sapiens
  misc_feature (1)...(769): n = A,T,C or G
gagnaggnnnnttttnngaaagccnnnnnnnnggnagntttnaagagnccttgaagccattgctacttgttctttttgcaggatcccatcgattcgaattcggcacgagggggcagtaaataataatagggaggatagaaaagtcagcatggcattccagatgagaaaactgaagcaagttaaactttctacatggtaaccgtgattatgtagttgatatacaaagtaatgactgtgggccttcaagaagaggtaaaatacattcattatattaacgagtgcatcttagaaagatttctttcaaaaagtagttgaagtttttttgctttaaggagtaaatctcaatcatctggaaatttaacttctgtggaatacctctttacatcttaaaggaaatgttaatgcattatattgaggttattattgcaatggaattttcaaaaatgtgagtgtgctctttntgtttctagaatctataagacacatatctggtctaagtatagtgtctactaagacaatttcacaatccanaaaatagttggttagccaaggatatcaagttcaaccccagagactagccaaagagggaaggctatgaaataaaaagcttatagatggctagnctcatatctnnggctttatncctataaaaggatctcangaaatatgnaatcanaaatatnggtatttaatctcctccttttttggnccatngcctctttagggccaanggtttttgggngaaatcattggtnggccaattnggttn

SEQ ID NO: 2538 - DNA, 754 bp, Homo sapiens
  misc_feature (1)...(754): n = A,T,C or G
gnnnnnnnnngnnnaggttnnnagnnnnntttctaatgcnaggctacttgttctttttgcaggatcccatcgattcggtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaagctctgagaaagtcaggtttgctcctaccacaggataattccgatgaacctgaaaagcgggttttggcttgtgtgcagggactctggtggaagaaagggtgacagcacctgcctgggcatgacacaagttaggacccgtaccaagaggccctggaattgagggtgggggttgctgtggactctttctccctcttaggaaactctattgggtctccatctgtcacagaagcagtaaatgatgtaggggctgccaggtatagggtcctgtggggatgctggaacatgccgangcaggacgtgccagccaccctctgcccatatgtgcacanggccacagatgtgcttgtcggtaggagagaccaagctgtctgtgtgcccatgtcttgacacctgagacttcaggttcaccccatcctggttctgccatttccatttgcaaggtggctttcccttccttttggggactctttaacgcctttggnnctgtttaaaaaaaaaaaaaaaaaaa

SEQ ID NO: 2539 - DNA, 742 bp, Homo sapiens
  misc_feature (1)...(742): n = A,T,C or G
gnnnnnnnnnggnnngnnnnnnnngnnnnntttnaatngacnggctacttgttctttttgcagggatcccatcgattcgagtgcatccatgcgttttcacttgttcttaggctacttcatccaataatatatttgagtagttctgaacaggaacacaagtaaggagaatttttttttttttttctgatacagggtcttgctgtgtcacccaggatggagtgcagtggtgtgatcttggttcactgaaacctcaacttctgtggctcaagccatcctcccgctcaagcctccgagtagctgggactacaggcttgcaccaccacgcctggctaatttttgtatttttagtagagatgggattttgccacgttggccaggctggttttgaactcctggcctcaagtgatccacctgccttggcctcccaaagtgctgggatgacaggtgtgagccactgggcccacgtgagcagcatatttttaaaagctcccctgatgattctagtggacgagaaccaccagtctatgtaattatttgtctgtttagtgtctgtctgtcccgaaggtttagaagttacacaaggggagggactgtaaatatttgttgaatgaaaaatgaatgcatgggaatgaggatatttctttgcaatactgattttatttccttatacacccataaatgggaatgctggatcatatggagctctatttttaatgttttgaggaccctncatactgcttcc

SEQ ID NO: 2540 - DNA, 892 bp, Homo sapiens
  misc_feature (1)...(892): n = A,T,C or G
gctagttngaagaggtgtttctaangnntnggaatcgacatctnnnnaggcngnccntgcgattcgctttgctctctccattccaagttgttctctgttctagaaagcngatgnngggntacatctactgtttttgcctaaacagaatccctttntcctttttttgttaaaaggctcatncctaatattacattgctctggaacgantgacaataccanaactcagcaccntgatcggaccgggacaatcagattatctaattcctcagcaaacggagatcgatccgaaaagtggaaatatganctcntnctttgtgntggcatatggaccctgagagaaagaaactttaatcttttactcttggactgcaatnaagtntagctgcctaaaaatcnntttcntgacacttngnaggtttgtccacaatcgggngaaattanngggtnngacntaancactggatgaaaaaaaatnccgnttanttntattncnnttccanncttntnaaatananantttntcanccttnnntaatactattanntatatntnttnnncccnnatnnnccttcttnctcctacnncnntncnatntnnnnnnangntcnncnannnnttctnttatttctannatatntcntancnttnactaaaacctccnctcgtnnanattncnntataatattntctctagannttntnntntnttgnnncttaaaanctcntctatccctantatnantnattcttaccatnaaatacactanaagtnntntcacgagacncgntatgttantncanactataatcgcttncatntanntatatntaaaantgctatncagnnagnngntnttatatntttanctngnnaggntatcctcnatancc

SEQ ID NO: 2541 - DNA, 749 bp, Homo sapiens
  misc_feature (1)...(749): n = A,T,C or G
gnanaggtctatgtggctctngttagttgtgcaggatccctcgattcgaattcggcacgaggatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcanggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtntacatgagtgtgcagataactnttaacaatactgatttcaatccctttgtggagttgctggatcgtattaattntggggggaacctncgtctgtttnccataatggctgtaccaatttacattcccaccaacantgtacaaagatgnccatttttncatgtctcactagcactcgggtgtntttttggtaatagcccttctaacaggtntcaggtgatacccttatcnaggttttgagtcaaattttccanatgatttaagaagttgacaantnttcatatcctgtcaancgtnagcgatgntttttttttatagnnagacaggntttnntctgttgtgcagantggtttaagatggtgcgancatggntcanttnntcctttncc

SEQ ID NO: 2542 - DNA, 722 bp, Homo sapiens
  misc_feature (1)...(722): n = A,T,C or G
gnnagnnnnnnngngnnntttnagatacagctcttgttctttttgcaggatcccatcgattcgatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtcccagtcatgtctgcaggtcccgagatatgaatatcactgggcagatggtctaatattaaaaagccaatcaaatgttctgcaccaaaatacatngactatttgatgacttgngttcaagatcagcttgatgatgaaactctttttncttctaagattggtgtnccatttnccanaaactttatgtctgtggcaaagactatnctaaagcgtctgttcanggtttatgcccatatttatcaccagcactttgattctgtgatgcaactgcaanaggaggcccaccttaacacctcctttaagcactttattttctttggtcaggagtttaatctgattgataggcgtgaactggcacctcttcaagaattaatagagaaacttggatcaaaagacagataaatggttcttcttagacacagttcccccttgcttcatctattgctagaactatctcattgctatctggtataactagt

SEQ ID NO: 2543 - DNA, 764 bp, Homo sapiens
  misc_feature (1)...(764): n = A,T,C or G
gnnngnnnnnnngnnggattnnancgantttgcnaatnnanagctacttgttctttttgcaggatcccatcgattcgaattcggcacgaggcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctactgccccttcgccatcctagantgaggctctgtccaatacatggctctgcctccagaacttcagctctcagtgacccttcgacatcctgcttgctcctgacttccaaggccccgtagttagcaattctggaaaagttaagccatctncttcctctggncctttccttctgggaatcttcaaaatgcctgttanggnccttcnttattggccctccntccttccttggcttcgggccttccnttaaaacttgaccaaaggggccttgttgcttggcccaactggggtaaacttttttacaaggttctttcccttttccactttcccctnaaagtntt

SEQ ID NO: 2544 - DNA, 764 bp, Homo sapiens
  misc_feature (1)...(764): n = A,T,C or G
gnngnnnnnttttnnaagaccangcctctngnnctttttggcangcagtncntagancttngtgcaggatcccatcgattcggaaaacatgagacatagaaatcattgagattcatcaagaaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaactgaacatttgcttcaggatgccattaagaatgccaaatcaaataatgaatcttcattttatgctgtcaactacccggcatcttttcaaaatncagaaaaaccttncaaaatcaagaaangngctttttggaagcaatcgaaagagncaaggagaacacaagntntncctcaatttact

SEQ ID NO: 2545 - DNA, 800 bp, Homo sapiens
  misc_feature (1)...(800): n = A,T,C or G
gnagnnnnnnttttnnaangtccngncnnngnnngnntttnnagagnnntttnaancnncntgttgcaggatcccatcgattcgaattcggcacgagaacatctcctcttgtcattcctaggacatagacggttagggaaactctcatctttccttcaccacctcatgagtctaaaaacaatgataaacccagggaagcttgctgaaaagcatcctccatttggttatngctctttgtctaggaaaatcagnactcagctgtgaatngtggaccaagtggtgcagaactcattactttgaacaatgcctcctcggcctgggaagcatgtnctctcttctactagcaggggcttattccaggctggctttggtcacaaggaaaatcatttagacacagttcagtggtttcttattctgtctcctccttaccctgccctgcacccctgtccttaagagggaaaaggtggnaggtgctgtctggtatcattgctgcctcgccagtaganggttgcccgctgtgcaagggtaactgcccgcctgctcccttcctgacctcccctggaccccgaagatcacttacctctggtcattcangccnttgggggtacaatcctggataaagtcgngtcaaaaactggccaaatttcaaggacttgaaaatgnggttttttaaaaaaaccaaatcccttatnaacntccactttggnacctttaanattttaaaaactgggggnaaaaatggngaanattcctttgggacccactttttttaaattnaatttaagcccttnaatggaaan

SEQ ID NO: 2546 - DNA, 852 bp, Homo sapiens
  misc_feature (1)...(852): n = A,T,C or G
gnagnnnnnttttnngaaagcnnnnnnnnngnnngnttttatagatcanttnacttgctctttttgcagggatcccatcgattcgaattcggcacgagcacattttcctgttttcttccaagccctccacagtgttccaacctctgccggttacccatttccaaagtcacttccacattttcgggtatccttatagcagcaccccactctaccagtccaatttactgtattaagtccattctcatgctgctataaagaactgctcaagacttgggtaaattattaaagggaaggagggtttaaattgacccacagttcctcagggttcgcaagggcctcaggaaacctacaattatggtggaagggggaagcaaatgccctacttcacatggtggcaggaaggagaagaatgagaaccaaatgagggagaagccccttataaaaccatcagatcttgtgagaacttactatcatgagaatagcatgggggaaactgccctgtgattcaattacttccactaggtcactccaccatacatggagattataggaactacaatttaggatgagaatttgggtggggaacacagnccaaaccatatcaaggtnttaaccagcaggaatttaacccaagcctgagggaaaagacttttcaagaagcttcaaaagactgggttcttnccaaaaattccaggttaggacccaaaaaatttaaannnnannnnnnaaaaaaaaaaaacnttggaagcccctttttagaaaacttttttngtggaagttcccnnantttacccgttnnnaattcccnagnacccttggaattangggaatncccaatttgggttngnaagn

SEQ ID NO: 2547 - DNA, 852 bp, Homo sapiens; identical to SEQ ID NO: 2546
  misc_feature (1)...(852): n = A,T,C or G

SEQ ID NO: 2548 - DNA, 879 bp, Homo sapiens
  misc_feature (1)...(879): n = A,T,C or G
gngngnnnnnttnnnnnagnnnnnnnngnnnggtttngatcagctcttgtcttttgcaggatcccatcgattcgaattcggcacgaggttgtattggaaagcagtagtgtggacgaattgcgagagaacttagtggaaatcagtgggattcctttggatgatattgaatttgctaagggtagaggancatttccctgtggatattctggtccttngntnttcatccangaatttaanaactgggaattcctaaaagttttcttaccccttgaaatggtcntgggcccctctttttaataatcctggtggaatggaatgggttgcccggttccantaattttttaattangggggatttaaaaaaccaagaaangnaaattttaaatngggaaaatttggaaccaggaatggaagcccaaaangaaaaattggaaacctgggattgnaaaaaaaanggaaaaagnccagttccgaactttcccagaaaagaacntggggaccanttcgggggttaaccantaccttcaaccntcggttaaaaggaggaaaaggccaccttaaaaaaantattantcttgggattggaagccaccccaaanttaaaggaatctggacntcaaggactggacctctggataggtggtagccattttnccctggggggaagtttttggttttaattagatggntcacttccactgggtagtgccattttggnccggacatggttggggtacccatgacccacactgatggactgcctacccatcagaactcatgcccaatggccctggtttgactcggatcatgttggcctatagtcaaatgtctgtaagtgaaanggatgtgcaaaaataaaaaaaccccaaaaagctccna

SEQ ID NO: 2549 - DNA, 797 bp, Homo sapiens
  misc_feature (1)...(797): n = A,T,C or G
attttnnaanctttatnncattttgctacttgttctttttgcaggatcccatcgattcgcacactccaggctgagaaagagtaattaggaggcctgaggaggggccgaggaaaggctgttggggtgtgctggggttggtacccgagcgccttcccctcacctcaaccanagaagagcatncggttgctttttaaagcttttancctgccctagcaaggacaaagcatgttanattagagatgcttctgctgatcgcangggttcttatttgaaaacatctatnatggggtggggtgggaggagacaggttgtggttatgcangaaaatcttgtcctaaaaatatatgacttngggggtaaggggtgggatagccaagcaaaatcactnattattntaaaatgaacatatgtnttttnattaactttnagttaaatacagattttacaactaggtcagcatangcctnaatctatatagagggctaactcaggcattgtctngtttatttggtagactggattcaaaacaacctgtcctgttttgtcagntcccagcttnttcntttagaataaattanaccaaaagnaacaaactgtgctcgctcttgtatacccgcagaatgaactactgttgtaaaactggattttttcattatactangttncgaaaagcnagatgcttggtanatgtacaataccangatcctttttaaattgaatggggtgcatttaaaaatcctcncttaacatttctaagaaagaattgtttcaataaaataantggaatcttcanangg

SEQ ID NO: 2550 - DNA, 724 bp, Homo sapiens
  misc_feature (1)...(724): n = A,T,C or G
ggnagnnnnnnngggnntttcnacgtgaannccttgttctttttgnaggatcccatcgattcgcacagatccaggaaaaatcaaacgtattagaggaatggcgtactctgtacgtgtgtcacctcagatggcgaaccggattgtggattctgcaaggagcatcctcaacaagttcatacctgatatctatatttacacagatnacatgaaaggagtcaactctgggaagtcnnngggctttgggttgtcactggttgctgagaccaccantggcaccttctcagngctgaactgnggcttcaacccccagggccagggancancagtacttncanangaccttgncntgaactgtgcccggctgctgntggatgaaatctacaggggtggatgcgtnnactnnaccanccaangcctggcgctactactcatgacccttgnacagacgatgtntacaaagtcctgctaggccctntntctcctacacgatagaattttgcggcatttgaagagctnttnccacattatgtttaaaattgaaaccaagccatgtngtgaanaactcaaggtggggataaaagtgctgatgaccctgtgtggcattggnttctncaaccttagcaagaccctcaaagtgataaccatnacaaagataaggncccattgcctacngacaaagcaanagcttgccanggncccaatggggaccaagtncaattggttt

SEQ ID NO: 2551 - DNA, 721 bp, Homo sapiens
  misc_feature (1)...(721): n = A,T,C or G
tatatatacagctcttgttctttttgcaggatcccatcgattcgaattcggcacgagctgggtctcaggcctttgaactcaaactggaactacatcactggcgctcctggtctccagcttgctgactgcagaccttgaaacttctcgggctccattaacctcttttatatatagagagagatacatacacacacacacacacaaacatacacacacacacacattggttgtatatctggagaatcctgattaatatacccgataaattcaaaacaaaacaaaacttgaaaaaaaaatttttcaggtgaatatttgttttttagcatctgagtttcagtccaaacagggaaggaaagagaggaagtgtcttcaaaaaatatagacaccccccaaaaatatattaaatcaataataatttagatccaagatgttattgatggttggagtatagaccactacccatacaaaaagcactgtaggaaatggagttcttcagagagtagaattgtggttccaanggctaggcaggaaggcagattgggaagatgtggcaaaggattcaaaatttcagttagagangagttaagtttgaagagctctattataccaaaatggtggacctatgggttaataaccaatgganttaatatncctcgaaatattgcttgaaaagtaggttttnaagtattcttggccccaaantaaaaaaaaactggggtct

SEQ ID NO: 2552 - DNA, 781 bp, Homo sapiens
  misc_feature (1)...(781): n = A,T,C or G
agngtttttanacccgctcttgttctttttgcaggatccctcgattcgaattcggcacgagaaacaatataactcaaatgcctttctacaggactacaaactgtctgtatcaggttatggggttaaatcataatttctggatcatgatcttaaacctttaattggttccatttctactttactctttactaacaagtatcctgatggcctgaaaatccatgttgaaatttgaagtttgaattttccagatcaaatatgaaatttattttcattttttaaagtacaaaatatcagttgtataatcatggtaaaacataaaattttgctataaaagatttttaaaggctatttgattaaacatttatttacttaaactctttgctagaattttttttagaattcagcatcggaggaggaatgtgacataataatgatcgaaagccgaaagtttaaaagttgtgatgccctcacatggttggagggttattctagcttctaanggactgaatgttgtccacaagaagtgtcatcagggtcataaattggtaaggacttaaatggcttaagaattttatggtattatacctgaaggttattggnatttgaggaatgaaatatttaatggaaccaaaaatggagnccccatttggggttaaagaagttttaggtantttaaaatttttaaggtttaaaaaccttngggaaatttttnaaaatacctttgggaagttattgttaaagccctttttcgaaaagtcctcntttgnanggccttgaaaag

SEQ ID NO: 2553 - DNA, 755 bp, Homo sapiens
  misc_feature (1)...(755): n = A,T,C or G
gtngnggnttaatancagctcttgttggtggggaggatcccttgattcgnattcggcacgaggattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagngttgtcagaaacaaataatanagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaancagtgctggnctgtggctgcctgtccagaggaatggaaatatcctttggctttagcacttcattttntaataaaatcancantatgtcttnaaaaaanaatttaaaanaaaaacttnancctntanaactttangtgngtcgttttacntanatncaccttgataagaccattgatgagtttggacaacccn

SEQ ID NO: 2554 - DNA, 749 bp, Homo sapiens
  misc_feature (1)...(749): n = A,T,C or G
nnngngnttnanancagctcttgttggtngggcggatccctcgattcgctcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttggtttaaaagaaagggttttatatgttctattgtaaaatatggaaattaaacagggacttcagaaagccgacagaaagatcaccttctgatggtgtgatgtgctcctgacattcnggccgaggctgtattctgaaaaagattaatggnctgtgaaan

SEQ ID NO: 2555 - DNA, 750 bp, Homo sapiens
  misc_feature (1)...(750): n = A,T,C or G
gnagagggttnttcnnatannctgctggtggncangatcccattganncgctttgccattgtggctgtgcgagctcagcctcctggaaacccgccctgagcttggttaacagcattcactccaggtttagcccagctccaggttatcgcaggcaggactcccgagaacaggttcatgtttgctttttgggaggtgctgcgctaaagtggaaaaccaccctgggccgagtgggacctccccagctgggcggctgttaaccagccaggatgtctgaccctgagaagtcaccgtgcactcttgggactcattcttctcatcagcaggatggggtgatggagcgggccttactgggtgctggggatgatataaagaggtggcgtgtgcatgtgtgtgtgtctgtgtgtgggcgaacatgtttggtaagtgataggctctgcacacgtgcacggcaccatcatggttccctccctgcagcacttggcacgcagtgggggctcaaagcacaggccgactgatggcctggggttgcagccctgctccgtgtgtccctgggcacttgcttactgaccaccccacaggtgaacacgggcaggtgggtgtttggaggtgtgaggctgaagaaggtctggatcttgcaantcttgcncctggatagttatggggtctggaaggggcttttattgcgcctggtgctttctgctaaggccaaatttgggcttgcctgaccttngggttttggggccctcttan

SEQ ID NO: 2556 - DNA, 747 bp, Homo sapiens
  misc_feature (1)...(747): n = A,T,C or G
ntctatagcagctcttgttctttttgcaggatccctcgattcgaattcggcacgaggccacggcgctcggcctgaattttttttaatacttaatttagatcaataacttcgactggtactgaaatttgcactcactttcagcttacagtttgggtaggactgctagacccagttcttttgtcatctcattcttagagagctcttgaaaaccaaagtatttaaaaccctgcaagtttctgtgcagatgagtgcaaatttccacccagcattggttcctgagtaattagaggaaggaagccatgcaaaagctgctattgcccaggctccagaaaaacatcatgtaaggtttgattccatactaattgttcaaagtgtaaaagaaagctgactgtggcagtttttacctccttttcttttttttccttttaaaaataatccagagacattaagcccaacagtttctctttgcttttttccctctctagcacattttcttgatgagtctaaggtgtgacctctactgaaatggctcccacccaccttctnctatggaagtggatccccagccccatctncttggacctcgtggctgtgtttagaaaattagcatcagcctaagccaggggcatcagcatggagccccctggtcattggctgattgccaccctntntctggtggaagcccgactagggantggtnggangtcaacctaaagttaangcaacctgatgaatggttattgactn

SEQ ID NO: 2557 - DNA, 751 bp, Homo sapiens
  misc_feature (1)...(751): n = A,T,C or G
gngnnnnnnnnnnttnnnagnnnnnnnnnngnnnnnnnnnnngnnnnnnnnnnnnnnnnnntttttnnatacagctattgttctttttgcngatcccatcgattcggccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaatcctctgagcctcacccacaaagaggagacaaagggtggcctgtggcctncccgtctnctgctcctagtggcccaaggccccagggaataactggagtaggcaggcaagtgtccccttctgnattttttanggactctaaccttctgcagggttaaanggagagtactttaaacccatatccactgtgcttnatttctctnctttgcctggtaactgctgtagggtagaagtacctttctgtgccagtganaatgacctgtgtggtactgatgtaaaan

SEQ ID NO: 2558 - DNA, 751 bp, Homo sapiens
  misc_feature (1)...(751): n = A,T,C or G
gnngnnnnntttnnaagaccnnnnnngnngnnttnagnnnnnntnnnnnncnntggctctggttctttttgcaggatcccatcgattcgggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcanctgaggtattgatggaagtgtgtttttaatgtacttcattccaatttgaattactttatctttccaagttattcatgaaactctggtatctgtactcttgatnatatccctttatcattgncactgngatctataagacctaattatatgttatcaggtattctnaaaagaatgttgacttctgaattaaaaaaaaaaaaaaaaanaa

SEQ ID NO: 2559 - DNA, 765 bp, Homo sapiens
  misc_feature (1)...(765): n = A,T,C or G
gnagnnnnnnnnnnggnagnnnnnnnnnngnnngnnnnnnnagagnnnnttnnnnnccntttgtaannnnacagctacttgttctttttgcaggatcccatcgattcggtgatttactttctcattcaaaatacatattggatattgtatctaattttgtattggtaattttgggttatgaaaccccagatttgaagccccaaattgtatagggttcaatgcccataaaacccagatctgcccctgcttagaggccggcccctctaggagacagcatgtggggccacccagagatgcaggactcttctgttctgccctatcgcagcagagaggccatccctggagctggaaggtgcagactgggaattgctccttctctgaattgctagctcctgctaatgcctgcattgctgctgcaaaggatattcagaaaaagttgctcgtcagaaaaagaattcatgctagctctggccctgctgctgatgcattgtgtgaaacccttgagtgacttcacctcttggaactcagttttcccatttgtaaagtgatatcaatacttccggtgtgggctcangtttgggccctgtgaattgtaaagctctatgccatgggaggatgtatgattataagttgngttgctattacttgnattgctaaaatcttgctattattgaaaaatgcccaaaccttacatttcagtgactaaagagcaaaaccagtgttcactctgacatagnttttttaaattttcattcattcactcat

SEQ ID NO: 2560 - DNA, 763 bp, Homo sapiens
  misc_feature (1)...(763): n = A,T,C or G
gnngnnnnnnttnngnaannccnnnnnngnnagnnnnnnaagnnnntttnaannnnntttncnaatgcnaggctcttgttctttttgcaggntcccatcgattcgaattcggcacgaggtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggangtgggtgacaaagataggaccccgggagggggcgcaggtacatgctagtttcaattaccacagtattctagagacnggttgcaatgacaaggggggcaaatgaaatcaatgcaagatttcttaataatgggcagacagaaaaatgtaaaaccacacaaaacggactgctgataatattttaaaatatacttatttgncttctttttgcattgtgaaaaaacaaaataaattttgtgtgataattttgatgatgaaaggtggaaagttctacctanatttgaatgantgtttttttaangggaatgaaaatgtcatggtgctnaaccttgccaattagaagaatcattgaaaatgctgaaaaatttnacagtcttntta

SEQ ID NO: 2561 - DNA, 706 bp, Homo sapiens
  misc_feature (1)...(706): n = A,T,C or G
tatatatacaagctacttgttctttttgcaggatcccatcgattcgctccagcctggggcgacagagcaagactctgtctcaaatagataaataaataaaaatacaaaaaaaagaaactcaaggtacagtggtgggagtcaaaaaagcataagggagaaaaccaagactgaaaactgttattgagcttagtctgtgcctagttcagtccctagcattttacaagttttctctgagttaacaaacttgtgggggaaactgaggctttcagatgttgaataacttgtgtaagttgtagagcaggttcttttccatagttccgcattttttacctgcaatacagcaatgcggttgcccaggcccctcccaggagagttgcagcttccccggaggccacacttcttcaacaccttttgcctaaaggctctttttccctaaaggctcaactcatcccttgcaaaatacccaaagccaaatgagtctaganggtaaaccagccatgtaggatgtggacctttacaactgaaggaaactgaggtatttcaatatgatgaaatactctgtagtcattaaaatgatagatgtgaatgtgtagaaatatgaaaaagttttgggaaaaagttgcacatatctgaagaaaccaattgaaagcaatgggcatttattaatttattttggttntggtttttttttgagaacaagcccnct

SEQ ID NO: 2562 - DNA, 749 bp, Homo sapiens
  misc_feature (1)...(749): n = A,T,C or G
gnaagnnnnnnnnngnnnngnnnnnnagaggnnnttgaaancnnttgcnaatgcnaggctacttgttctttttgcaggatcccatcgattcgctgaataacaacctaactactacccctcaacctcacccccaccccaggaaaagtaagtctttttctaacgatccaccagattagggttacatttaacagtaactagaaaggttaattntaaccttaatcagaaagattaatttctgtcctttcagtcttctttctgtgctcataaataagcattgnttcttttaatcaacctgggcagtatctttctcattttaacagttgtctagagctcagttgtcccagcatttatttcactggtccctgatggatggagggtggtgttgcttcagtgtttgggcagtgcagacgatgttgagattcacattcggtctcgtctctttgttgttataggataagttctcaaaggtgggattcctagatccaaggcttctgacacacacactgctgattgaacctcagtggcagtgtttgagtgcacctgttcctcactcccatttcacctttattcacatgttgattcactcagcatttaatgagtgcctattatgtgccaggccttccttcagtgctggggcccttcancaatcaaggcagataaagattgctgttgtgagccatgtgtggtagtgtgcacctgtagtcttagctacttgggaagctgaagtgggaggattgcgtgatccccgg

SEQ ID NO: 2563 - DNA, 701 bp, Homo sapiens
  misc_feature (1)...(701): n = A,T,C or G
aaatngctaggctacttgttctttttgcaggatcccatcgattcgaattcggcacgagggggccatagcctctattcctgcccagctgtggatcctcagcttgccatgttaggtacactggaccagcttgtggagccatagcccaggagctcagggacattgagtgcaggtttcttactcctacctgctggccctgtggctgtccctggtggccagcccagctgcagcaaaacctacaaagcctccagccatggtaggcgtcttggacctgccccagtcagctggggcttgggctgctaggggttttggcacacgtccatgtttggcggagggtgtgccttcaaaccctgaagggcctaatttcaccattctttctggctgcccaagggaacttccctgcttttctcccttgctgttggctggataaaactggcaatcagaaagtcaagagctacagctgatggtcatggtgttcccagagagtcaggaatatccatggaagctgagcagatgccctgttgctctcccatctcagctctttgattctgagaccatcatccgctcattgacctttgatcacaaaactttgaacttctgaattctgctccaaatccctngctcctttttnccctatccctgtgccaaccaggaagtttcttctatttncangcctcctggcanaagcaggcttccggttgttt

SEQ ID NO: 2564 - DNA, 697 bp, Homo sapiens
  misc_feature (1)...(697): n = A,T,C or G
aaatagctagctcttgttctttttgcaggatccctcgattcgaattcggcacgagattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggcccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaacctttatgccacccgacacctgctgtaattggggtgcatgagctatggagtcagatagttgttggganggggangacaagaagtctattgtttggactgtgtttgctcacaatcaccacaaaataaaatgtngaaaatgaaaaaaaaaannnaaaaaaaaaactcgagcctttaaactttt

SEQ ID NO: 2565 - DNA, 757 bp, Homo sapiens
  misc_feature (1)...(757): n = A,T,C or G
gnnnnnnnnnnnnngagnnantcnannnnnnttttatnnatacangctacttgttctttttgcaggatcccatcgattcgaattcggcacgagctcattttattttgcatatattaaattgagtaggttcagctctaacataccttaagaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacagtctgacttgctttcagtattcacaagttctttccagtttccaagtcttttcctagcagtaatttaggggagacagaggagtttcatgtaaagagcatgcagtttggagtcagaacctgggtatgactctgtggccttgatgaagcaagttacttaaactcttgagttttagctttctcctttacaatgcatgaatgcctatccccctacaaaacaaagattaaatgtgatgatgtatgccaaggggctttgnatattgtaaaagtgctatataattattaagatggtctaaattttcaagggatctaaaaccangggattggcaaaccgtttttncaggggagtaaatatttttaacgcttttgcatatattaaattaatggaaggtggttgaaaagggattnganttngaccactttgaaagtacctcanggataggggc

SEQ ID NO: 2566 - DNA, 751 bp, Homo sapiens
  misc_feature (1)...(751): n = A,T,C or G
gnnnaggttntagancagctcttgttcnttgngcaggatccctcgattcgaattcggcacgagagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgntatttacaaaatctagcagactgtgggtatccatattttaattgtcgggtgacacatgttcttggtaactaaactcaaatatgtcttttctcatatatgttgctgatggttttaataaatgtcaaagttctcctgttaaaaaaaaaaaaaaaaaaactcgancctntanactatagtgagtccntattacgtagatccagacatgatnagatcattgatgaatttggaccaacccaactagaatgcagtgaaaaaaatgcttttnt

SEQ ID NO: 2567 - DNA, 756 bp, Homo sapiens
  misc_feature (1)...(756): n = A,T,C or G
gngnngnnnnnnnnnnngnnagnnnnnnnnnngnnngnnnnnnagngnnnnnnnnnnnnnnttttnannatacagctcttgttctttttgcaggatcccatcgattcgaattcggcacgagggtagaagaagaaatgattacgaaaatcctggataagccagctccctttcaaggggatcagtgtcctcagtcccccacccccacctaaaaagcaggtcccattcagcccagccagctcatccctgcagttccatccaggacctacaggtgtcgccctccgcatggcgaggcccggaagggcagctggctgcaggaggcagaggagtctggaccgctaacctgagcatgtggaaataatatatgtcttcaagtgaactgtctggtcctggagaaataaaataggacattcataagcagttcaccatctgtctttataccatcatcatcaacagcaagangaaaaatagctctttaaaatggatgaaagcccaagctgcagtaaccggaaaactgtgagctctgaataccaataaaggtagagaaatgattaaaaaacagagatgcaaactgaaaatttgtctggacagctcangcccacgatgctttgcaggcanggtgtgtttattggttccgaaagcataaagcaagctgnttaccaagagccagcctggggaaggcttggtctccggncctggaacacgtnggaaccagggcaaaatancttccgctttgaacaaaatctggtcccaccttac

SEQ ID NO: 2568 - DNA, 740 bp, Homo sapiens
  misc_feature (1)...(740): n = A,T,C or G
ggnnggnnnnnnnnnnnntnttntananacangctacttgttctttttgcaggatcccatcgattcgccaggtctctccactgtcaagttactattattccctttataatttgcagtttaagatgaaatgcactagttttagtgcttcatctgtaaaactacttttttatgtgaatttattttttaaaaaatgtctgtcactaaagagaaaatcatcatcgcttggcatggataaaaacactaactgccaaagtcattaacttttggccaaataccaaagccagctaaagtcacagggccttggcctgtattctttgttaaaaagagattaacaactgtcgggtgataaacataagatataccagcaccaaactgaactttctcctctaaataatcataaggattgaccaaaaactgaaaagcaaattgcttgctcactatatgtgattccttgttacttagggtcacctccgtataccctctaaaattgttacttacatgctttgcagttggacatattttggtttaaatcccagctccaccaacacctcagacttcatctcctaagcctcggtttccttctctgtaaaacagggataatagtagcacctgcctaagggcttgtgcaaattagattgggatagtgaatgatgtatagttggtgcttgcttaatgaatgacgtggtcagtgtcaatggcgtgtcagaccctgaaggggctctagcccaggaagccttccc

SEQ ID NO: 2569 - DNA, 738 bp, Homo sapiens
  misc_feature (1)...(738): n = A,T,C or G
gnnngnnnnnnnnnntnntnntgncgttctaatgctngctactcgttctttttgcaggatcccatcgattcgaattcggcacgagattacaggtgtggcgtgagccaccgtgcccggccaagctcctggccttcttattcacttgacagttttgagaatctttgatttcagggatgttgagagctgctcctgtcatctggagttgagtctcacccatgggctacagtgtacacaggagtgggaccttctgttcttgaacttaggctgtggtgtgatcacccttttctctgcatccacctgacaggctgggacttgggctatgctctggacaaggctggctggtgcaatgatgccctctagaggatggatcaggcccagtcaccacctcagattcagtgcctgctgctcttcctctttccacttggccctggtgacagacagatagaggcccagctgacgtgtctatcggaacgactttatttcagtacactgggccccaccaggcaatgtggtttgtgcgagctgtgcgagggacangcttgggctaagagaagggaggtgaagttggntaaacgcactgcantccgcgggcgctacgttgctttcacacatacctgcttcttgtggcccacacctggcangggcctttggcataggacggcntggggganaatcttgtgtgaagtctgggattggggtggggtcttggtgtncaggtganggtgccggtgaaaaaac

SEQ ID NO: 2570 - DNA, 733 bp, Homo sapiens
  misc_feature (1)...(733): n = A,T,C or G
ngaaancagctttgtncatttgcaggatccctcgattcgaattcggcacgagcccagaggccaccaatggcaatagtagccgaagcgtacctgtagttcagcttttgacatgtgtgtaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgggcttactgtgggctgcaaggcctcgtaggatttgccccccatgactttctgacttcatctcttgtcacacatctccttattcgctccacgcgaagcacagtggctttttcactgattcttaaacatgccaggtacactggcctcagagcctttgcactggcttttccaggcactggcttttcactctgcctggaaagctctttcgccagatatttgcatggctagctccctcacattctcctggtgtttactcaaaagtcatgctctcagtgaggccttgtatcaccaccctaactaaaattatacccatttattccttgncttacatcttcctgcttatttggtcttagcattcaccattttcttatgtgcaacgtgtttgtgatggttatatcatttatttctgnctttccaattgggaatgtaagcatcaggaatcagattttgcc

SEQ ID NO: 2571 - DNA, 745 bp, Homo sapiens
  misc_feature (1)...(745): n = A,T,C or G
ggngatagcaggctcttgtnctttcngcangatccatcgattcgaattcggcacgagactccatctcaaagaagaagaaagaaaatgaaaaatggntgagaaaagttaagtaacgtnctgaggctggaggggccccgctcctcctcaccttggggagaaggacagcgtgaggctagcctgccctacactgggtggccccttcccctggcctgaagttgcagcacctgcaggctaaaccagcacatgcatgagggctgctgggccggggcttngggagcagccgatgcttctaaaaccctgctctgggtggactctagggatgcagtttgggtctgtgtctggggctggcagacaagcccacgtgcccacctctgcagaatgagaagtaagggtgggcaccaggccctgcccctcacgttctgctctttctctaagaactgcagaaccttggcaagccctttgcctctgcgtggggtgcccgtgtgcccctcatgaggataagcccttcgcccctgcgtggggtgcctgtgtgcccctcatgaggataagcnctttgnccctgcgtggggtgcccgtgtgcccctcatgaggataagcccttcgccntgcgtggaatgcctgtgtccccctcatgangataanccctttggctttgggtggantgcctgtgtgcccctatgangataaacccttttgccttctgcntggaatgnctgtgtgccccttnggttaagccccaatgnaa

SEQ ID NO: 2572 - DNA, 733 bp, Homo sapiens
  misc_feature (1)...(733): n = A,T,C or G
gtgnnanncagctctngtntgtnngcgacncgatcgattcgctcagctgaaaattcttttccctatctagttttgttaaggaattcaacacatgccagttaagctgtcagaaatgaaataatctacctcgaggctgtattttaacagattattatatcgaaagaaaaaaatgaatgtttataaaataacatttctttttttttttttttgagacagggtctcacttggctcactgcagtcttgacctccaggctcaagtgatcctcccacctcagccttccgagtagctgggactacaagtgtgccaccatgcctagctaatgtttgtaattttttttttttttttttgtaaagatgtggggttttgccacgttgcccaggctggtctcaaactcctgggctcaagctatctgcctgccttggtctcccaaaatacttctgtaaatgtaagaaaaggggaataatgaagtaatagagacctctgatgattctcattacttgnctttgnaataagatcttaaaaaagaatgtgtggcaaacaaaggaaaataccagttctactaaataaatgtctgctctccctgaactctnccatcttttaaacatgaatctggattttctgnaanggtctcttnccctatccacccacttaaaaaaaaaaaaaaaactcgagcctntaaactatggggagtcgnttacgtgatcngacatgataagatcnttgatgagttcg

SEQ ID NO: 2573 - DNA, 719 bp, Homo sapiens
  misc_feature (1)...(719): n = A,T,C or G
ttcnaatagcnagctcttgttctttttgcaggatccctcgattcgaattcggcacgagagagggttggtgaaaattcagacagaatgtaacttgacaaagagaagacagcaacaactgtaacaattatcttatgaatatttgcgaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttcatacagtcacacacatacacttccttatttcttttatttaaactttgagtaacatagcagtctatgtttgggtcagttttcccttttttgtaattacattcagtggtttttgtaacttcattatttattgggaattaagtgatttagtcagtgggagttttgtaaaacttaagattttgggcatttttccccctcctcctggataaccagttaacccaataatggcttggcccgatggaagggtaaaatgaggacagttatattttttaaatgtcattactgncaccaaatcacacatatcattttctaagataaggaaattccaccattttttcaagttgcaaaaaagtactctggcttgcaggttata

SEQ ID NO: 2574 - DNA, 743 bp, Homo sapiens
  misc_feature (1)...(743): n = A,T,C or G
gnngttaatcagctcttgtctttttgcaggatccctcgattcgaattcggcacgaggctcctggcntgaagaagatcaagttagacactccagaggaaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcagtctttcagggtcagagagtgagccagaagaaactcccatcaagactgaagcagacgttttggcagaaaaccaggttcttgatagcagtgctcctaagagtccaagtcaagatgttaaagcaactgttagaaatttttcagaagccaagagtgagaacccgaaagaaaagctttgaaaaaacaaacccttaagaggaaaaaagattatcccactatcaaacgttattcgaccagnacacac

SEQ ID NO: 2575 - DNA, 731 bp, Homo sapiens
  misc_feature (1)...(731): n = A,T,C or G
ggnnggnnnnnnnnnntttcaaatagnnagctacttgttctttttgcaggnatcccatcgattcgaattcggcacgagcaaaggtgatctcaggaaaggtctaagctagtttacagtatgcccatttcctgtgtaaaccatttaatttaaatgactctgcttgtctcactgttatgataaatttgtgtggtagatcgcagcctgttagctattactggaagttttctgcttttattacaggcctctcaaataggtaggttttaacattttattggaccccctgccccttcccaatttcaactattaaatccttaaatttgttgttttggttatgcagaagttagttatcaggttatatggttcccaatgagtgaggaaattgggaaggttttgtgttttttttgtcttgttaactagaaatgggttttgtagtttagcttaagggccccaacagcttgtttgagaagacagctatggaacttgagctgtttacatgttttttaatactgcgagtgtattaggaaaattgtacaagtccttctcttggtctttaggacttaagtgagtttaaagagatgacaacatgtgttttccccaggtaagctttctttgaggatttgnctttcttttaaaaaaagttgcttgggcacggtggctnacacctataatcccccacttttgggaactgangtgggaggatacttgancctanggagtcanaaccagcctgg

SEQ ID NO: 2576 - DNA, 745 bp, Homo sapiens
  misc_feature (1)...(745): n = A,T,C or G
gnnngttagatcagctcttgttctttttgcaggatccctcgattcgctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcaggtgagtcaccatgaacacaacaggacttgagggccagctgactaggacaagacatgtatccttgctgccccggggcctccatgccgagactccatgccctgactccaacaggagcatcaccaaactacacctggaggaagagccaggacagaggaaatggccccgagaggaaacaaagctaggcacagtggctcacacctgtaatttcggaggctgaggcaggtggatcacctgaggtcaggagtttgagaccaacctggccaacatgacaaaaccatgtctctactaaaaatacaaaacttagccggatgcagtgccacgtgtctgtagtcccagctactcgggaggctgaggcaggagaattgcttgaacccaggaggtggangttgcaatgagctgagatcacaccactgcacttcaacccggggcgacagagcaagactccgtctcaaaaaaaaaaaagcnaaaaaaattaccaggcgttggtgaccacacctgtagtccagcatacttgggangctgangcaggaaga

SEQ ID NO: 2577 - DNA, 731 bp, Homo sapiens
  misc_feature (1)...(731): n = A,T,C or G
gtgngggnnnnnnnnnntttnaaataganagctacttgttctttttgcaggatcccatcgattcgaattcggcacgaggcagcagcagcccgaggcctgaggagaggagaccggcggcggcgggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgangtggtcatgctttctgcgcactgggagaagaaaaagacaagcctcgtggagctgcaagagcagcttcagcagctnccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattcaagaaaaataagangaaggacttgaaaccttcaaagctgaactagatgcagagcacgcccagaagtcctggaatggacacacccacaaatgaactgaaggaccgcagaagttttttgaggaaccttccacng

SEQ ID NO: 2578 - DNA, 801 bp, Homo sapiens
  misc_feature (1)...(801): n = A,T,C or G
gtgnggnnnnnnnnnntttcaaatagnnangctacttgttctttttgcaggatcccatcgattcgaattcggcacgaggaggaaagcggtgcgtgaggcgggcggccagggcacgactttgaagattatccaatgagaattttatatgaccttcattcagaagttcagactctaaaggatgatgttaatattcttcttgataaagcaagattggaaaatcaagaagcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagccggtcatcgtatcccaagttctaccaaacccttcacangcagtgaacaacttttaagggaagagcccgtaattgtaaccccaccttaccaaaccaatcacttagtnaaaagttcctaaaaaacttccaaaaatggtgccacttaaaaaatgggattgnatttttggaaatggtggtaaacttncctaaaanttaggaaccaccttttngggnattcttctggnaattattncctaatgggggntttnaaaatggaaagaantttccccccaattgggggacctttnaaaaaaatgcc

SEQ ID NO: 2579 - DNA, 841 bp, Homo sapiens
  misc_feature (1)...(841): n = A,T,C or G
tttnttantggggtnttcnggctttcnaatngcttggctactcgnnctctnngcaggcatcccatcgattcgcgccgggctgcccagcctggctctgtctacactggccgagtctctgggtctgtctacactggccgagtctccgactgtctgtgctttcacttacactcctcttgccacccnccatncctgcttacttagacctcacccggctccggacccggtacgggcagtctgnggcancangaatgaanggcgcnccgnnccctncttcataggaggctctgggtgggggcctgctncccatacccacaagctcacccagcantctcattgctgctgtnganttcagctttaccagcctcagtgtngangcttcatncnagcncacangcctngggcttgncangggccnanctggggctnggcccctgggtnttgaganactcgctggcaccacagtgggcccctggaccccggccgnncanctggtngactgnaggggcttntgactgngcacaggngctncccaacttttgttcnacnngcaataaagaatgggcntgaccctggtnattatatacttgggnncntaanggnggctaaaggcccccccattaaaatgcgcctaaactttnaanggntttgnanggnaantaaantgcctgnataatttaatnttaaaacnttggncnannggaanttnacctcntnancgaataaaacctgggcaacnnaaanttanttggacccnnnataatttttgntaaaaccccctttataaaacttngggatntctttttgggtaaannnnanctggccctnnggantcttaaaaccg

SEQ ID NO: 2580 - DNA, 1191 bp, Homo sapiens
  misc_feature (1)...(1191): n = A,T,C or G
aggtggttnngangncattcnaatnganagctacttgttctttttgcaggatcccatcgattcgaattcggcacgaggacccaccctctccaggcctcagtcttatctctgaaatggggtgggtgttgagaggtggcttctaagatctttctacttcccaaacttggaattctctttttaggagcatctgcgtgcccagatgtatgttggagcccatggtgtatgggggtggggtggggggaagggntnngtnnccnaatncactgtggccttnnntcgnngtganatannnnttnanntntnnacntcatcntnntnnngtttgnctnntnnnanacnntcttnnnnntnnnttattatggannnttctncanntntatnntanatnnacntnnnttcatnnnnattnntnggnnattntccnnnngntnnnanatnnntnaantncntangnntnctntntntnntatnnntgnanttnananatnnnnnnntntannatnnntatnnnnnttnnnntnnatntntnggnnntnnnnnannncnnttngnnnnnnnntnnnnntnntnnntnnnnnnnntnccnnnnnntnnnnnnnnnntnnctgnntntntntaannnttntgtnannnntnnnnannntnngntnnnnnnctnnnnccnntnnngntnnanattnntntannnnnangtcnntttnnncnnanactntntnnnaantgnntnnnncnaannaattnnnnntntcnaananngngncnntattntnctannntatnngnngntnttttannnnnnnnnnnnnntattntattnngtntnntttnntntatnnnnnnngntntatntttncncntnnntgntctnatncttnnngnantnnnnnanttnntatctnatntgtcnntnatnttntatnacacttntnatattnnngcnnntntaannnnnatatnnnntaatgtnctnnntnnntcncatntttcttannnntnnnnnntnttntttnncntntatcntnntgtcntnttnctntannntnanntntnnttaaannatntcntntnnnntnntntnnnantccnntnntnntnnntatnnnnntnnnantnnnntnttnncacttnntanantnacttntnnannatanntnnnnactannatnantngcncnnantntatatcccncc

SEQ ID NO: 2581 - DNA, 767 bp, Homo sapiens
  misc_feature (1)...(767): n = A,T,C or G
gggnttantancagctctngtnggtggggcaggatcccattgnnaatntcagctacttgttctttttgcaggatcccatcgattcgaattcggcacgagtgagacagagcagccccagaacacacaccggggagtacaggagcctaggccacgtacccaacattgcaggcagagaaaaaagaaagtgtattccatgtaagcaaatgttatttggacctttctctctgtctgacctaatcatggctcacagaaagtaatcatactcctaataatacatcaacttatctgatttatccacacaatcacgtagattaatgtatgcttctatttcctggtcgctttagcataatattgatcataaattgataaataggaataaaacaatataattagattaatttacaatacggtatagttgactaataacattttcacgatttacatactaagaataaatacatttttaatcaaatgtctcccctaggtggtgcattccaggccttagaataaaattaaaagggaaatcaatgaagacacatccactggtcacactctcatcttcaatgtttgaccagtggctgaactgtttggagttgcagaatggatatttctcttttatagttttagggtgcttggaaattgctcttttaatgctcatggttactcttattctgggnggcctttaactcattaaagacagttttccattgagaaaaaaaannnnnnnnnnnnnnnnnnnaaaaaaaaaaagncttttagaactnttn

SEQ ID NO: 2582 - DNA, 753 bp, Homo sapiens
  misc_feature (1)...(753): n = A,T,C or G
tggnggnttttaaaanncaggcnctngggnnngannnttgntataganagctacttgttnctttntgcaggatcccatcgattcgaattcggcacgaggggattacaggcgtgagccaccgcgcccagcctcatatcccccatttcaaacacgctgtaaacaatgctcaattactttcctcttaagttgaaaccaccaattactggggaaaggggcagttagattttattggttgactttgtgtttttactaatccttgttgaaaagtagaggaattggtttagttgagaaaacaaaatactaaaaaatctgccactagactttttaagtcaagagtttgtataaaatgaaacatatctactatctaatctataaaatttagaatctttttaattctaaagttaacttaagtgtgatttttagtgctgttgctgaggccagtgttgcttaaagcaggaacttctacagtaattgacaaaacttgagtttttctgctctcatttatccatccttcagacccctcagatgtcatctatttcctgaaatctgacttctccagttttagtaattcttacaatttttcaggatttagatagtactgtcagtttactgctatgtatatgtctttaatacttggtgntttcagatattacactaatgnctcatctgtagtataaatcagactttctgncttctaccagttacataatttatataatggtgcagtacatgtttggtgattactaggctgga

SEQ ID NO: 2583 - DNA, 803 bp, Homo sapiens
  misc_feature (1)...(803): n = A,T,C or G
gggnttaanccntnnnnntnnnagggggnnnnnnnnnttntangantcagctcttgttctttttgcaggacccatcgattcgaattcggcacgagnaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggctctaaattgaggggattaaaaagaatttaaaataattttgaacgaatttattttcccctcagtttttgagggcattaaaaaggcattaaatcaagacaaatcatgtgcttgagaaaaataaaattaatgaaacacagcacttatgttggttaactgcagcctccttggaggtagaattatttatttaaaattactggtgcatcaagaacccatagggtgtccaaaaggtctataaaatcgcattttggagncaaagagggcaggcaaatccatgtcacaagggtaaagcttccaagttnccaaattggggaacgccaggggtgtagggatttaaaaaaccccactnttggagaaacccaaaatgtaatcagggggggcttgaaaaaccttgcatggggctttttaaaacanttagccctttgngttaacaaaaatttcttggngatttggcacgatcccctaannggngcccattnggcccnaacaccaatttttggccccttatgggcnctttnaaaaattttaatttnaaaaatacccctttttnccgggn

SEQ ID NO: 2584 - DNA, 710 bp, Homo sapiens
  misc_feature (1)...(710): n = A,T,C or G
tgggtttngatcaanngctcttgttctttttgcaggatcccatcgnttcgaattcggcacgaggcaacacaaactgaatttccttattgctgatagctgcctgtagaggggtggtcaaagagactctacctggaaaactcttacagaaaaacattattgaataccctcttagtttcagagtttccagtctcatttctccttaaatctattcaccaaaacaccaccagtttcccctaccacaaacacacacataagtacacactcacctattttcaccttctcttccacttccacctttgtgttgaacctgattaaactctgatacttttaactccaaaatatgctatgctcttattaacaactggatcttagtagtttgcaaatgtttatttctcgtttatatgcagttcattgtgagcaggtggatgttctgctccatacccactgcagtccgagatctagacagaaaagtagcttttctctagaatattgngggttccataccagacaggaaaaatgaaattacacagtggcttatataatttttgcttgtactttcacccacatttcattgcaaaagcaagtcacatagccaaggttattgggtttangaggggtctctgaaaatggccagtaggggagacaaaggggatatttgtgaacaatattgcaatctatcctatatgtcattctttaaggtttaacacagn

SEQ ID NO: 2585 - DNA, 781 bp, Homo sapiens
  misc_feature (1)...(781): n = A,T,C or G
agttangtcgnatcgngttctttttgcggatccctcgattcgaattcggcacgaggaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcataccttgaacaatataaattgngtatattaccttaacatcaaaactaaaccaaggattcaagaattgatggttggattaaagaacctagcntcatgttaaaaattaaaattaacctttaattaccnttgncctcaaaaaaaaaaannnnnnnnnnnaaaaaaccttngaagccaangggccctttttggaggccctttt

SEQ ID NO: 2586 - DNA, 760 bp, Homo sapiens
  misc_feature (1)...(760): n = A,T,C or G
nnnngttanancagctccttgttctttntgcaggatcccatcgattcgctcgagttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtcccagcttttgttccctttagtgagggttaattgcgcgcttggcgtaatcatggtcatagctgtttcctgtgtgaaattgttatcccgctcacaattccacacaacatacgagccgggagcattaaagtgtaaaagccctgggggtgccctaatgagtgaacctaacttcacattnaattgcgttgccgctcactggcccgcttttccantccggnaaaccct

SEQ ID NO: 2587 - DNA, 736 bp, Homo sapiens
  misc_feature (1)...(736): n = A,T,C or G
ngtaaatcagctacttgttctttttgcaggatcccatcgattcgaattcggcacgaggcgtgtgtgtgcacaaagcccctaaggtttcatgtgtacacaccggtgctaagtgttttttacacccttgtgcatctctcggcctggggctcctgtgcaggttgccctgagagttgggtttttagttcaaaaagaaggaacacagatgactactctgctggcgacacggccactctgctggcacgcacatagcatggcgcctccttttttgggggactctccttggtggcatctctggcaggctgtgtcctctccagctgcagttctggaccctgtctgggttggggaggggcatttggtcctcaggctgagcccacctggattccccaggcccttggtgagcgccactctggctgcaactccccttgcctggcccgtcctgaggcccctctctcgtcctcagtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgcaagangactggggaagggangggagactatgtgtgaactttttttaaatagaaggattgactcggatttgantgacattaaggctgagtctgttctt

SEQ ID NO: 2588 - DNA, 711 bp, Homo sapiens
  misc_feature (1)...(711): n = A,T,C or G
gttttnnnnnttnnnantctctngttctttttgcaggatccctcgattcgaattcggcacgagcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcaagcacagagcatggtaacaagagactggatgctgcttatcgtccatgaacgggaaaggccccgtttacttacttttcagtgtcaacggcatggacacttctgtggcgtggcagaaatgaaatctgctgnggactcacacatgtgcaggtgtgttggtnccaggacaaatggaagggccgttttgatgtcaggtggattttgngaangacgttc

SEQ ID NO: 2589 - DNA, 774 bp, Homo sapiens
  misc_feature (1)...(774): n = A,T,C or G
tgggtnttatgnatncagctcttgttctttttgcaggatcccatcgattngctgaaattgaagatgttggttctgatgaggaagaagaaaagaaggatggtgacaagaaaaagaagaannngaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagatnaatttttaattatacctttacattcactgatgcctacagttaaccagacacangtgtttaaaagaacccctnctggtgttcgganaatagtaattgctaccaacattgccggagactagcattaccatagatgatgtcncttatgtgatagatggcngaaanntngaanagacncattnngatactcagaaccaatatcntttacaatgtccctcttnagtggggntagnnaaaagcnttaatgcccnaaaccatantaanaagggtcnctcctnggnaaaaannttcaacccttgggnccaattcgcntatncaatctnggcttaacngggnncntttangacnccaannnnntttnccttangntngnncctnttcnaacctggncccnnaannntttttcncg

SEQ ID NO: 2590 - DNA, 852 bp, Homo sapiens
  misc_feature (1)...(852): n = A,T,C or G
ggnnanagcagctcttntctttntgcaggatccctcgattcggagaggtaatgcttcattttgcatagttgggaatcaagataatctgtttttaataatacaagaaacaaaagcataactatattatttatattacaaaagcaatctttagaaaaactaaaaggggtatataagtattgagaggagaggaaaaggaatgatatggtatcatgaggtaatttttgatcaattatagtaggaaatagacaatatctaaaatggataaagggaaaatggcaatattatctttttattttatattattttaattttttaagacaagtgctcgctctgtcgcccatgctggagtgcaggggtacaatcacagctcactggagccttgacctcctgggctcaagtgatcctcccaccacagcctcccgagtacctggtactacaggcatgccaccacacccggctaatttttgnattnnnnnnnanncnnnnnnttnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 2591 - DNA, 715 bp, Homo sapiens
  misc_feature (1)...(715): n = A,T,C or G
ggnttnaaatatcangctacttgttctttttgcaggatcccatcgattcgaattcggcacgagaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatagtatgtgatctgacttttcctttagcatttaaagataccttttagaaatagaaagcacctgtttttctctcttaatcttaaccctgtcttttcttctcacagttccccacctgactcttcctttccctacctttcattccacaaaattaagattcttggttatttgtatctaaacctgcaattatgttgaagacgacaccgtactcagtgtggtgagtaacacagagatgaaccagacatgtttttgctctttnttttttctttttcttttttttttttgagacggaatcttgcacttgtcaccccaaggnttggatgacatcctgggttgcantgagctgaaaatggtgccaatgnacttccaacctgggtgacaaaat

SEQ ID NO: 2592 - DNA, 762 bp, Homo sapiens
  misc_feature (1)...(762): n = A,T,C or G
ntnaggggnnttgaaggncnntttctanatgctaggctactngttctntctgcaggatcccatcgattcgaattcggcacgaggtcatgatcaactcagtataggttttcttaaaaaattttttcttaaaatgttttttgaacttcaaataagtttggttggtgctacagatttaaatcgacttgtttgtgaggataatagaattctttttgctatgaacttatcagtcagcccagcgtctgtgagacggtgcctgcttgcatggtgcagtccagagtgtattttgcaaacgtctagcactgcctttatgtaggacgcgtgcttcgttttattggtctaaaatttcccatgtcataacactttgatcatgccttagagaagtcttacagcttattcagagcactttggagacattaacacccagcgtgcaaatgcgtcttcttgcttaggcgtcttgtgccttgtgttcagcatcagtctctaggcccgcttggtgtggttctggaccanagaaagtgctggtgagaagatattcctcancagtgttgggagagcangcgatggaccctgggtttgnttcgatgtggttcacgtgcggtactgtttctcaaaagtggtcatttggagtacttgatgtacctggatttttgctaacccttgtncanctttgctgttctttatgtaaaatatattcattttcaaaggaaatggttgggccggacacagtggctnacgcctattatcccancactttggggaggc

SEQ ID NO: 2593 - DNA, 702 bp, Homo sapiens
  misc_feature (1)...(702): n = A,T,C or G
agnnntanatcngctctcttgttctttttgcaggatccctcgattngaattcggcacgagaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactgtgcccagcatggtgtttcttatatcaggtgttttagggagctcgcttgcttattccattctttaatccttacagtgtgccacacgtataaagtttataacgtattaatgatctcattacccaaaaccagaacataatttcacaagggttcctacttctgtattgntttattatctcaaaaatttaaataacatgttctgctgtttattggtcttgntatccactgnattagcaccttccctgatgtgctttggaggttgatcaatgaattctgagactttctgctggaattactttaagggtgcttattagatgatgaaaaagttggctgagacccn

SEQ ID NO: 2594 - DNA, 708 bp, Homo sapiens
  misc_feature (1)...(708): n = A,T,C or G
nntttagatcagctctcttgttctttttgcaggatccctcgattcgaattcggcacgaggctttatctctaaattagaatcacaaatgcgtaatcttttcagggtaaaaatgtgtcatctttaaagtctgtttcagatatattttaaattactattttaaatgaattcatatggaaaagtcgtgggagcttaaggccttgtttaaaagggaaaaaacaactgagtctttttagattaatcaaaaactatcctcttcctttggagaggagagagtgtttgtcacacgcggaatgaagtgccatgttctttgaggcacgatttgtatgccatttggagganggagtccgttcaagagaatggattccctgacaagctacgtttgccagaatattccaagacatgttttagaagctacctatggcattaacatcataacgcctagagaggatgaagatccccaccgacctccaacatcngangaactgttgacagcttatggatacatgcgaggattcatgacagcgcatggacagccagaccagcctcgatctgcgcgctacatcctgaaggactatgtcagtggtaagctgctgtactgccatcctnctnctggaagagatcctgtncttttcagcatcaacaccagcgactcctagagancnaaatgaacagtgatgaaataaaaatgcagctaggcagaaataaaaa

SEQ ID NO: 2595 - DNA, 710 bp, Homo sapiens
  misc_feature (1)...(710): n = A,T,C or G
ggttnntagcngctcttgttctttttgcaggatcccatcgattcgaattcggcacgaggtttagggtcagatccatgtatttgtagcttggaggtgagcccaggggttcatacacaactttgctccctactgtctgtgatccctctgccactttctggttccttggagctccctttcatgatcctcctgtcagaataccagggctttaatttgcccactctctgccatgcacttctcatgactgcatctgcatccagggccaagcggtaggaggacagagggagcctaaataaacaataggatttgtttcacagtcttgaagctacagcttctctggtcagagaaaagaattcaaagccctcagagttttaggtacctgctcaaattctacctctgttgcctaaggttagagagaacaaaataagaaagaaaaaaaaagcaggagatttcccttattttctctgaacttttggcattcctttttctgttctttggaccagaaaatgagttgaagttcctctgttcacacctggtgtttactttcatgtttcaagctgctcttaagtctagaccaggtaatatctgagggggaaaaaatgggacactcactactggcttggtggtagtttaaaccctggctctttcccggtgtgctcattatcatttactttcagagtttccagaaagctgctccatgcattctatctaga

SEQ ID NO: 2596 - DNA, 775 bp, Homo sapiens
  misc_feature (1)...(775): n = A,T,C or G
tgttnctaatgcnaggctcttgttctttttgcaggatcccatcgattcgaattcggcacgaggcttagaaaattaacctttttctattaggctggtgcaaaagtaattgcggtttttttgncnttaaaagtaatggcataaaccattacttctattaataaaaccctcaattntcattttcatagcctttcagaatgggagtaagctttgcaatcaacctgctccttcatcttatctgtacacttgataaatctgattcagtggttggaacggaatctgcttttcctgtattggttacaagcaagcactttgcctgggtgagtgtagctgcagtatagcatagaattaagactacagtttcatagtcagcgcagcttgaaatgntggctctatcatttactagctgtgtgatcttgcacaaaatcctnaacttctctgcgcctgtttcctcacttaaatggnantnacattgttatctacctcatggagtngntatgaagattaaataacntgcatagnaacntgcanaagctncnnacnnnnnnatatnancctnanaccanctctnncncctncctcnctnctnanctaannaanaccnnnnggtgnggngnaaatttcttctanaaagaaaaatntccttgaaancnttttnaaannnnactaantttnctcantnaatctngtnnatnncanggnnnaacctaaaatccanncnnnnnganacntncccnntntattntatantnngncntannagggcanntancctncn

SEQ ID NO: 2597 - DNA, 710 bp, Homo sapiens
  misc_feature (1)...(710): n = A,T,C or G
gnttttanatacagctacttgttctttntgcaggatcccatcgattcgccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctncccgtgttcctgctatcgcccgctctgccgcctcaacttcggcctcaatgtcgtggagaacctcgcgttgctagtgctcacttatgtctcctcctccgaggacttcaccatccacgaaaatgctttcattgngttcattgcctcatccctcgggcacatgctcctcacctgcattctctggcggttgaccaagaagcacacagtaagtcangaggatcgcaagtcctacagctggaaacagcggntcttcatcatcaacttcatctncttcttcttngng

SEQ ID NO: 2598 - DNA, 722 bp, Homo sapiens
  misc_feature (1)...(722): n = A,T,C or G
gttcaatgctnggctcttgttctttntgcaggatccctcgattcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttncgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatgtgagaaactacatttgtttgcattttctcctacccaccttttttggggaatgaantgttttggggaatggggcttgtgaactaaaaggaaaaaaaccattggtgaaagtgcttttagaattttaaaactgnatttaattattttatangtttnaaagtttaaggttagct

SEQ ID NO: 2599 - DNA, 792 bp, Homo sapiens
  misc_feature (1)...(792): n = A,T,C or G
agtgcttctantnnattgctacttgttctttttgcaggatcccatcgattgcgaattcggcacgaggttgatctctcatcagtgtttgacagttaatcactttttcctccttgaaataccgggggntgaggcttncaagacaccacacacaactggtttacctctctctgnctctctcttttttgtttcctttgctgactctttctcagcatttcngctagggttnagtccatggcatttcttnacattnntggctacctttctcccttaangtacntntctagacttcnaantccatnnattcctagtttnaagatntccctttancaacttaattncatnnanntttnnanacacagtccttgaanattnccnanagccaaaacacggantcgtacntgaacccctnnnnnntctcatatcacatacacggtntgtcatcanntcatgatatncttcncnctttnttnnanantnttnccnntntcttatnaattcntttngnanctnttcctnccncaatccaaangannnttanntgcttnnattaaactatatntannggngnttttnttcnntctcngngananaaanatnttnnaaancccgntnncttaaatncaattntntgcncctttctnnnaaatgncnanngnccnttaatcatccaactnggtnggntccaggggnncanatggctntaccaatccttgcnnaanccntcacgnnctttttggcnnnnggccnttntantncggccnanatctaccctcgtnnnggaangccanttnc

SEQ ID NO: 2600 - DNA, 712 bp, Homo sapiens
  misc_feature (1)...(712): n = A,T,C or G
ggcngntntatgnagctcttgttcttttgcaggatccctcgattcgcaaagccactttgaattctggaaagttgacctgatggagaagaaccaggaaaaccaagaccagcatttgaggaaagctggttttgtcaacaacaaaatactgatggaagacagaaatagtgttttaggagaaacatttaatataaattcaaaccttgttccaatgagaaaaatacctgataaatatgacttatgtataatgaacgtgaattatatttcagaattaattgttagtaatagaaactcctttggaaggaagcttgatgagctcagtgcacatgcgaaattgctccttcatatgacatgagcatccttatgccagagagaaacattttgagtgtgatagaaatgagaaagccatctgttagaatgaggacttatttcagcatcaggatattcaaactctgaagcaaatttttgaataccttgagtgtgggaaagcttttcatgaggaggcagccttcagtacccataagagagtgtgcttcttgggagaaaccttgtgaatataatgaacaacttaagagccttttctgacaatncaaaccttcttggtcatcagagtactcacagaagggaaaatcactacgagtttaattgctggtgggangaagtctgtngtgagaaatctntaattaacaccatggaggaatcatggggaaaaata

SEQ ID NO: 2601 - DNA, 733 bp, Homo sapiens
  misc_feature (1)...(733): n = A,T,C or G
ggngnnttttatagatacangctacttgttctttttgcaggatcccatcgattcgaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagntttagtgcagncctcaacgcaccantaganaaagactgactttcggnatcttcaggatgtaactgggaataaaaggatgttttctgttggacatgtactggaaaattaacacatgtngtagccttaaaaattttagacttnttctaacatgangnttg

SEQ ID NO: 2602 - DNA, 722 bp, Homo sapiens
  misc_feature (1)...(722): n = A,T,C or G
ngnggnnttttagatcagctcttgttctttttgcaggatcccatcgattcgaattcgtcacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaaccgacgagaagacctatttagttaaacagatcagggn

SEQ ID NO: 2603 - DNA, 761 bp, Homo sapiens
  misc_feature (1)...(761): n = A,T,C or G
ggngggtttctaatagnnngctacttgttctttntgcaggatcccatcgattcgaattcggcacgagaaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctccatccctagagccctgcttcttcaggcccgagagaccagcaaacccgtcgcccttcgtcccgttgggccccacattcccccactgcttacaggcttagtcaccccggagacccgacgtncttggangancatggtggcnaagagcccgccccaggagcanccacaccgagatgcaaacttgcattggattatcacaagtntaaattcacttggaattttgcattaacccccncccnttacccttgnaacaaaaatttttgnccaacagggaggaanatcttantttttttcaanggncaaaanaaatgtttttttnaaaaaccccaaaancttgnttnaaatgttnaaaccttgggaaaacttgggaattttt

SEQ ID NO: 2604 - DNA, 799 bp, Homo sapiens
  misc_feature (1)...(799): n = A,T,C or G
ggggntttttnaccacgctcttgttctttttgcaggatcccatcgattcgaattcggcacgagaacggtgtctggtggagaagagctgagcttccctggccccttctgaaatggggtcaggaaggggatcangagggnnattntncatggtgttcctgcnnatangtatttctttnnctcnctnatctctctnagtcatnnctcagtcaaccacatatattaagacctatgcacagaacaattctattcctataaaattctataaaatgcanactannccataatgacaaaaanaatattactggtttcctagggatggnatgtnngcaaagagagacgacagatgnangnattaccaatgagcacagngganacttntgnatgcanggatatgctcattgtccttgactgctgatggtttnacnaggtgggcccaaaactatntcaaacttttcacttcatctatatgaccanctgtcatatgccaattatacctcaattaatcctgattaaanncatttanngntatctctactngtaaantttaaaaccnctttttacnttaccncncctgtantcantcatgtngccnttcctnaaaaacttcccaanngtatttctancnataaannaggctttctnnntaaccnanttnnaccttccnttngnnnatnctnnnnnaccttattncttaattcttctgaaanaattcaacntantattatacctatttnaaanccttctnccaacttctttantnnnngcacctttcttctcnttataatcccancnanncncg

SEQ ID NO: 2605 - DNA, 729 bp, Homo sapiens
  misc_feature (1)...(729): n = A,T,C or G
gggggtntctaatgcnggctacttgttctttttgcaggatcccatcgattcgccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctctttttttttttttaagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttcaaaaaaaaaanaaaaaaaaactcgagcctctagaactatagtgagtccgtattacgtagatccagacatgataagatcattgatgaagtttggacaaaccacaactagaatgcagtgaaaaaaatgctttatttgngaaaattggggatgctattgctttaatttgnaacccttntnagctggaattaaccaagttancaccaaccaattgcnttcatttttatggtt

SEQ ID NO: 2606 - DNA, 763 bp, Homo sapiens
  misc_feature (1)...(763): n = A,T,C or G
nnnagnggnggnnantnnnnnnnttttgnaaagncgttgctacttgttctttatgcaggatcccatcgattcgaattcggcacgagggtgaacaaaaatggcccagattcttattcagaaaccaattcacattttaaaaatatatactgtacactaccccatcctcttcctaatagctaaagtgatctaccctaaaacaccaagcagtccttcttacagtttgttccctcctgacagttcattgattacaatgtgaaagcaccaacctgagctaaaatgaaatgagaagcctgatgtttcaggcaccaagtactttaaaaatgtctactggctgtcctgcagcattttacttaatcattttttagaggagggatgaggactggttgggtaaaggaaatcatcaaatggagccttaaataactgattacaaaagctttttgtaaaatcacacaaatatttcaagaataaatgcattccagagatacaaatcaggccaaaagaaacaaaaatcaatgaaattggcattacacttgtaaaaggccaaatggacacaagccctcgagcctctagaactatagtgagtcgtattacgtagatccagacatgataagatacattgatgagtttggacaaaccacaactagaatgcagtggaaaaaaatgctttatttgtgaaattgtgatgctattgctttatttggaccattataagctgcaataaacaaggttaacaacaccaatggcttcatttatgtttcaggnt

SEQ ID NO: 2607 - DNA, 740 bp, Homo sapiens
  misc_feature (1)...(740): n = A,T,C or G
aggggnnnnnntttntnagggcagntttntnnatacangctacttgttctttttgcaggatcccatcgattcgaattcggcacgaggctgtttgtgcaaataccttgaaaactttgaaacttgaccccggacaggcctggtgccaggtcctttccgacttttgtgttttctttccacctttcactactgactttgcctctttcctaccaggaatggacagggccgatggaggtgaagcggacagcagctgcactgccctgtagagattcccaggccctgcccacttcaaagcacacaagcccacctcttcctcatcacatttccctttgcaacccagggaggcactcaccaggatgctgccaagaaggaaacattttattaacatgtttctttgtttccgatgcacttaaaacacttgggcctcttgaccaagtctagttttaggacttcaaaggggcgttgaaagccacattttgatgactttggtgtaaaatgagtagggcatatcgggatttaatttcccttgaaagttgcacagacttaaaaattagcagaataggctagcagaatangccggatgccgtggctcatatctgtaatccagcactttgggangccgaggcangcggatcacctaaggcaacagttncanaccaagcctggccaacatggtgaaaccccctcttactaaagatngaaaaaattaanctgggccgttgtggtgcaacctgtaatcttac

SEQ ID NO: 2608 - DNA, 718 bp, Homo sapiens
  misc_feature (1)...(718): n = A,T,C or G
gcggnnnntcttcanatgncngctcttgttctttntgcaggatcccatcgattcgaattcggcacgagttcatttttaaaaagcttctccttattatgttgttgtttaacaacttaaacgctatctctagaccaggaataattatttgctatatattacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggcatagtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgnatgagaatattcatagttcttatgcacagtagttatcaagtaaacctgtctnccatcagaaaaatggatatcaaatggggtgataatcatncaatcaataggatattacttggccaaaccaaatgaaacaagggaaaaccacatcaaccaaattagtggcntntttncccc

SEQ ID NO: 2609 - DNA, 715 bp, Homo sapiens
  misc_feature (1)...(715): n = A,T,C or G
ggcagctctctaatgcnngctacttgttctttttgcaggatcccatcgattcgaattcggcacgagcaaagtactgggattacaggcatgagtcactgagcccagcctaataaagaactttctgacagtgaaaatggtctgtgcatggtgtgggtggggtgagggtgaggccgggcgtggatggagcagcagggaggttgtagacaatgtccagacatcagagagagggctgggctctgatcctgtgccaccctgaaaggctttgatcctatggtttggtcagaaacagagcctgtaaaacccatgtatgcagctgttgctaagggcaaccacaagatgctcaaaggaccttaaagatgtagatgcagttagttacctgaagaagtgaaagtagaagtgaagtcttttctaaaagaaaaaccacagacacaatggcaatctggggagaaagagagcctgggattgggagaagatatccaggcatttagctctctcttccccccatatttagtgtgacatatttattgtgactttataaattctttttttaattttaatttttattttaatgtttgtgggtatgcagtaggtgtatatatttatgggacacatgagatattttggtacagcaggtgtttatcttgaccgacgtcttgnctctactgcctgtcccgntcttaacatccttctctttctactccccttaccccgtntt

SEQ ID NO: 2610 - DNA, 723 bp, Homo sapiens
  misc_feature (1)...(723): n = A,T,C or G
gcggnnttnnttctaatgcnggctcttgttctttttgcaggatcccatcgattcgaattcggcacgagatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaaggacatgaataggtggttcataaaagaaatataaatagctaataagcatatgaaaatggtgtttagcctaggataatcaaagaaactcaaatccatcttttggttggcaaattg

SEQ ID NO: 2611 - DNA, 815 bp, Homo sapiens
  misc_feature (1)...(815): n = A,T,C or G
ggggactctgttctnacagctacttgttctttagganccaatccangagnaatnngncccgancncagnccnnaatnctnttttccgcncctgggtncntcacttcctngcggaanagacagnnattttcnnggntncattcntatgaaancanggnntggnntgaaaatgtcttnccagntncaacaggcnatnaacacatgcctaaaagatcntgtaaggggtttcagnacacgacgagtcctctagcgctttgtgttcacacctttactccatgatccgtggaaaccggccaacacagacgagccttncttattnctnntactcagcctctttgatgacacancagaancagacgtgactatgctctcgtatatatgcagacaatctangcctgttttncataccagacncaggaagaagcccgttgttataatgcatcatatatacattacactctnnagtttcttggnagtcacctactgcagtcatttcaagggagnctnatgggtaaaggnncataaaggaaangangaggaaaantantcncctantannnggaaaattgagtcnangctgacaggtgnnatangaaaanttttncnaggcctttgggaangtcaccgggaaaaccgtggttngatttncagaatttccanaatttccggaatttcangaatgaaccgatttttaaaattccagtngnttgnaaaatggtttttgnccnggaaaaaatttannttcccnttttaaatccgnaatttttcaaaantgntnttncccaaggggncattttnaaataaccnttnctcaan

SEQ ID NO: 2612 - DNA, 742 bp, Homo sapiens
  misc_feature (1)...(742): n = A,T,C or G
gngggnnnnnnnttttnnanngcgtntatagcnggctcttgttctttttgcaggatcccatcgattcgaattcggcacgaggccagcttgacctggttgtgggcccgttgggcgagaatgaagctncactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgaggtgcgtgaagtgggcaggccctgtcagtctcgcgttcttcttggaagccgagacgcgggccaccctcggtcctcatgctcccggctgctccctaggcgaaagcccgccttgggggttcctgaactcccagccttgagacctaccatcagcccgaccccanggtcctgtgcgtcttcctacggacccgaaagaagaaagctttgagagtgtaccttttcgctatttttcctcccacttttacgactttgaatttacagtgttgctatttagtagtggatggcaatcccgcctgtttcaagtttctgaaattttgcgtgaaacaagcgcaaatgaagcaacttgtccagttggggaacagtaaaataactgcagttcttgttcaatgaaaaaaaaaaaaaaaaaactcgagcctntagaactatagtgagtcgtattacgtana

SEQ ID NO: 2613 - DNA, 721 bp, Homo sapiens
  misc_feature (1)...(721): n = A,T,C or G
ggngcgtctatgttgctctngttcttttgcaggatcccatcgattcgctggatccagtccaggccagagcctcctctgcagagaaggtactaggtgcccatgcacagggtgactgccagcctcgtggagtgggggcagtggtgtccctgcgggcgggcttggtcttctgaggccatgtcagtgccaccccagggccgccctccatggcagtgtggggccaacaagcctgtcttcccatttttctgagagaggctggaaatcctgttctttttatatataaagtgtttccttttcaaaatattggcaactaagtaaatccaaacaaagtatgggccaaatcatggcacactcctgccccacaggtggccctccagctaagagtcatgtttacaattttagaggtttggtgggctccagtgggaccacgcctgggggtggagtggctgtgggtgaaccgtgtctccactcccacacctcgccactgagaagacagagcacgggatcgtgacagccgagctccaccgccttcactagtcactgtggcctgcaggggctgncagcctctgattcaagagccagtgggccgccgaggacacactnccttccttccctgcctggggtcctgtgcntttgagctgaaactgttctnggccttttctgaaaaggatngtagaacgccngantggcattttantggtgaatgggcctttgcaggaacact

SEQ ID NO: 2614 - DNA, 741 bp, Homo sapiens
  misc_feature (1)...(741): n = A,T,C or G
ggngttttatagcngctcttgttctttttgcaggatccctcgattcgaattcggcacgagcctaggctttaccctcaatactgcttctggcnngnccaancngtctntntccngtggctctgngtgatgtgactngtcctcttctccaaggcagtattactcataaattcttctttagcggtactgatctatctgtgtcatcgctcagtcaaccacatatattaagacctaggcacagaacaattctatttctataaaattctagaaaatgcaaactaaaccataatgacaaaaagaatattagtgggtttcctagggatgggatgtgggcaaagagagacgaaagaaggagggattaccaaggagcacagggaaagttcgggatggagggatatgctcattgtcttgactggtgatggttttacaggtgggccaaactaatcaaactttacacttcatctatatgaccagctatcatatgtcaattatacctcaataaagctgtttaaaaacatttaagggtatatctactggaaagtaaaactgcttttaattacnagactgnatcatcatgtgcatagaaaaaatccaaanggattcttccaaaaaaagctactaagaaccactggccttcatcgagatgccaggtncaaaggtttaatattggaaaatcaactattatttcctatttcaaaagccaaccanaanaanaaannnannnnnnnnnnnnnnnnnnnnnnn

SEQ ID NO: 2615 - DNA, 753 bp, Homo sapiens
  misc_feature (1)...(753): n = A,T,C or G
gnttggnnnnnntttttnnnancgcntttttatanatacangctacttgttctttttgcaggatcccatcgattcgaattcggcacgagggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggatttggtttaataaaagttgaaataaagtanaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataaagctgcaataaacaagttaacaacacaattgcattcattttatgtttcaaggttcaagggggangtgtggganggtttttnaattcgccgggcncngcngccaatgccnttgggccccggnncccagcttttggttcctttaatgangggttaaatgcccccttnggcgtaatcatgggnaata

SEQ ID NO: 2616 - DNA, 722 bp, Homo sapiens
  misc_feature (1)...(722): n = A,T,C or G
gnggggnnnttctaatnnnaggctacttgttctttttgcaggatcccatcgattcgaattcggcacgagggtaagtaacctgtgcagagcacagaactaggattcagacctacagacccacaagtcagcctctaaggcccacttataactgctcttctgcttgcaaggccctatggatgaaatccagttataacctccttttgctataactagacacagagggaggcgtttctccctaatctgtatttatccagacaagctgtccagcaagatttctgagtgaggggctttaaggaagcaatctgcgggtgtgtagccttttctccctcagcaaatacagaaggagcttatagcccgggctcaccctgcttcagaacaagggccaacatctgtccatacccctgttatagtgagatgggaaaccttgtagatgttggcactgtgtggctcttttcttttatatactgggctttagggtcaatcccatttaaccaaagggttcaatagctataaaaaggcgttgaaattgtatggttatttgagttatagctcagtaaaggcattaaatcttcagcctagatgaccctattccttcccactctaaccagctgtgactncagatggagacattgncctgcatcctctacgtncccatncccacatnccanccagaaacaaatgtgtgaagtttcataccaacaagaatgggggggtaggaatca

SEQ ID NO: 2617 - DNA, 742 bp, Homo sapiens
  misc_feature (1)...(742): n = A,T,C or G
gnnagnnnnnnnnnngnnngntttnnaagancagctacttgttctttttgcaggatcccatcgattcgaattcggcacgagggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagttgttagaaatgtttcttgaatcaaagtttgtttgaagacacctgtgcctttgtacccattataagatggtcattaagacccaagaaactgataactttggnttttttt

SEQ ID NO: 2618 - DNA, 753 bp, Homo sapiens
  misc_feature (1)...(753): n = A,T,C or G
gggntttaannncnntttncnaannagnnagctacttgttctttttgcaggatcccatcgattcgaattcggcacgaggagaactccaaatagcccaagagggtggtgcacccccaacttcataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattatagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaacaacatatttggacttgcttaacttaagattatngagatgatcagttataaaaccccc

SEQ ID NO: 2619 - DNA, 757 bp, Homo sapiens
  misc_feature (1)...(757): n = A,T,C or G
ggnggntttntanntncttnnctaantaggagctctngttctttttgcaggatcccatcgattcgaattcggcacgagatgcagtgtaactggcaggaggggagtgagaactacttgggtagatgatcaggagatactctgcaagaggaaacatacagaaggagcctgacatgagaaaactggggcagcagttttccaggaagagggaccagcacaggtccaagttgaaactcagaatggaattttaggaaattatattcttcatgatggttagatcctgtgggctatcatcactgcagttcaacaatgtggtgcctagtaggaagagttctcccaggaaccctccacgtgtgctatgggatttctgagaaaaccagttctgagttctaggcagtggactcacagttgaacttggagggaaccaagaattgcttccatcatagccttactaagaaatgaccatggcatggcctgagtgcttcggcatggangaccagaangggaagccctaatttgccagttgcagactcttgagccttgtgactctaatgacgacnaaaattaggagattttctaggactcacgtttgcgattttgagagtagtgctgctggggttcctggtttgggttctattgattgtttcattggttctgtgtgcaagttacccttttctaagcttaattttaattaatattatattaagtgaggtaattagattatatgaaccctaangcttccttttattcttaaccctta

SEQ ID NO: 2620 - DNA, 750 bp, Homo sapiens
  misc_feature (1)...(750): n = A,T,C or G
nggaggtattnnnnnnnntttncnantagnnngctcttgttctttttgcaggatcccatcgattcgaattcggcacgaggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtanggccactggcaacatactcctcttggcccttcccatatctactcttctgtgattgggagactgcaaggcactgangagtatcaaagaagcaaatattttcactttgaaagaaaactgccattttgtatttaaaaaaaaaaaaaaaaaaaaactcgagcctntaaactatagtgagtcgattacgtagatccagacatgataagatncattgatgagtttgacaaaccacactagaatgcatggaaaaaatgc

SEQ ID NO: 2621 - DNA, 791 bp, Homo sapiens
  misc_feature (1)...(791): n = A,T,C or G
gnnngnnnnnntangtggtnttaagnnnttttnnaatgnagctcttgttctttntgcaggatcccatcgattcgaattcggcacgaggggactacagctgtgtaccaccacaccggcctctcctggcttnttaaccacttacattanaattgagagganaaaggcagttgacaggggntgtantnaatnactngaacncattcanngagganttttntncntggccntnatnagtncnnctattcatcnantntaatgntgancnntacnnttgntncaaagccntnncaatcntaaacgncatncttanatangtatnntcctactgcngcatngagcagntcatnacatcagatacagattctcagcatggaaaacaaagctnggatactgtgtcantgctgctctgtggcaaagaacacctncctttntaagnnacagcctcactctactagaatangtcngagcgcgcccattcatggctgattgcaacttccactggctgggatccagatctagaatntgtgttcagatgccttacntaggaatacatnctaacacattcttaacaggtttcaaggggagatanttngcgatagnacgtagtttatgcttnagttatatgtgtctgcatctgnttttganggtaaacggcttaacccnttanttagggtngtttanagaattgatgngtaaataacnttgatgnaaaagtttcanatggacntttnnantttgccttnaanngtggatatnggtctattgcccanngggntaatnnngaaatancg

SEQ ID NO: 2622 - DNA, 765 bp, Homo sapiens
  misc_feature (1)...(765): n = A,T,C or G
nggngggntnnnnnnnnnttttcnaatgctagctcttgttctttttgcaggatcccatcgattcgaattcggcacgaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccanagatagaagaagcttatgaaaagttttgtttggaatcagagcgtaagcgaaaacagtaaagttaaatttcagcatatcagttttataaagcagtttangtatggtgatttagcagaacacaagaagagcaagaaaatgtgtcacatctataccaaattgaggatgttgagttatggtactaatgtatgcaactttaattttgtttaacactatctgncaaaattaaactttattccctataactttaaaatgngtatatatatattaatagtttatttatgtacaggttnaattctactgggttttggcng

SEQ ID NO: 2623 - DNA, 747 bp, Homo sapiens
  misc_feature (1)...(747): n = A,T,C or G
ntnggnnnnnntttnnnngtnggtttttagatcagctcttgttctttntgcaggatcccatcgattcgaattcggcacgaggattcatttttgtactagttaatatcaactctttctcagaagtagtcaaaatataaataaaagttcttcaaaagtaacccaggagcaacagctgagcagtgccagagttgtgaggtaaacatcaatcatttcacaaatgttctgacttgttgagcagtgttcatttccaggtttcaaacttaaagtatctattaagcaatcttaaaagaaagaacaccgccttaggaaaaaagagatttgccaaactcttcatacttccttcaataactgcttagcaaacactcttgagtgtcttctatgggcaatggtctgtatccatagggatacagagatgaatgaacatgaacttggaaaaaattattatacaacacaaagtaggaaaacggtgcacaaagcataaagaaattagcggagggagggattgtttgatggaaggtcttagggagtaggtgggatttgaatttgggtcttggatgggtaaagtaaggtagggcagcagggtgggcggcaaaaagtgggaggttacagtaagtagaatggtcaatagcctattttgactgaagtaagggttaaggcttgttgggagcctgatgatagatggggatgctgtaaactcactgggatgttttncaaaagagaaccctttaaaaactgcgtnnaggagcn

SEQ ID NO: 2624 - DNA, 774 bp, Homo sapiens
  misc_feature (1)...(774): n = A,T,C or G
ggnggnnttntttatntatacangctacttgttctttttgcaggatcccatcgattcgaattcggcacgagagagcgagtctctctttgttgcttaggtttgtcttgaaatcctgggttcaagcaatcctccctcctcagcctcccaaaatgctgggattacaggtgtgagccaccacacctggcctctactttcttatatttccttaaatagatttcctttctttttggattaagaaaaaataaacagaaaattaaaatttgaacatattataaaaatgaaagataattgtaaaatcttggtttggagagtgtctctctgagcccagaaatcatccagaaaaatggacagatttgactgcatcacatttaaaaactttacaatgatgaaaaatacaagtgaagctattcatacaatagattaggaccaagtatttttaacatgtattatagacaaaaaattaccatccaaaatatagaattgtacaaaaattttaaaaacatggttaaaaaatgggcatagggatataacccggataattcacagganggaaaaaaaatncaaatggcccaataaaccatgaaaanggtggttggtaaggctggggttgaaggtgggcttcacttcctattanttttccaaccacttttggggaaagcccaagggaaaaaagggattgnactttggggatcanggcttcgaanccttttagaaccttttggtggagtccgnanttancgtnngatcccggaccttggataaggatcccattgg

SEQ ID NO: 2625 - DNA, 746 bp, Homo sapiens
  misc_feature (1)...(746): n = A,T,C or G
gngggggnnnnttttnnaaggcgcgcntnttctaatnnnagctctctttttgcaggatcccatcgattcggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtcccccccctttttttttttgcattgtatgnnaaaagcgcttggtctttcgtgcatgtgtantatntaatggtacccattgnntagttgaccatgacatttttgganaaacattncagctgnnangttgngtatggnngctcactggatgctanactttttnaaatncnaattnntntaaataanannnnnttnngaantantnnntntntnnnnncncnnnnnancnntnnnnccnttnnnnnttntnnnnnngaactnntnncnnnttccctgntttannnntnnnntnnatngcnntttntacnccncttnntcc

SEQ ID NO: 2626 - DNA, 728 bp, Homo sapiens
  misc_feature (1)...(728): n = A,T,C or G
gnggnnnnntttatanatacagctacttgttctttttgcaggatcccatcgattcgaattcggcacgaggctgggagtataggctgagttaggaagattgcttgagcccggaaggcagaagttgcagtgagccaagatcgcgccactgcactcccaactggacgacaaagcgagatactgggagtataggcattcgccaccctgggcaacatagcaagaccctgtgtctacaaaaaatttaaaaaaaattagcctgtagccctagctatgcaggaggtggaggtgggagaattgcttgaacccaggagtttgaggttacagcgagctgtgatagcaccactgcactccagcctgggccacagagcaagatcgtacctcttaaaaaaaaaaagaaaaacacaagcaaccaaaaaaaaaaaannnnnnnnnnnnanaaaaaaaaaaaactcgagcctntagaactatagtgagtcgtattacgtagatccagacatgataagatncattgatgagtttggacaaaccacactagaatgcagtgaaaaaaatgctttatttgtgaaatttgngatgctattgctttatttgtaaccattntaagctgcaataaacaagttaacaacaccaattgcattcattttatgtttcaggttcangggggaggttttggaaggttttttaattcncgggccgcggggccaatgcattgggcccggtacccaattttt

SEQ ID NO: 2627 - DNA, 728 bp, Homo sapiens
  misc_feature (1)...(728): n = A,T,C or G
ggngngnnnnnttctnaatagcnaggctacttgttctttttgcaggatcccatcgattcgaattcggcacgagcagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagctttgaagatgctttatgtgaaaagaatgtgtgtggcttggatcctaaagaatgttttaaaaggtgagaattagtantcgcctntgggaggatcagcctttggtcctgttaatagaagttgaatatnccggcaattttgcgagcccccaaggnggagaaaaccaagttaa

SEQ ID NO: 2628 - DNA, 731 bp, Homo sapiens
  misc_feature (1)...(731): n = A,T,C or G
gngngnccttnaaatcncnggctacttgttctttttgcaggatcccatcgattcgaattcggcacgaggaggattagccatgctggggtctcttggacaaaaggctggtactgattgaaaaattccctgagtatgtctagaagtgtcaggctcctctggaatcagttacagtgggattggctgcttaggtataatctttataagattaaaaattatagattatttggcagcttgtttgaaagtgttggtcccaagaaaaagttctgctgtgtgttatggcagaattattaaaaaaaatacattcttaagttgaggtttctaagtaggcttttgtaaaaacaggcaattacttgctggaggcagttaattgcatgcacagatgggtacttgtgttacaaattcctcatttgcacttgtgattacccatttgcaataattcatgaaacctagggaattcttaggtacaaggaaaggttttaggcatttaaaaaacgtatcactaccatcagaggagatggagaaaacaaagagctaagtataaagccttattccaaatgctaagttcagagaatattttctgaagctcgcggttgttgaaggtaagaggtttacttaagctattggttccatggactctnttcactttnaaaaaaaaaannnnnnnnnnaaaaaaaacntngagcccnttanaacttntngnggagtcntatttccgtnnaatccnnaacntg

SEQ ID NO: 2629 - DNA, 727 bp, Homo sapiens
  misc_feature (1)...(727): n = A,T,C or G
gngtgnnnttttnagatacangctacttgttctttttgcaggatcccatcgattcgaattcggcacgagggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcagtgttaagttgtgcagcagaggcccctccatgcaaagctgaatatgtttactatttgaactttttcagaagttctgcttaaggacaaaataaagcctaaatccaagaacacttttaaaaatgaggaaatagtgaacacaatagacggaagtctggaagtttctacccatgccaagaaaagcattttatgtttggtcacatatgttgtgcaattcaaatttttttccctatattctctgactagacacttgtactgagtcaattggcgagtgtgtctgtctaaaagcccaatttcaaaatatcactttaaaggcatctttacatagtggggtttaagaaaaaagttgttattcagcaana

SEQ ID NO: 2630 - DNA, 731 bp, Homo sapiens
  misc_feature (1)...(731): n = A,T,C or G
ggnggnngtnnttcnaatgcnaggctacttgttctttttgcaggatcccatcgattcgcttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccggagagagtgccagggtgccctggtctgagctggcatccccatgtcttctgtgtccgagggcagcatggtttctcgtgcagtgctcaagacacagcctgccctagtcctaccagctcacagcagcacctgctctccttggcagctatggccatgacaaccccagagaagcagcttcagggaccgagtcagattctgttttggctacatgcctctgccgggtgccggtattgaggcacccaaggagctgntactggcgtggaaataggtgatgctgctacctctgctggttnactcacaagccacacttgatacacgatgacaccttgcttggttgggaaacatnttaaacatctagtnnatgacttgcaggctgntggctaccagtttcctgtcttgaaggggtaatatggttaactttcgggancaggttggaatgtnng

SEQ ID NO: 2631 - DNA, 757 bp, Homo sapiens
  misc_feature (1)...(757): n = A,T,C or G
ggtgttatannnnnnnnttttcaaaganacagctcttgttctttttgcaggatcccatcgattcgaattcggcacgagattatttaaagcttattcaatttaaaagactacttgtaattccggacttattctttgaatagttggtattaaggtttcttttgtaaaataagaggtggtagtatttttcaatgcccttaattaacaaaattaaaagtttgaaaaccatatgttgattctccctcattttaaaaaattttgtaattccactggtccacaaaaatcccaattgaggagagctctgggaagagcacattctgtcaatgggtctcaacattttggtctcaggaccactttacattcttatttaggaaatgacctaaatgtctttcaactagtgaacgaataaactggtacatctgtgtaatggaatactacttcacaatcaaaaggaatgtactattgatacacacagctacatgggtgaagctcaaatgtattatgctgaatgaaagaagccagactcaaaaagctgcttactgntatgttctatttatatgacattcttgaaatgacactacttagggatggataatagattagtggttgccaggagttggggtagtggaaggggtttactacaatggantggcataagggaaattatttggggtgttgaaactcttaattggtggntacataattctatgcatttggcaaaattcatggagctgcacacccaaaagagtgaattttntcc

SEQ ID NO: 2632 - DNA, 761 bp, Homo sapiens
  misc_feature (1)...(761): n = A,T,C or G
tgnnnnnntttttnnaaggngcnnnncnttnaaatnnctggctacttgttctttttgcaggatcccatcgattcgctaaagccggctatgggaagccatgtcatacttggctaccttcctatgttccttctcacagcaaaactcttggactgatcatttgaagtcacccctctgtgtcttcttgtgaaatggcttgggcgtctctgggctctgacttgctcatctgggaagagatggggtagagggagttggattataaatcatgcttcactcagtcaacagaatgctactcaggcactaaaaatgatggcgtagccctacgtattctgacatgggaagatggccacaatatcttattatgtggaaaaaactagttgcataggatttatggtttgattacattttagtaaaataaattcatttatggtggtatatgcaaagaaaaaataatgccgggcgcagtggctcacgcctgtaatcccagcactttgggaggctgaggcaggtggatcacttgaggccaggaggttgagaccagcctggccaacatggtaaaaccccatttccattaaaaatacaaaaattagcaccaagccgtggtggcacgtgcctgtagtcccagctactcangangcttaanatgggaaaacttgcnttgaacctggaaaggtggaaggtttgcggtgaagcccaagaatcacgccanttggacttncggcctgggcttacaagcccanacttttgcttnaaaaaaaaaaaaa

SEQ ID NO: 2633 - DNA, 764 bp, Homo sapiens
  misc_feature (1)...(764): n = A,T,C or G
naatngcnagctctngttcttttncggattannaagccttagcaggcngggaagatgaaaggtagccggatcgagctgggagatgtgacaccacacaatattaaacagtttnaaagattgaatcaggtcatctttccagtcagctacaatgacaagtctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttacccgaaggctaggaataggaactaaaatgttaaatcatgtcttaaacatctgtgaaaaagatggtcttttgacaacatttatctgcatgtccagatcagcaatgagtcggcaattgacttctacaggaagtttggctttgagattattgagacaaagaagaactactataagaggatagacccgcagatgctcatgtgctgcagaaaaacctcaaagttccttctggcagaatgcagatgtgcaaaagacagacactgacaaattacaaatgaactttcttgcacttgcttgtcgcccaataaaagagangcccattgattcttccccaccccaaaaaaaaaaaaaannnnnnnnnnnnnnnnnnnnnnnnnnnnnnnnnnnnnnnnnnannnnnncccnnnnnannnnnnncnnnnnnnnnnnnnannnnnnnnnnnnnnnnnnncnnnnnnnnngnnnnan

SEQ ID NO: 2634 - DNA, 717 bp, Homo sapiens
  misc_feature (1)...(717): n = A,T,C or G
aatcagcctgntcttttgcaggatccctcgattcgcttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcaggagaatcgcttgaatttgggaggcggaggttacagtgaacccacatggcgccactgcactccagcttgggtgatagagtgagactctatctcaaaaaaaaaaaaaaaaaaactcgagcctctagaactatagtgagtcgtattacgtagatccagacatgataagatacattgatgagtttggacaaaccacaactagaatgcagtgaaaaaaatgctttatttggtgaaatttgtgatgctattgctttatttgtaaccattataagctgcantaaacaagttaacaaccancaattgcattcattttatgtttcaaggttcaagggggaaggttttgggaaggttttttnaattcgcgggnccgcggcgccnatgcattg

SEQ ID NO: 2635 - DNA, 769 bp, Homo sapiens
  misc_feature (1)...(769): n = A,T,C or G
gttctngttctttttgcaggatccctcgattcgaattcggcacgaggccaagcctcggcctccactgcacctgctgcggagtgggcacctttgcctgcaaggccttttncccantgnccaatggtantttaaccagggtttttgncnnttaaggaggccttngtggtgggtngttaatctggccnttccntattgaaaagctcctgttattgtccacagaccagaaggacttgtaaccttggtcccacagtctgacttnggcttttcaagcacccagaaaacttagagggaatcttatagattccagaacttaaggatacctcaagggatagggtcacagccaagaagtncaaaggaatcttcagtctggaacaaaaacagaaccctttcatgattgacaaangtcactttctgtttgcctggaccaagctactncagatcatctgaccaactcttaaaaatcacggccaggcacagtggctcatgcctgtaatcccagcactttgggaagcaaaagtggcaggatcattncagcccaagagttcaagaccagcctgggcaacacagtgagtgagaccctgctctatttaagaaaaatnattaagaaatttattaaaaaagaagaatcaggaaaccaagtncaacccaacttaacctcaatgaaccagcccctaacacagatgangggatttgggactgataagctctgtgctgngtccatggcccgtcanttatcaaggttgcacttttaaatgnggtatttttatgn

SEQ ID NO: 2636 - DNA, 769 bp, Homo sapiens; identical to SEQ ID NO: 2635
  misc_feature (1)...(769): n = A,T,C or G

SEQ ID NO: 2637 - DNA, 777 bp, Homo sapiens
  misc_feature (1)...(777): n = A,T,C or G
taananatncagctacttgttctttttgcaggatcccatcgattcgaattcggcacgaggccaagcctcggcctccactgcacctgctgcggagtggcacctttgcctgcaaggcccttctaccccatggcccaatgtcatcttaacaaggtctttggccacttcaagaaggccttgtggtgggttgctcaatctggcctttccttcatgaaaaactactgnttatgtccacagaccaagaaggaactgtcacgctggtaccacaagtctgacttgggctatcaacagccagaaaaactagaggaatcttatagattccagaactcaggatacctcaaggataggtcacaagcaagagtacaaaggaatcttcagtactgaacaaaacagaacccttcatgatttgacaaaggtcactttctggttgcctggaccaagctactccagatcatctgaccaactcttaaaaatcacgggcaggcacantggctcatgcctgtaatccagcactttgggaagcanaagtggcaggatcattncagcccangagttcaagaccagctgggcaacacagtgagtgagaccctgtctctatttaagaaaaaattattaagaaattttattaaaaaagaagaatcaggaaaccaagtncaacccaacttaacctaaatgaaccaacccctacacagatgangggatttgggactgataactctgggctgggtccatggcccgtcattatcaaggttgaactttgtaaaggggctttttttatgt

SEQ ID NO: 2638 - DNA, 777 bp, Homo sapiens; identical to SEQ ID NO: 2637
  misc_feature (1)...(777): n = A,T,C or G

SEQ ID NO: 2639 - DNA, 779 bp, Homo sapiens
  misc_feature (1)...(779): n = A,T,C or G
nnnnnnnnnnnnnnntntgaaacccttttnaagccttttgnaggaccctcgatcgaattcggcacgaggaacagacaagttctgtcccagcctctgttacctctaaccccatggcattctatccttttctacactgggcttncatttcttacccaacaatggactggtctttcaaggtgctggcatttaaattcccaaanacttggncctcttctganttggggacctccttcaaagntgaattgcagtgagtgacaataaactgggctaaatacttatcttgccagaagactcaaagggnttaaggcttttactaactgaactctatgctagaaggtaaggataaaagggtaacaggacacaagtcttgcttaacttgctatgggctgtcaagccttatcaaactaaccctatctctcttcacctcttatctttatcacccgtagattccttggtggccactgggttctttcaagccttaattagccctttgncactacctgnctacacatgctggttttccgtctcattccatcttgacattggctattttgaganctcaacttaattgcagaagaactggcttcccatctggcaacccattatatgnggcaaaagaccatgttgnaccatagagctagaccangtgccatggtggggcttgnaaagnattcaccaacttncaaaggttacctaaatccctttactcaagaagcctaantntactggacagtgggaaaaataacccntttggnataangnncccaaaaaaaagnaag

SEQ ID NO: 2640 - DNA, 757 bp, Homo sapiens
  misc_feature (1)...(757): n = A,T,C or G
taaanatcagctcttgttctttgcggacttatcgatccnaattcggcacgagggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaattttgtattagatgaacagactcagcaagcacctcatcttatgccttccccttttttggttgatgttgatggtaaccctcatccatcaagatatcaaagattagttcctggccgtgaaaattgcagggaggagcaactcatcctcaaatgggagtacttcctcaggactgaatcaagttttaagtcagcaagcaaaccaggagatcagcccactggacagcatgattcaaagactacaacaggacaagacctgagacgttcttggtgaagcaggtttaataatccaccgttaagtagangctccataagtctacctcaaaggtcattcccaccaacgtaggcttanacgtatggacaaattgaagtgtccgnaaatgcncagaacgcccaagaaat

SEQ ID NO: 2641 - DNA, 779 bp, Homo sapiens; identical to SEQ ID NO: 2639
  misc_feature (1)...(779): n = A,T,C or G

SEQ ID NO: 2642 - DNA, 764 bp, Homo sapiens; identical to SEQ ID NO: 2633
  misc_feature (1)...(764): n = A,T,C or G

SEQ ID NO: 2643 - DNA, 788 bp, Homo sapiens
  misc_feature (1)...(788): n = A,T,C or G
gnntttgataccctttttgantgccttttgcaggacnctcgttcgaattcggcacgagggaacgcagctgctcaccagcaacggaacaaagctggacngagaatgactttgaagagctgagagaagggcttcagaccgatcaaattactctgagcttacggggagggccattcaaaccaaagggcaaagaaagtttgaaaactttgaaaaaaataaatggtcattaattaaacgtggaaatctggtgaacaagtaacaaactttggtgaaatttcaggaccatagccattgaagtggatgagggaacctatatcatgcactcaacaatggtctttttaccctgggagcttcacacaaagaagaatcgccctgaaacctggctatggaaaataccttagtataaattcagatgaacttgttgttggcgttcagatgcaattggccaagagaacaatgggaaccagtctttcaaaatgatggccatncagtaatgagaatgaacagtcttcaactaaaggcaacaatntagatgaatctcggaaacatgatattgaccaagacagaaaagattcacttacataaacttcaaaagaagataaaactgatctatgacattaatagtcagaatattcattatccttgagggaactaaactgggaagccncatgatagggcattttggaagctagtaatgncctctttcttgatctggtacattggtgnggttatttcattagatttattgagctntacatttaccaccgngtccttggctctggatatgtttn

SEQ ID NO: 2644 - DNA, 800 bp, Homo sapiens
  misc_feature (1)...(800): n = A,T,C or G
nnnttttnnnanatncagctcttgttctttttgcggatcctatcgattcgaattcggcacgagttcaccaatgacatgatcttatagcgattctataaaaacagaattattaaccaaattcagcaaagttggtcaaattccaaaattaacccccagaaatcaggtgctttctattatagtactngccaggtggaaccacttcatggaanggaaattagccaggttcatttaaatngcattcaaaaaggaattnaaattccttagggaattaaccnaggganggtgaaagacttggtccccagaaaactnccaaaatattggttggaagaaattaaagaagacataattaaatggaaagacatcctggtgttcaattatatccatttaaagacacaattaaatgggaagacatctgtgttggaaagtttaatattggtcacatgtcagtctacccaaagtggcatcagaggcaatgcaatcctattaacatccacagtgtttttttaggaaatnttaaaacctatcacangccaggttcngttggtcatgcctgtaatcccaatattttgccaagcctaggagttcaagaccagcctgggcaacatacgagaccctagctttacaacacaccaccaaaagcccggtgtggtagcacatgtctgtagtcacaggtcctttagangttgaggcaggaggatcacttgagccccaagaatttgaggcacagtgggctnttntcaggnttcttaactccagtctnggtgacanggggaaaacctgnggctaggtttaaaaaaaaa

SEQ ID NO: 2645 - DNA, 804 bp, Homo sapiens
  misc_feature (1)...(804): n = A,T,C or G
gnnntttnaaaannncnagtttactttgttantttttgcaggatcttatcgatccgaattcggcacgagcatggtaatcctgctcagtacgagaaggaaccgcaggttcagacatttggtgtatgtgcttggcttgaggaagccaatggggcgaaacctncatctggtggggaaggaaaggaaggcagggctggtgggtggggactggggtaggggtattagtatcactcctggaagtttccactggcttcttagaaatctaacccagaaantagaaacctaattttttaaagggtgactgggcaaaaaaaaaaaaannaannnatnnnnannnnannannnnnnannnannnanacnnncnannatgnaccntnnnnannntncnnnngannnnnnnncannnnanncatngnaanttnnnnnnnnnntgaaaaactnnngncctnaanaaaatngnnnnntntnnaatnnnnnncnnntnnnntnnnnnnnttgnnnnnnnancnccnnnnnnnnanngnnnaaaaaaaanttttttttnnaaannnnnaannnttnnnnntaantnnacanntttnnnnngnnnnaanaannnnnncncanannattgnnnttttttttnnnnnnnnnnnnggggggnnggngggaantnttttnnannnngnnccccnngncntnnnnttngggcccnnnnccnntttttttnncccnnttgggnggnnnnttnnnccccnnnnnnnaaannngnnnnannnnnntnnnnaaanaaaanntnnnnnnnnnaantnnnnnnnngnggggnc

SEQ ID NO: 2646 - DNA, 779 bp, Homo sapiens
  misc_feature (1)...(779): n = A,T,C or G
gnnttttnaannnnnncagtntactngtngtttttgcaggatcctatcgattcgaattcggcacgagcgagttttttttttttttttttcttcctctctttctctcttccttcctccttccnttcctccgttcntccccccccntttttttggnannagggtttttttttngtgncnaggnctggagtcaagggnccaantnccngttaatngaaccntgacntcnngggccnangnaatccttttaacttaancntcnngnaaacngggnccncnggcccatncaacaaaaccaagttangattttttttttttaaaatttttgagcaacagggggatctcctggggtggcccaaatgggcttaaaactcctggcttnaaatggatcctccggcntaagcctnccaaaggctaggattntaagcntaagccaccacacccagcccattctttataattactttatggttcaaagcagcttanggttactggnaaattgngaagaaattnccgagttccacatctnccaactttgcatttttacatgactggntttctctattctataacctaataagcatgcttttcctaccttnctactgaactttttactaatatattatctaattgaaatgagcatacccagtncatttactagaattagatgtgggactcagaaataaatctgcaggttggtttggaccaactntgggaaaagctacctcaaatttgtggagggccaaagnttgcatttgcnctntactggaacanggggagna

SEQ ID NO: 2647 - DNA, 793 bp, Homo sapiens
  misc_feature (1)...(793): n = A,T,C or G
agctcttgttcttttgcaggatcctatcgattcgcatnnggcacgagaaatattntgatactgtacccgttgctgctgccatgtgtgtgcttaaaacagggttcctttttgtagcatcaagaatttgggaaaaccattctttatatcaaaattggcncatctttgggangaatgaatgaatgaaagaaccctggagttttcaatcaacccatgccctcttggaaagaagggagaacncatttctttttttcaacccaaagaaccactttaaaaaccttggtgctgggttgatgaagttgggacaagcctcttctcccattctggtttgccagatagctgatctggccaatgaagatctccacagttgtatgtggcctgtggtaggggaccccgatcatctctgagaagtcctaagacatggacttgangtgtcagaaatggctggttctgagctacctggtaccccaacgcttgtctggacagtgcgtcgacacattgaagatgagtttgatgcctacatcattgggtctttcgtgaatgccaccctaatgttgtccattggagaaactgtagaagaagtgactgactctnggttcctggggaccaccccgacttggcctgctncntattaggagatgatgccttggtgcaggctatncanatgnattnggnacatacnagccgacaagaaagtcaatgaatggnaaaaccctggaagaaaacaattgtgaantgtgcaatggaaccancgaccagtggtgaatggccttacaggangaaaactggtntnttt

SEQ ID NO: 2648 - DNA, 843 bp, Homo sapiens
  misc_feature (1)...(843): n = A,T,C or G
tatnnnatncagctcttgttctttttgcggatccctcgattcgaattcggcacgaggaaagaccgagatagagagagagacagagacagagagcgagacccgtggttccgggncagagaaaggaggaacccccccnganganganganganganggganccgtgattcaccagtcccttccaccaaagtgtttttcaaccagccgattgaaagaaccgattccaggattccaggggaattttgccnngaaaaggaaggttnttgaaccgtnaccaagaagcaaagttcgaggaaaaaaaggaaagaaccgaccatttgaggaaaaggaccgaccaccaggggagaaagaaggaaacccagacnttaagtcttcttcgaaagttattagtagacgtcgccatgaaagttgaagaaaggagattgtcacaggagaccaaacccnaaaaatctaaaagaagcnaagaagggaaagaagcnggcagtgagccttgcccttgacaggagagccccgaaactncaccttgcagaatagcatgggtttngccttttgtgtatattagtaccagaagtagatactatnaatcttggtatttttctggataatgtttaagaaatttaccttaaatcttggtctggtttggtagtatgaaaagttaacttttttttccaaattaaagagtgaatttttcattgttaagttnaaaatctttgncttgtnctatttcaaaaattaaaagaccgcaatgactttntnttccaaaaaaaaaaaaaaaaaactngggcctttaaacttttgtgagtcgtnttacgtanatccngacttgttaggatccttggttgagt

SEQ ID NO: 2649 - DNA, 775 bp, Homo sapiens
  misc_feature (1)...(775): n = A,T,C or G
tanacancagctcttgttctttttgcaggatcccatcgattcgaattcggcacgagggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttagagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagcttccaaagtggatgaagatgaagaacactaaagcagttggctgaatgggtatcctgataaatctgggcttgtcttncta

SEQ ID NO: 2650 - DNA, 879 bp, Homo sapiens; identical to SEQ ID NO: 2548
  misc_feature (1)...(879): n = A,T,C or G

SEQ ID NO: 2651 - DNA, 705 bp, Homo sapiens
  misc_feature (1)...(705): n = A,T,C or G
cagctcttgcntttatgccgatccctcgattcgaattcggcacgaggagacgtcgtctctacaaaaaataaaattagccaggcatgatggcctgtacctgtagtcccagctactcaggaggttgataggggaggatcacctgagcctgcgaggtcgaggttgcagcaagccaagatcatgccactgtacttcagcctgggcgatagagaccctgactcaaaacaaagaagacccagtacaagttcagtgttgagtgctaaagacttaaaagagttataaagctgaacccttaatcttaagaggtttataagtgagaacaagaatctccaaatcctgtactgtttaatatcagcatgagactaaaccactgtcctaagaagacaaccttaatttgaatcaagttattttagagtgatgtgttttctgaggcagctctcagaangttattgtctggtgttaaaatagtgaaattgagtaataacaaggttaaaatcggtggacattaaatacacacaagacttcaattgctgggtcctccattgattaatgaaaaaatgattgtttttggaatttgagtgaaacacttcttaatggctgagtanggtggcttacgcctgtaatcccaccactttgggatcactttgaggccgggacttttgagaccagcttggncaacatgaggaaagcacgtctttctaaaaatcn

SEQ ID NO: 2652 - DNA, 709 bp, Homo sapiens
  misc_feature (1)...(709): n = A,T,C or G
ttnaatcatgctcttgtttcnaancgntgncatcgattcgaattcgcacgaggtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccacccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacctttaaaaaaaaaaannnnnntnnnnnnnnnnnnnnnnnnnnnngnnnnnnnnnnnnnnaaaaaaaaacctngnnaacnggatgccaccctgggccnacgaattttcctgccaatgttgctcactngggggacnncctggaaggactnttttggggncccncanaattaaaccttgn

SEQ ID NO: 2653 - DNA, 740 bp, Homo sapiens
  misc_feature (1)...(740): n = A,T,C or G
tgnttntttnaattatgctctcgccttcnaatngntngnntcnattcgaattcggcacgaggagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaacttgcagaagaaaaaccagaagccgtnccaggtgaatggtgctcccgggtcccccacggaaccttgcaggccaaaagcagcatcagaaggctcttcccaaaaagggggtctttgggcaaatcaccacttgtcccgcgcttggcaccggaaaaanggcaagggcttgtcttttggtcattcanggagttccagccctgcnttcaaaaatgggggcccaaanaat

SEQ ID NO: 2654 - DNA, 780 bp, Homo sapiens
  misc_feature (1)...(780): n = A,T,C or G
ttttncaacagctggctactcgttctntttgcaggatcccatcgattcgaattcggcacgaggacagtacctttcccccccctttcatggcccattttattgtctgcctttcagtactaagtatgaccgttcctatctcagatcttaataaaaagaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttanaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaaatcccttgtgattggatgtttactatcngccnngaaactggtactcaagatgttngaacg

SEQ ID NO: 2655 - DNA, 742 bp, Homo sapiens
  misc_feature (1)...(742): n = A,T,C or G
ntttgaaaccctttgttacttgtnctttttgcaggatccctcgattcgtttcagccctttgccgccagggccaaaggtggaaagtgatttggaagagnaagagcttttcgtccaccagaaaaattggtccnaaattaancttgnaagggangnaatttgggaanttgccgcaaggcnaaaagcnttacttttanngntttaatcaantangnttggcccttccngaaagtaaattttaatggcttaaaggggttancagncccaanaaagggtnnggggaagcaantcccagccncanccagggccagttaaggcctttggtgaactgtgctattagggcccagcttccggtaccctgtaggttcccaaggcctggcttaagcagatccttgatcgatataccttgagancagaaggtgctccnaatnacaccgtccaataggggatctaggacaatcttggagatccatgccttgctgtgttgctgattcttactggggactgtagatgaaaggtggaaagatnacttagcacatcttnaaactatgggaagncattctttctgcttgtangatttgtcntgttttggaaanctttaaacgtggntnaaccctatgttnggaattatctgctttatggnagcaataccctnttttaagaatttgaattnancccgaaagttatggccggtaacttaaattggttaaacctgggcttataaccccaaggcccgggttcaacn

SEQ ID NO: 2656 - DNA, 786 bp, Homo sapiens
  misc_feature (1)...(786): n = A,T,C or G
ttgcnancgntgccctactcgttctntntgcaggcatcccatcgattcgaattcggcacgaggttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaaagcaggtgcagatgtggatgcagcagataaccgcaagataactcctcttatggcagcatttagaaagggtcatgttgaangtgggtgcgcctactttagtcaaagaan

SEQ ID NO: 2657 - DNA, 807 bp, Homo sapiens
  misc_feature (1)...(807): n = A,T,C or G
ttnaaantatcgaaactctttggacttttcgnacgctttgcaggatcccatcgattcggnccacttncggcgtngccatggnggcgnaacactactanttcccgtcgcagctnctgccgtnagagcntgtggacaantgtataggatcaagaattcacatccngatgaacagtgatnangaaatngntggtactctcctacgatntgatgactttgnnnntatggtnctggaagangtnnctgagnttgaaatcacaccncatgaanaangatgctaaattanancacatntngctnaatggaaataatataacaatgctggttcctggaggananngacctganntgtgaatgagttnccttgacttacactagattttgttttggcttatnatgacaanaaaatgggattttttttcccactttctaatgnttaaatcccatanagctaagttncccgnttaagggaagtgctntgaagatgtgtacccatcnttgtnagttaancatgattatcctggaaaaagaanaaaatancttcttctttgcagatgaaaataaaggtgtttttggttaactgtcnaanaannnnnantgccctnaaaaagagttgnnggggggcntgactcttataaaatggatttaatnaaactgtncnanangcctcccccccttaaaanntttggggcgtgttnttcccttangncccccaaaannntnnnannccctttntgggattttnggcccaaacccccccctttgaaaggnnngggaaaaaaacttntttttttttgggaaaatttgtgn

SEQ ID NO: 2658 - DNA, 777 bp, Homo sapiens
  misc_feature (1)...(777): n = A,T,C or G
tntacatacaggctacttgttctttttgcaggatcccatcgattcgtggctggtattataggtgcacaccaccacacccaactagttttttgtgtttttagtagagatggggtttcatgatgttggccaagctggtctcgagctcctgaccccaggtgatccacccacctcggcctcccagggtgctggaattataggcgtgagccactgcgcacggcctggggaggttttatttcttgacaaaggtatttgatactcgtgcagaccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaaacccaactcaaaatagaaagtattacatgataaggtctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggctctgcctgaagcccaagttcatttagtatgtcatggttaattcagagtaaaatcaagagttagtacttgatttatgcttggtatataaagaaagagacaacttcactgnatgatcattttgtcacttttcaaaagcatttaattccattcaattggaaatgtg

SEQ ID NO: 2659 - DNA, 774 bp, Homo sapiens
  misc_feature (1)...(774): n = A,T,C or G
naaaccnncagctacttgttctttttgcaggatcccatcgattcgccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaaaagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgnacttnccaccactggaaatgttagcataaaagaacttggagaggaaaaaagtnttac

SEQ ID NO: 2660 - DNA, 815 bp, Homo sapiens
  misc_feature (1)...(815): n = A,T,C or G
taaacctncagctacttgttctttttgcaggatcccatcgattcgaattcggcacgaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacnaaaagtgatatgatggaagaaaacatngattcnagtgcccnancnnttgntnnaacccanccagaagccattngtnnanaaganntccatngaaannnntaaaantggagaagccaaanttncagaggcaccagcttntgaaaaagaanttgtggaagtaaaagaggaaantattgaanatgccacagaaaagggaggagaaangaaagaagcagtggcagcagaagtaaaaaatgaagaagaagatcagaangaagatgangaagatcaaaacgaaganaagggaaactctggaananaacacagatntgaaaagggngaaaaatatggaanagggtttaaatgnggatgtgaaaagggaaaatangcaagagananagaatttggaaaaaangngtgaacccnggaaaggggatttnggaaaattttggaaaaaaaaannnnnnnnnnnnnnnnnnnnnnnnnnnnnaaaaaaaaaacgcccttttaaanacnttttgggggggntcnttttttcccgnaannnccccanacctttgantaangaatnccnttc

SEQ ID NO: 2661 - DNA, 815 bp, Homo sapiens; identical to SEQ ID NO: 2660
  misc_feature (1)...(815): n = A,T,C or G

SEQ ID NO: 2662 - DNA, 805 bp, Homo sapiens
  misc_feature (1)...(805): n = A,T,C or G
gtngggntnnnnnttttgnaaaccntnngctattgttctttttgcaggatcccatcgattcgaattcggcacgagggtgactggaatcgcttgaacccgggaggcggaggttgtagtgagctgagatcgtgccactgcaccccagcttgggcaacagagcaaaactctgtctttaaaaaaaaaaaacaaaaaaaccaaacaaacaaacaaaaaaaaccttatatgggctgggctgggcgtggtgccttatgcccacaatcccagcattttgggaggccaggatgggaggatcacttgagcccagaagtttgagaccagcctgggctacagagtaaggccccatntctacaaaaaaaccttaaaaattagccaggtgtggtggcacgcactgtggtcccagctgtaccagaggctgaancaggaggatcccttgagcccannaggtcaaggctgcagtgagccatatctacaccactgcactccagcctgggcaacagcctgtctcaaaaactaaactaaaaaccttatatgttnttgttagaatnaaattagatatacaaaaagaggggccgggcagggtggctcacgcctgtaatcccagcactttgggangctgangcaggtgaattacttgaggtcatngagttccgagaccagcctgaccaacatggngaaaaccctgtctatactaaaatntacaaaaatcagtctancgttggnnggtgggcgccttgtaattcccanctattctggcaggctnangcaangataattgnttcnatcccgggaaggcaataggtttccc

SEQ ID NO: 2663 - DNA, 778 bp, Homo sapiens
  misc_feature (1)...(778): n = A,T,C or G
tcaacagctggctactcgtnctntntgcaggcatcccatcgattcgaattcggcacgagagttttcctgtgattagtgtttttggtgttgttttattttttttcttacaggaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatctattctctctgaagtcttctacctggaggcttcatctgcatgataaaactttggtctccacaacctcttacaacccaggcattcctttctatcgataattactctttcaaccaattgccaatcagaaaattgttatatctacctataatctagaagcccccacatcaagttgttttgcctttctggacaggaccaatgtatatcttaaatgtatntgattgatctctcatgtctccctaaaatgtataaaaccacgctgttccccgaccacctggagcacatgttctcagggtctcctganggctgtgcacaggccatgttcacttacatttggctcagaataaatctcttcanataanaaaaaancccccnccnccccccccccnacccacaaaaaacctcngccctttaaaactttngngggncg

SEQ ID NO: 2664 - DNA, 961 bp, Homo sapiens
  misc_feature (1)...(961): n = A,T,C or G
gnattccgtaaacgtacngtgttctttttgcaggatcccatcgattcgtttttaatagtcattccaaatatgagatgcattgttacaggaagtcccttgccatcctaaaagccaccccacttctctctaaggagaatggcccagtcctctcccaagtccacacaggggaggtgatagcattacataatttacacgaaagcaatgctatcacctnncnagngtggacttgggagnggnnngcttngnttncnnttgagtgatganncntcnnnnncnccntnccntcttnttngnnccnnancttgcatnnntnnnngcttcnncntncntnngaccgnnnngnnnncnncccnnncttccnntncnnnnttnntncnnnccnntnnnacnnacnncnccncttannnncnccncncnnnnnccnnnnnncccnnnnnnncccnncnnnnctncctnnnnnccntctnncnnannnnnnntnnntncnnnnnnnctnnnnnnncnnnntcnnnnnnnnnnnnnccnnnnnnnnncncnnnnncnntnnnnncnnncnnncnncnnnnnntcnncncnnnnncnnnnncnnnnnnnnnnnnnnnnnntcnnnncnnnnnnnnnnnnnnnnnnnannnnncntnnnncnnnnncccncnnnnnnnnnnnnnnnnntcnnnnnnnnnnnnnnnnncnnnnnnnnncnnnnnncnnctcnnnnnnnannnnnnnnnnnnnnnnncnnnncnnntnnntncncnnnnncnnnnnnnnncncccnnntnnntcnnnnnnnncncncnnnctnnnntcnntntnntccncttcctnttnccncncnnntctnttcntnnnncnntctncnnncccnnctatccnatnntncntcntnnccntcnncccncnnnntnnnctccnncatcntccncnatctnncctccnnannttnccntnttnccccccg

SEQ ID NO: 2665 - DNA, 790 bp, Homo sapiens
  misc_feature (1)...(790): n = A,T,C or G
aattttcaagctcttgttttttatgcaggatcccatcgattcgctggtctccaacctggtctcctgggctcaagcgatccgcccgcctcggcctcccacagtgctgggattccaggcgtgagctaccgcgcccggcctatttacttttcttactaagctggggatcaccgtcgccctcggcttggcaggaaggcgggggtgcaagaagaaaagaggtacagaacacccagaggtgccctcgattccgtcttgcacttgcccttctcccaccgtccagcaataaagcgagagaaacaagtgcaggaaactggccggcagtcatgggagaagccaaaaagacaggagttcagtggcatgaccagggctcactgcaaccttgatctgggctcaagtgatcctcctacctcaacttcctgagtagctaggaccacaggtgtgcaccaaccacacccgactaatttttgtagagatgagatcccactatgttacccaggctggtcttgaactcctgggctcaagtgatcatcctgccttggctttccaaagtactgggattatangcttgagccacccgtgcctggcctgtgatcaaaattctcatttttttagtcactaaaaatgctggggggcactccattctncattatgtgattagttcacattgcatgcttgtatcaaaacattatatnttcccccncaaatttntnccaaaaacttttaaattttaagtatttaattggttcaggaaaaaaataaaatgctgggggggctgaaatctcaangggcccat

SEQ ID NO: 2666 - DNA, 779 bp, Homo sapiens
  misc_feature (1)...(779): n = A,T,C or G
tttaaanctttcatttanagccttttgcaggatcccatcgattcgaattcggcacgaggtttgtgcatcacttggtcaccattgggcttatctccttctnctacatcaacaatatggttcgagtgggaactctgatcatgtgtctacatgatgtctcagatttcttgctggaggcagccaaactggccaattatgccaagtatcagcggctctgtgacaccctttttgtgatcttcagtgctgtttttatggttacacgactaggaatctatccattctggattctgaacacnaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcaaaggaagaagatgtgaccacctgcacaaaaagtccctgtgacagtagctccagcaatggtgccaatcgggtgaatggtcacatgggaggcanctactgggctgaanantaaggtggttgctatagggacttcagcacacatggacttgtanggccctggcaacatactcctcttggcccttccatatctactcttntgtgaatgggagactgcaangcactganggagtatcaaaagaagcaaattttttcacttttgaaagaaaactgncattttgtntttaatagcctccaagttcntttn

SEQ ID NO: 2667 - DNA, 750 bp, Homo sapiens
  misc_feature (1)...(750): n = A,T,C or G
tatnntatcaagctcttgttcttttgcaggatccctcgattcgagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacatangcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattatnagggttggtttttttttnaaaanangaanannnnnnangaaaactcgagcctctaaaactatagtgagtcgtntacgtaatcngacatgataaaaacattgntgatttggcaaccacactngaatgcatgaaaaatgcttatttngaattgngatntntgttattgaccatatactgata

SEQ ID NO: 2668 - DNA, 820 bp, Homo sapiens
  misc_feature (1)...(820): n = A,T,C or G
gnnnnnnnnnntttaatanttatcanctcttgttctttttgcaggatcccatcgattcgaattcggcacgagaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccanagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggangccatcgcagtggccaatgcaagcactatgcactgagatgccttggccatggcacaaagagaaaccagccaggaaaaaccagacagactttcacactaaagaagaagccctccattttttttttttcttttttttattggggggagtttacnaaacctttcaaggttgctttttgtttnaaaatattaaaaagaaaacntttaaaaaaaaaaaaaaaaaaaaacttggagcccttttaaaactattagtggggtcgtnttaccntaaaatnccanacttgataaan

SEQ ID NO: 2669 - DNA, 789 bp, Homo sapiens
  misc_feature (1)...(789): n = A,T,C or G
tatntatacagctacttgttctttttgcaggatcccatcgattcgtggaggtctcctttcgccccagcccaggtggccaagcccatcctggcctcagaacatgctgagcacattttgtagggtggcacctttttatccaagttactagctacacatcantgtttaaagagaaaaaagtgacctttcatttttttttcttgaaacttgaggaaacaagatacatactactgattttttttttcttaaaactaaatgcatgactgcaganggtagaggtgtatatttttcatactgtggggcaaagtatttgtgctgctttttggagatggactggaacgtctggtttctgtccccnggcccggcagctacgtctattttctgtanaaggtgccacagtgagacctggagccaccccttnctgccctggcgccgtttanagctgggancccgtggactcccggcctgtttctaccttctattcaaccactctgacgtggggagacaaaaacaaataaaactttttgatagtgtggtaaaaacattgatttgaactattttagtaaaaggagtgacaaacaagaatgtgatagtgtctactttgagctaaataataaangcctctttgtgaacctnctgggntttanngcanggcnnnaaagtttttnnaaaaatgngnannnaaactnganccttnaaaaactntanggaggcgtnttcccttantncccgacatganaaaaaacctttgatgnggtttnggncaaacccccaacttanaangccgtggna

SEQ ID NO: 2670 - DNA, 780 bp, Homo sapiens
  misc_feature (1)...(780): n = A,T,C or G
tatnctatcagctcttgttctttttgcaggatcccatcgattcgagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcnccttcagttcagcacagcctgagcagtgagaaggtctgaaaggagagtatatagntaagatccttgagaaagggctgcctgaggaactgacctcttaaagatctcaggatctttaagacaacaagttaggttcctactggagttacctgccagaatggcctcttaattaactcangtaatgaagagctaactgtgttataatcatcttgcttttgcctgaatttggagaaagtattataattaaagttcccagtatcagaaatgtccttacataagattaaaatatcttggtgactaataccattctatgagaaagagtagttatttgcccagactgtattaatttactttagaaactaatgtttgaagtaatggaaaaaattttaaattatnaagctaagggcaataacatttgctacttatttatagaattatttgaaaaaatttgntttgaagtaatgctttaaggagtntaagatattcaagataaattatactatnaaatgatttatt

SEQ ID NO: 2671 - DNA, 749 bp, Homo sapiens
  misc_feature (1)...(749): n = A,T,C or G
tcaaatntnnnntaancctttttaagatcagcacttgttcttttgcggatcnntccatgggtagaanggatgctcgtaccnnnaagancantaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcangtacctaagttggagctgatgcccctggagacaccgcaggccctgccccgatgctagtccatggtacattctggaagcactggccatccatcctactcaaaggcctgtcctgccagggaaggacgcacattcacctggccccaggactgcctggagccccggtatcatcagtggcatgcggncccattgtgaaatagctgtgtcatcgatggaccctggctctggcagatggaatacccttcttccgttctgccaatggggtgattctgactccanggaatactgatggcttcctccttccaagtccttaangangncctgancttcnccttaccgaaagccctttccttggctggngatgaaaaaacaantgtcanaatanccccaagcacagttccanaaaaag

SEQ ID NO: 2672 - DNA, 782 bp, Homo sapiens
  misc_feature (1)...(782): n = A,T,C or G
ttnnntantaaaccccttnnntactcgtttttangcncgttcccatcgactcgaattntncacgaggaccagggctcactgcaaccttgatctgggctcaagtgatcctcctacntnagcttcctgagtagctaggaccacaggtgtgcaccaaccacacccgactaatttttggtagagatgagatcccactatgttacccaggctggtcttgaactcctgggctcaggtgatcatcctgccttggcttccaaagtactgggattataggcttgagccaccgtgcctggcctgtgatcagaattctcatttttttagtcactaaaaatgctgggggggcactccattctccattatgtgattaagttcacattgcatgcttgtatcaaaacatcatatataccccacaaatatatacaaaaaactttaaaattttaagtattaattgctcangaaaaaattaaaatgctggggtgctgaaatctcaagggccccattacaaaactccttangaacctcgccctcttntgctgtaaggactggttccagaatgagagaattaaaagacattcccgccaaaatgtcataatgtcaccccggaaacctgcgaatatgttatattacatgaccanggagaantaagggtgcanatggcagtaagggtgctaatgggctgaccttaananaaggagatgatcctggattatctgggnggacccaatgtaatcacaagggtccttactggggaaaatgaggnggctgatcaaaagcaantgatcatg

SEQ ID NO: 2673 - DNA, 769 bp, Homo sapiens
  misc_feature (1)...(769): n = A,T,C or G
tatacanctnttgttctttttgcaggatccctcgattcgcgacaatcagtgattttgctgtatttctcacaatagtaataatggttacaattgactaccttgtnggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatgggtggcgttatgntgggagtttgctctgtcatgggacttccatggtttgtggctgcaacagtgttgcaataagtcatgtcaacagcttaaaagttgaatctgaatgttctgctccaagggaacaacccaagtttttgggaattcttgaacagcnggttacaaggctaatgatttttattctaatgggcctctctgtgttcatnacttcagtcctaaagattattccaatgcctgttctgtatggggtttcctttatatgggagtttcctcattnaaaggaatccagttatttgacccgtatnaaatatttggaatgcctgcttaagcatcagcctgatttgatatacctncgttatgtgccgctctggaaggccatattttacagtcattcagcttacttgtttggtccttttatnggtgataaaang

SEQ ID NO: 2674 - DNA, 790 bp, Homo sapiens; identical to SEQ ID NO: 2665
  misc_feature (1)...(790): n = A,T,C or G

SEQ ID NO: 2675 - DNA, 784 bp, Homo sapiens
  misc_feature (1)...(784): n = A,T,C or G
tatactatcagctacttgttctttttgcaggatcccatcgattcgctggtctccaacctggtctcctgggctcaagcgatccgcccgcctcggcctcccacagtgctgggattccaggcgtgagctaccgcgcccggcctatttacttttcttactaagctggggatcaccgtcgccctcngcttggcaggaaggcngnggtgcaagaagaaaagaggtacagaacacccagaggtgccctcgattccgtnttgcacttgcccttctccnaccgtccancaatnaagcgagagaaacaagtgcaggaaactggncggcagtcatgggagaaccaaaaagacaggagttcagtggcatnaccanggctcactgcaaccttgatctgggctcaantgatcctcctacctcagcttcctgagtagctangaccacaggtgtgcaccaaccacacccgactaatttttgtagagatgagatcccactatgttacccaagctggcttgaactcctgggctcangtgatcatctgcttggctnccaaagtactgggattataggcttgagccaccgtgcctggcctgtgatcacaattctcatttttttantcactaaaaatgctggggggcactccattcttcattatgtgattagatcacattgcatgcttgtatcaaaacatcatattntaccccacaaatatatacaaaaaacttnaaattttaagtattaattgctcangaaaaaaataaangcttggggngctgnaaacttnaagggccccatt

SEQ ID NO: 2676 - DNA, 784 bp, Homo sapiens; identical to SEQ ID NO: 2675
  misc_feature (1)...(784): n = A,T,C or G

SEQ ID NO: 2677 - DNA, 818 bp, Homo sapiens
  misc_feature (1)...(818): n = A,T,C or G
atcagctcttgtctttttgcaggatccctcgattcgaattcggcacgaggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactanggtgaattgggaatgaagctgtcagaaatccccttgactctgcattctgtttcagagctggtgcggctctgcttgcgcagatctgatgttcaagaggaaagcgagggctcaaacacagatgacaataaagattcactgcatttgaggataatgaggtacaagatgagttcctagaaaagctggagacctctgaattttttgagctgacgncagaggagaagctacagatcttgacagcactgtgccaccggatcctcatgacatactcagtgcaagaccacatggagacccacagcaaatgtctgcacagttgtggaangaaccgcttgctgtgtttgaaaggaagaaaatgattaagaagaagagcnngantaaaccgnaaaccgggaaagaaaatgggaagnccaaaaaaaaaaaaaaaaaaaaaactcgaaccctcttaaaaactatnagtngaggtccgtattaccgtttgaatncnggacnttgaatnagaaaccattggatggagttttggnccaaaaccccaancttagaaatggcngnggaaaaaaaatg

SEQ ID NO: 2678 - DNA, 875 bp, Homo sapiens
  misc_feature (1)...(875): n = A,T,C or G
ttnannnntatacaactacttgttctttttgcaggatcccatcgattcgaattcggcacgagggcacgaggcactaagcaggctagtgctctcagcttcccggcctccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgccggcccaggggctggaatcccgcccctagtggtaccctccagaccaagcgccaccgncttcgacagtgtcctcgctctacctctgacctctccggaggttccgctgctccaagccggacttaaggcttcaagaggcgggcgtgccctctggagtcccctaccatgactgaaggcgccagagactggcggtgtcttaanacttcgggcaccgccacgcgctgtcaagcaacaactctgcggaccttcccggcgtaatttgcaaccgggggcttgggggaaggggcttgggggtttggaaccgggattgaaggaaaggtnccgcacaaacctggtctttttgnttcaaatttgcnaataaaaacgttgnacaattntttgggggaagccggttttnnnnnnnnanaannnnnnnnnnnnnnnnnnnnnnnnnnnaanncccttcgaagccctttttaaaaaactttttaggggaggtcgnanttaacgttnnaatnccnaaaacnttgattaaagaataccatttggttgaaattttggggacnaaanccccaaaanttagaaatggcgg

SEQ ID NO: 2679 - DNA, 772 bp, Homo sapiens
  misc_feature (1)...(772): n = A,T,C or G
nnnnnnncccnnnnggnnngnnnaggnggggtnnnnntttntactaangntgtgnganctcgtnctctccgcaacagcccggcgggtcgaattcggcacgagtccaagaggagaagcatgttccaaaacccttaactttgggaatttagaactagcttttttactatcttctgcacagcataacttcagtctccctttactaattcaaggaaatctcagtgaacaaattgtataagggtagatgagctaaaagctcactgagtcattaatttgtcataactcatctaaatacaatgattaggcttgtgtaggtgtccctagtttctctttctaaatcatgtcttagtagggacagagcaataatggtggatcgtggcaacgggaaggaagatgatgtgtcagttatctattgctgtatgacagtcacaaaaccttagtacttactacagaaacaatgatttgtcacattttgtgggttgtctggatggttgttttgcttatatggtgcaggctgagattactcatgcagcttcacagttcttttgcttatatggtgcangctgagattacacatgcagaggaaagatgggctctgntcctcattcgtatgcctggggccttggtgcgggttgtggcaatggcgtcttggntctccatgtgccgnctctccagcaggataacctgtnnttttctcacaccatgacactggggttccaggannatcaanccannancngctanacccattannaactaggccccaaaanttgct

SEQ ID NO: 2680 - DNA, 768 bp, Homo sapiens
  misc_feature (1)...(768): n = A,T,C or G
ttntatcagntcttgtttttgcggatccctcgattcgaattcggcacgagagatgggttaaaacttaaatgtcacatctgaaacagtaaaaatcctagaagaaatcctaggaaaaactcttctggacattggcctaggcaaagaatttatgatgaagacctcaaaagcaaacataacaaaaccaaaaatagacaaatgagatttaattagaaaaacttctgcacagtaaaagtaataatcaacagttaatagacaacctatggaatgggagaaaatatatgtaaattatacatctgacaaagaactaatatccagaatctacaaagaactcacaagaaaaaaaccaaccccacaagcgggcaaaggacatgaacagacatttcccaaaagaagacatacaagcaacctaaaataatctaaaataatttttaaaaagaaaaaatgcttgacagagttttgatagtacttagtaaaaagttatatctagtggctttttgnttgnttggttttgntttggttttaagaggtagtctctgtttcccagctggagtgcagtggcgcaatctttggctcgctgcggcctcgaactcctgggctcaagcgatccttcagcctcagcctnccaagtagctgntataggcatgccccccccttccgactnatnatctgctatcaatacataatggttncctttggcttatttangaaataacacttttatgcttttgaaaaaaaaaaaaaaaaaaactcgagcctntanactntgtg

SEQ ID NO: 2681 - DNA, 790 bp, Homo sapiens
  misc_feature (1)...(790): n = A,T,C or G
tttnnnnttttaaattatcagcttttgttctttttgcaggatcccatcgattcgtggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttccattgtcaaagaaagcaaaatttgattcataataatggcaacggcctangatcagtacctgttgaaaaaaactggttctccacccctcccccatacaaaatccacaaaaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttntnagggaaggaaatggaaacaaaaagccaacagggcaggggttttgtaaagtggaactcttggattgactggtcagttgctacaatcaaaatatgctttcttggaccatgtttgagactcaaaanaatgggccttctgncataattctttacttagtcaagaatgccacagtttcttttgtntaaaaaacctgnctttnaaat

SEQ ID NO: 2682 - DNA, 709 bp, Homo sapiens
  misc_feature (1)...(709): n = A,T,C or G
cagcncttgctctttgtgcaggatccctcgattcgcccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtaagtatcacgctggtatggagggattc

SEQ ID NO: 2683 - DNA, 780 bp, Homo sapiens
  misc_feature (1)...(780): n = A,T,C or G
tatatttatacanctcttgttctttttgcaggatcccatcgattcgatacactgcatttgctggtgctgtttttatatagtgaagcaacagctgtcagcaaaataataaaatactcacttcttcgttaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaangatgtacatttgcaatgtttgtcatgtcagacaaaacaaaaatatgtaaatatccatcaatangggaactgctggaaaaatttttttgtntaatcataaaatgaaacatgccgatgtttaaaccaatggagctagatctcaacgtgctgatattggaaatgcttcaaaatgtnttaanggacataaaata

SEQ ID NO: 2684 - DNA, 777 bp, Homo sapiens
  misc_feature (1)...(777): n = A,T,C or G
ttnnnnntttaatnnnatacagctcttgttctttttgcaggatcccatcgattcgaattcggcacgaggggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacangcataagaaattataaaaagtattaatttggggaactaataaatgtccatgaaaccttcacaatccatgtttttctgccatggcttcaaccagtccccccgtttggggtcctgacttnctgcaacaatgtcctgcaggaaaagtttttctttatatccagtttttacatgatgaatatttccaatattcatagttatgangctgaatnctcttgaatttatnaa

SEQ ID NO: 2685 - DNA, 775 bp, Homo sapiens
  misc_feature (1)...(775): n = A,T,C or G
tattttatcanctctgttctttttgcaggatccctcgattcgtttaaggaaaaccagcaaataacaagaaaaccatttaatgtaaagatttgtaaataatcacttcaaaagaagtgccttgttgctgtcacatttagtccatcttcatataattcttatctgggccagtttcttgggcatgggacatgtgcagttacacaagcctgtgctcttaagagggtcttacccatagtttaatgttctgctgttgtagtcttgaaattcttaatgatttaacaaggggtcctccattttcattttgcactgggccctgcaaattacatagcccatcctgatttctacaactatagaatagcacaatgggaattccatatggattaataatatgtgacacttacggctttttctatacgcttccaagtacttcatataaattacttcatttcattcaatggtagaattggtagatgcttaacttttaatgaaagacaaagtcagattcactctaaggattaaaaaatatatgtaacattacattttaaagattttcaaaaacaatttgttgtggaaatgaattattgncatgagatattncccactagacggacttcctgtanggtcangggtcctggtcttctgtanggatgaaccaagcttttcttgaanggccangtgctaagtgtctcaagctttgtctgttaaggactacccactctgctggtgtagcaaggaacacanctggttgcagccagatnctcaaatgancaagcctntt

SEQ ID NO: 2686 - DNA, 899 bp, Homo sapiens
  misc_feature (1)...(899): n = A,T,C or G
taaatttatacaactncttgttctttttgcaggatcccatcgattcgttcaagcccccagcctacgaggatgtggttcaccgcccaggcacaccaccccccccttatactgtggccccaggccgccccttgactgcttncagtgaacaaacctgctgttcctcctcatccagctgccctgcccactttgaaggaacaaatgtggaaggtgtttcctcccaccagagtgccccccctcatcaggagggtgagcccggggcaggggngacccctgcctncacacccccctcctgccgntatcgccgtttaactggcgactccggtattgagctctgcccttgtcctgcctccggtgagggtgagccagtcaaggaggtgagggttagtgccaccctgccagatctggaggactactcccgtgtgccttacccccanagtntgtaccgcanatctttcccatggggctgtcttncagtgaaaggggacatnccataatagttttganagggtggatgggttactttgcccaccaaaaacagcccttagtnccaacttccttgcgtttccttttggcccctcccttgccttaccttaaaaaattttgccttgaaaaagggctttgggaaaanggggcaaanaatttggggggggaacttggtgcntaancctttttaaccccccccgcnngggaacaattacaaccangggaancccttttggnatccttccantttaaaaanaaaaatgtttggaaaccccaaaaaaaaaaaaaaaaaaaaaaaaaaaaaacnttcggagncccctttttaaaaaacntttttagggggggggcccnttnntttaacctttaaaaatncccccnnccttggntttnggnaanccccttttggttggaagttt

SEQ ID NO: 2687 - DNA, 794 bp, Homo sapiens
  misc_feature (1)...(794): n = A,T,C or G
nnntttnnnnnntttaatatttatacacctcttgttctttttgcaggatcccatcgattcgaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtcattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctnaaaaaatgttctttgccttttctaaatactgcacaaaagtgggncatgtcgacatttgtncacccaccctcn

SEQ ID NO: 2688 - DNA, 775 bp, Homo sapiens
  misc_feature (1)...(775): n = A,T,C or G
ttnannttttaaaccctttgtnctttttgcaccatcccatcgattcgaattcggcacgagagtatgagaagggaggatgggggagaatctgattaaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgntgggtttttctttctttttttttttttttcctctgngcatcctanaaaaactcccaggactagacttaggaggaggcaatcaagttatgtggtaaaacaagagtgccttttctgttggatatccactttagtttcctggcttccagggcataagatgtttanaaactttttttctctaaacataagaattattgtgtccacaattttgaaccaccgatttccatatcttcagcagctatcaacttgccaattccctttgggtctcctttgnatattcttatgtttccttctgnttccaggtgcctcaaaaagagttgaggggggcatgactcttataaaatggataaaaatgaactgtacagatgtttgcctccttgttctgtgagcatgactctatcangctggaaaancgctttatcattttggatatttgaccattttggattcagcattacttgactccttatgtgcnttggcaatgtt

SEQ ID NO: 2689 - DNA, 1157 bp, Homo sapiens
  misc_feature (1)...(1157): n = A,T,C or G
nttncctnngnaaaaaacccnccnttttaaaantttcaaaattccccccccnttttttttggaacccccccnttttgncnaaggaaaaaacccccaanncagnaacttnttttaaatntacgggggaccacaggnaggccaggcaccctgtcccaaatgccccggnacntttttatttaaccacccaaacaagaaaacngagaantacgccaccccgggnannggccaaaaggnagnaaggngggaacaagcntnaccntgtgnctngcaacanacangngtggcnngaaancanccaggactcnccggtacatcaaatcgcccannnggcgcncnncatgttcttaaccanccggaataggggacaatcaattggttgncntttgngcctgccgaaaagctagctggnnanatctgccnggttaaataagccccnttaaacggaagggcanangggggnaacnnaanaaggtnangccattcccgcccaccggaatgaagnaatggggaancccgccttggngggggnaagtcangcanaaacggcttgacgnaaaaacaaanccattcncccccaanttnngtnaanggnncccaangaaatncnnccacgngcnaagnccccccngggcnaatgnncccaaatcccctcccatttnnatnttatgnaaaccacctttngggggaaaaaaaaaaaaagnccntttnttngaaaggaaagggttgccccattgggctatgggaaggngnncnnccccaaattanaaaanttnngggnganaaaaaannngggcnnccccgntttgggggncgnctttgggcaaaccaccccccgtgcccccaaaaangcccaatgggtantccctaaaaaaaaaagttcccccntttngtgggaaaaancccccgggagagggccccgngtttcaaagggggaanaatcccaaaaaaaaccnaatcctanaanggccaaanggnggtntncctnaaannnnggnaatngncaaaaggnnggngaannaaaccnttgggganggcngaatttnccccctggaaaaacccgggggggnncccctcnccgnaananaaaaaaaaccnnttcaaaccnngggggccntcncggggtgcccggaacncnttttgaaaagatccacnncccg

SEQ ID NO: 2690 - DNA, 769 bp, Homo sapiens; identical to SEQ ID NO: 2673
  misc_feature (1)...(769): n = A,T,C or G

SEQ ID NO: 2691 - DNA, 776 bp, Homo sapiens
  misc_feature (1)...(776): n = A,T,C or G
tattttatacagctnttgttcttttgcaggatccctcgattcgaattcggcacgaggccaggtgtcattgcacatgcctgcagtcctggctactagggaggctgaggcaggagaattttttgcacccagaagttcaaggctgcagtgagctatgatcacaccatggcactccagcctgggcaatagaatgagacccagtctctaaaaaagtagaagttaaaaaaaaagattaagaatagatgtagggcagcagaatttcgaacttcttttcagcatcacaatactttaaaacagtgattgtcatctgcctcaaacccattgcctctcacataggaaatattttgaaacatattttttagtaccttgaaatgaaattcatgataattaacccatctacacacatttttaaaaatcaatatagggccctaacagcaatataaaggggaaataaaaagaaactaattgtaataaaataatattgatttcaataagtacattctagcccagtgcttataaattttaatgtgcatatgaatcatccagcattcttattaaatgcagattctagttcagtagattttggttcagtaggtaagccctgagatttggcatttctagcagctnctagatgatgcccacactgctgtttagtaaagagcatactttgagtagtaanggccgaaaagtataaaaaaaaaaaaaaaaaaaaaaactcggcctctanactataggagtcgtnttacgtanatccngactgataagatcattggtgagtt

SEQ ID NO: 2692 - DNA, 774 bp, Homo sapiens
  misc_feature (1)...(774): n = A,T,C or G
tatnnatacaactttttgttctttttgcaggatcccatcgattcgcagctctgcacccagctgcttctccagggagccctccctcactggagactgggatttagcaaccaagacctgggcactggctgtgcttgttgcttctgggccctcctgggacagagctgggaagtggatctatgacacgtgcttgtgcatttacccgccctgttggtttctgtagctgtctagttcctgctgttcctgtctcacctgcccctttccttatgtgtagtttcttcctgtgacagggagaaacctggctctcagattgacaggacattcgcttaggccatgtcagtgctgtaggtgaactgttcaacctgtgccccagggaggcgcagtcactatggaggcaccttacttccttaatcgtgtactggtgtttttgtgtttgacctgtagcatctaagtactggtttcaaaagttgcctagatgagttcttttctttctttcacctcctgcaaattatgtgatttgcataatttgtacataagttaggttcatttgttagtttgtattccttttggcttcccccatatcctcgttgactttttctttcttttgtaacttacatatgttatgaaattatatgaggatatataatttcataaatgtttatgggttacatgtattaattggtattattaaaancaccctgggattgactggccaaccatttggtggaagatagcaataaataatacatcataaaagactttaatgtaaaaataaan

SEQ ID NO: 2693 - DNA, 816 bp, Homo sapiens
  misc_feature (1)...(816): n = A,T,C or G
nnntttantatntntacagctntcggctnttgcacgatcncatgatcccatnnattnngnttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagaatgtgaccttatttggaaatactgnggttgtggttgtaagtagctaagatgangtcatactggagcagggcaggcccttaatccaatatgactggtgttccttataaaaaaaagataanggcgggcatggnnggctcacgcctgtaatcccagcactgtgggaggccaagccaggcaaatcgcttgaggctgaggagttcaagaccagcctggcccaacatggcgaaaacccatctcttctaaaaataaaattagccatgccgtggtgcttgtaatgtcagctaccccaagaatctgangcacaaagaatcacttcgaacctgggaagnggaggttgccanaaccccaccactggcactncagtgtggagcaacaaaaccgagactcttgtcttcaaaaaaaaananannaaannnnnnnnnnancctcgnancctttaaaactttagggaggccgtntttacgtanatcccaaacatggat

SEQ ID NO: 2694 - DNA, 786 bp, Homo sapiens
  misc_feature (1)...(786): n = A,T,C or G
ttattttatacagctnttgttctttttgcaggatccctcgattcgaattcggcacgaggatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaattgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggccgaaatctggatggccttctgcatttcagaagccaaaaggacgattgccatatgaacttcaggactatgttgaagatacatcggaatacctagctcctcangaaggaaattttgtttataagttatttagcctgcaagacctgttgttactcgtacgctgcagtgtccagaggatagagacaagaccacgttctaaaaaaccggaagaaaatcagaagacaatttncagtttatgtnctacccaaagtagagtatcaagcttggttntggagtttgaagctcttgactgaaagtggactttgtcgcttatngactggaaagtttattgctttccaccagctcattttatgtttgggcatatcgatgccntt

SEQ ID NO: 2695 - DNA, 786 bp, Homo sapiens; identical to SEQ ID NO: 2694
  misc_feature (1)...(786): n = A,T,C or G

SEQ ID NO: 2696 - DNA, 780 bp, Homo sapiens
  misc_feature (1)...(780): n = A,T,C or G
ttnctngttctttttgcaggatcccatcgattcgcgccggtagcggctgggtctggagccggccgagggagacggtcggcagccacagtggcggcttggggcggatggggcggcccggccgcgggcctggtaacattcttgcttgcaacttgcggcagggccaacttgaccggccgggccctggtccggccgggtgcaagttcaattgagaacttttttgacggaagaggggaccaaaccattccaagtgggagtggaattcctcagctgcttcctcaagctgcacaccaccagccaccttcacagtgactttgttgagtgtcaaaacatctcaaggaaatttctcctcttctctncatggaggctatggcattggtactgaagagaggaaacttacccaagaaaccacttatncaaatacttacatttttgacttgtttggangtgttgatcttcttgtagaaattcttatgangcctacgatctctatncggggacagaaactgaaaataagtgatgaaatgtncaaggactgcttgagtatcctggataatacctgtgtctgtcaganggagttacaaagcgtttggcagaaaagaatgactttgtgatcttnctggttacattgatgaccaagtaaagaagacattnttacaaacagnaacccttcattgaagatattttgggtgttnaaaanggaaatgatccgactngatgaagtccccaatctgagtccttaanttccaattcgatcaanaacaantcgcttaatttttgccg

SEQ ID NO: 2697 - DNA, 794 bp, Homo sapiens; identical to SEQ ID NO: 2687
  misc_feature (1)...(794): n = A,T,C or G

SEQ ID NO: 2698 - DNA, 696 bp, Homo sapiens
  misc_feature (1)...(696): n = A,T,C or G
aaatngcnaggctacttgttctttttgcaggatcccatcgattcgaattcggcacgagaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctncagtcctgattactgtacacagtagctttagatggcgtggacgtgaataaatgcaacttatgttttaaaaaaaaaaannnnnnnnnnnnnnnnnnnnnnnnnnnat

SEQ ID NO: 2699 - DNA, 708 bp, Homo sapiens
  misc_feature (1)...(708): n = A,T,C or G
ttagccttgnnttttgcngatccctcgattcgaattcggcacgagaaaaacctgggtatgtatctagaagtggaaaaacaaaaaaaggaaataagttatgaaaataaaaaccatgtcttgagctgggtgcgctggtgtgtgcctatatccctagattctcaagaggttgagacaggaggatcacttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcaggagaatcgcttgaattttgggaggcggaggttacagtgaacccacatggcgccactgcactccagcttgggtgatagatgagactctatctcaaaanaaaaanaanaaaaactcgagcctntagaactatagtgagtctattacgtagatccagacattgataagatncattgatgagtttggacaaaccacnactnggaatgcagngaaaaaaaatgctttttt

SEQ ID NO: 2700 - DNA, 772 bp, Homo sapiens
  misc_feature (1)...(772): n = A,T,C or G
tnctaannccggctatngttctttttgcaggatcccatcgattcgaattcggcacgaggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaaagtaggcaattctttgtatattttaaggcaaataatcacttcaccttctggtgccttcc

SEQ ID NO: 2701 - DNA, 777 bp, Homo sapiens
  misc_feature (1)...(777): n = A,T,C or G
ttaacntncagctacttgttctttttgcagggatcccatcgattcgctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaacagaggtttttagtttctttaaagggttgtaaacataaaaacaaagaaggatacaacatgcaaggcctaaaatgtttactttctggccttttacacaggcagttcgccagccccctaccctacagtatggaaaaaaggcatagaacagtcaaatcacgtaggatttcttggtttctccatgcaggctcatcgaatagcaaccatcctttcttagtttcttgaaacaagtaccttatttacattcagagaattatatgtggacaaacagctcataagcccgtacttttacatactcacttcctgaattgcatattgaaaaagagagttcatgtaaagccgattattatttaatctaaagttatgttcacataggaagcactagtgtagagaaatagggtctganggacaaggagcctgtgtgcccgtgtcgg

SEQ ID NO: 2702 - DNA, 777 bp, Homo sapiens; identical to SEQ ID NO: 2701
  misc_feature (1)...(777): n = A,T,C or G

SEQ ID NO: 2703 - DNA, 786 bp, Homo sapiens
  misc_feature (1)...(786): n = A,T,C or G
cctaancgcttggctactcgnnctctctgcaggcatcccatgcgattcgggtagttaagcccccccaaaacaagacggnaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaangtgcaccgaaggtnaaaaagtattttttcangttgtanataatttatttaatatttaatggaaagtgtatttattttaccanctcattaaacnttttttaaaccaaaanaanacnntctnnnnnnntccc

SEQ ID NO: 2704 - DNA, 741 bp, Homo sapiens
  misc_feature (1)...(741): n = A,T,C or G
gngaggnnnntttnnaanatcagctacttgttctttttgcaggatccctcgattngaattcggcacgagatttgaggacctcagacatttttaaaaatgtaaagggggtggggtcaggctcagtggctcgtgcctgtaatcccagcattttggagggccgaggcgaacggatcacttgaggccaggagtttgaggctagtctggtcagcatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatncttgccagtcttcatttgcctaattttgccattctcataatgtggcaattgtcaa

SEQ ID NO: 2705 - DNA, 709 bp, Homo sapiens
  misc_feature (1)...(709): n = A,T,C or G
ttnaaatcgctnggctactngttctttttgcaggatcccatcgattcgaattcggcacgaggtaagttatttgttaagttagaaccctcagtgcatggtctagggatctctggaggtccccaggaccctttcagagaagccatgaggtcaaaactgttttcataagcagaaccaaaacattatttgactttttcaatgcattggcatttgcattgatggtacaaaagcaaggatgagtaaaatgggtgattccttagcgtgatcaagatggtagtaattgtactagtagtcattgtattcttcactgccacaattttttttaaaactaccaattttaattaagaatgttagtcacagttgtttaaaagctcagaactcccattaaaaaaaaatttaaaaaagaatgtctttggtaaagcagcaaaaactggatgaattttattaactctagagccttgagtaaacatcttttcaggattttgtgtgttgaaatagaaagtatgggccaggtgcagtagctcatacctgtaatcctagcactttgggaggctgacgtgagtggatcgcttgagcctaggagttccagaccagcctgggtaacatagtgaaaaccctgtctctacaaaaaatacaaaaaaattagctgggtgtngtggtgtgcacctggtggtgtcagctactttgggaagcttgaaggcaanaaaggant

SEQ ID NO: 2706 - DNA, 744 bp, Homo sapiens
  misc_feature (1)...(744): n = A,T,C or G
gagaggnnttctaatncnngctacttgttctttttgcnggatccctcgattcgaattcggcacgaggtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagatgtttgtgctttcaacatttcatttgaaatgggagaagataaaatcacttgatgtacctggaaactatgctttacatggcaatcaaagccttt

SEQ ID NO: 2707 - DNA, 699 bp, Homo sapiens
  misc_feature (1)...(699): n = A,T,C or G
naatcgctaggctcttgttctttttgcaggatcccatcgattcgaattcggcacgagctatgatcaggactgactaggtagttggcatggcccatagagaacaaggaaagatgggctggtggattggcccacctgggagccacatggggcaaggggagccctcaccctcagccagccagacgagtgggatttcccccagcacagcatacccccttcacaaagggacaactaaagtgcttcattaagcaagtcctggatcctgtgccccccaactgggtgagacaccccaatgggtcaccagacaccttatacaagagcatttctactggcatcaggtgggtgcccctcaaggacagagatcccagaggaaggagtggggtctcatctttgctgttctccagcactctctggtgacatcttcaggtgtgggagggacccagataagtagggcttgaagtgaatccccagcaaactgcagcagccctacagaagaggtgcctgactgttcaaaggaaaacagaaagcaacaacaacatcaaccaaaaagtccccacgaaaacctcatctaaaggtcagcagcctcaaagatcaaaatgagacaaactcatgaagatgagaaaggaatgaaaaacccctcacaactcaaaaggccagantggcttgtttactccaaatgatcacaacacctctacagcaagg

SEQ ID NO: 2708 - DNA, 692 bp, Homo sapiens
  misc_feature (1)...(692): n = A,T,C or G
tacangctacttgttctttttgcaggatcccatcgattcgaattcggcacgagagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaatgtgtttttaaatttccaaatgtttanggattttcatatctttcttatgctgatttccaa

SEQ ID NO: 2709 - DNA, 719 bp, Homo sapiens
  misc_feature (1)...(719): n = A,T,C or G
gcnnnnnntnnnnttgcnaatcgctaggctacttgttctttttgcaggatcccatcgattcgaattcggcacgagttttttctaatccaaacgcacttctctttattcaaaccagggtcaaactggtcaatgggaaacgccctgaagccacgtgcctggggagaaaggcttcctactcggttcggttcagcgctgcgtgggatccacgcggctggctgtgcgcaacccccacagttcacctcagacactaccaagcaggtcagtcgacaaaagcaaggaattaaacaaaaaacagaaatacactcagtagatttcttctagaagctcccagagtttctggaccaccaagtcccaacccccaaagccaggagcgaggggactaacagcgcaccccctccaccagtgccgacggaaaccccgttttaaattaaaaaataagccagtatacatcgtagaaaatttctcttaaaaatctcacaatttgtaaatgtatattttttctttaacataaaagtttacaatataccgtaaaacaaaaggctcaggaaaataatttccaaaaaaaaggaagaaaaagaaacctgaagttttgaattaaagctgaagacatttttttaaaaccctgttgttgaaccagtgacttttttttattgngctgatgggttagagaaagaaatatttaaaaacaaananannnnnnannnnnnnnnnnnnnnnaa

SEQ ID NO: 2710 - DNA, 715 bp, Homo sapiens
  misc_feature (1)...(715): n = A,T,C or G
gncnntnttnacttccnaatcgcttggctactcgtnctctatgcaggatcccatcgattcngacagactcgtctnatcagagatggggagaangtcgaagcctatcantggagtgttagtgaanggaggnggataaaaattggngatgtngttggctcatcnggtgctaatcancnnacatctgnaaaagtnntatntgaagggananaatttgattatgtnttctcaattgntgttaatgancgtggaccatcatataanttgccatataataccagtgntgaccctnnnttanctgcctaccactnnttacagancnntnanntgaatccnntgttnnnngntcaactncnttaantcatnantggtnacacataaggtnatangntggnactngagaatnccagnttnncagatccatttacangcngtnncacggnatgtcacnnctctnctngatctnntgacncactgcccacngctgatcctttnncaantgctgnanngnatgtaccacattctgaatgtatcnnaactncnatnncctgataancatccatntcagggaanattgcctcccnatcngnatgcntntaaaacaatgaatcttgggcccctnatanctaggctgncacattatgaccangcttaccctacaccaatattangtaaactgaaatgaactttatggaactgnnntnntagcacaantttc

SEQ ID NO: 2711 - DNA, 721 bp, Homo sapiens
  misc_feature (1)...(721): n = A,T,C or G
ttnaagcctntnttnantttcaaatcgctaggctacttgttctttttgcaggatcccatcgattcgaattcggcacgagaggaggaaagggaactccctgaccccttgtgcttcccaagtgaggcaatgcctcgccctgcttcggctcgcgcacggtgcgcgcacccactggcctgcgcccactgtctggcactcgctagtgagatgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagcatgcccccatcctgtgccgataagaactccanaccccaaactcagctcatacacacacggaagagagaagcatctgaacatcaagaagagaanaagctgctggacatcagaaactgtgaaaggagaggagtttggctgagctccaggggaagactgcctgcacattctatccccttttcagttccccatcctgctgtcagccacatttaccactcaataaaatcttcacattcaccatccttcaaaaaaaaaaaangaaaaaactcgagcctctagaactatagtgagtccgat

SEQ ID NO: 2712 - DNA, 711 bp, Homo sapiens
  misc_feature (1)...(711): n = A,T,C or G
gcngntnttnantttcaaatcgctnggctacttgttctttttgcaggatcccatcgattcgaattcggcacgaggataaatacctcagcccctcgccttcctcaacccacctggcaagtcttcttaggatctgatcccagttttctggaagcaatcctaccccagcccaagcttcccagagtcgagccttaatccttctcacttctcagtgtcagagcagaaatgaatcctggggttgactgtgtccattcgggttattagcagctaagaagcccagacgagtagtgtgagctgccttgggagcctcagtgagggcactgggactggcctcactctcttgcccccagcctagtgggctttctcctctgtctctccggtggccccaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctnctgtctacctggatgtcctgggctagggggccggccaggggctgggagtggttagcccggaatactggggcctgccttagcatcccccatagcttccacagccccagggtgatctcaaagtatctaattcaccttaacatgtgggaagggacaggtggggcttgg

SEQ ID NO: 2713 - DNA, 771 bp, Homo sapiens
  misc_feature (1)...(771): n = A,T,C or G
nttnaacatacangctacttgttctttttgcaggatcccatcgattcgaattcggcacgaggtgaaagagttcatgacctccttgcgccgggcctggtgctctgcgatcaagggctgcagaaccagncccngngcntggtggncntgacctcttacannncgtgccgtattcnaatcgttggtatcctgctcaaggactgtagctcntntacganaangntnacnnacntgatagacacgtccacatcacanttgcccccaaactgcctgtgctcctcnatggtgtctctccctccagaaaacgcatgcttattgaccttggttttgatctgcttggccgtgtcggtgaggaagatggaggagttggggtcgctggcactcattttggtctgggcgccctgcanggctgggaagaaggtggagtgcacatgggataaggcactggatatccgtcctgtctcggaagatctgtgggaatgagttgctgaaggagggagcancctgnatggcangaaaactgatcttcccaatgcantcgctgtcantgaagccgaaaatgcctttcacttggttgaaggtaacatgcttttgaatcttcaccacatttttgtanaaacctgaactgctctanaactatantgagtcntattacntanatccanacatgataagatacattgatgaatttggacaaaccacaactagaatgcantgaaaaaaatgctttatttgtgaaatttgtgatgctattgctttatttgtaaccattac

SEQ ID NO: 2714 - DNA, 752 bp, Homo sapiens
  misc_feature (1)...(752): n = A,T,C or G
gngagnnnnntttttaanatcagctacttgttcttttngcaggatccctcgattcgctcaaaaccaaatctcaactcagctacagaatctactgtggtccttgtctgaaaaaattagttcactcggttggaatcttgtctcagagcatcctcatctctttctcaaaagcccctaccccaacaccggcgtgttggttgtctattgaaacttacaagtggatggaccctttctcccgaataaactggcctttgaaagctctaatcgaaatggtttggcaaaatccatactgcaggagattagggaggacaagaatgatgtgcctttttgtactgctgagcctgatggtggtgccactacttcaggtacttagatgagtcttgatgctaatagaattgtgtcgccaaacatatctggacagttacaacctaatctatgcattaattggtttgggaattgcttgaaattattgnttaattcaatgttttaattcgttttcctaaaaatttaagtgcccccatcatcgtgcaatacctcagtgcagcaactccttgattcttggatgactgaacttnctaacttgactctgcccattggtcccatttttcatgtttttcacaaatagttaaccaggtacctactactgtgcaccgctgcagaagcattgaaggatgtatgtgatgagtnaaaacacccaacctgctctgctgngttaggattatgacngaaactggtcaaaatcacatgtgaacaaa

SEQ ID NO: 2715 - DNA, 742 bp, Homo sapiens; identical to SEQ ID NO: 2617
  misc_feature (1)...(742): n = A,T,C or G

SEQ ID NO: 2716 - DNA, 742 bp, Homo sapiens; identical to SEQ ID NO: 2617
  misc_feature (1)...(742): n = A,T,C or G

SEQ ID NO: 2717 - DNA, 733 bp, Homo sapiens
  misc_feature (1)...(733): n = A,T,C or G
gnnngnnnnnnnnnnggnngntttntagatanagctcttgttctttttgcaggatcccatcgattcgaattcggcacgaggccntcctgtnnacagcgnggcaagangaatcatnntgnctgngcattttgcnctncttatctgggnntatantgtacatnnaggacagaccactcctaattgacaacatctannctntntggatgtnaaagangttgccagngtatnacaaangtnganntagnanactaatntnttttgtacattntggnttacaagtcctaggaaanattggcttctgaaaatttgatgnctnntgggttgatggagatggnaagggntctangccagaatgntcacatttggaagactctntcnaattntnactgtnggtacatgtttgcanntatattcaanactgctgtntacatagtagacaaatnaactccttacttgaaacatctagtctatctagatgtntagaagtgccccatgnatgctaaatgtatacgtagtgaaataccactttgnnaatatctctttgctaaaattcatncgaaatgcttttggaaattgantngnnaanncacctttgtnaacagnntantgntgnntatccttgnncaatatnttaaaggacgtaagganggaagaaattgcaaaaagggatatcctancgtgngcatacttgggcatttcagacccttgttctatatgntngggcatctgggtt

SEQ ID NO: 2718 - DNA, 733 bp, Homo sapiens; identical to SEQ ID NO: 2717
  misc_feature (1)...(733): n = A,T,C or G

SEQ ID NO: 2719 - DNA, 749 bp, Homo sapiens
  misc_feature (1)...(749): n = A,T,C or G
nnngnnnnnnnnnngnnngnnnnnnnnngnnnnnntntttagatcagctcttgttctttttgcaggatcccatcgattcgaattcggcacgagctcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaaggtgaatgaaataatggccatggatatattgntattgttctgatatgaaacaaagaatttagagtttcatgaagttatacgtgctctgtccccacaattctgattcagaccaaaatgtgttaagcttaatagcctttttacaagtttgctttaataaatttgaagatgaaggcaaaaaaaaaaaannnnnnnnnnnnnnnnnnnnnnnnnnnnnnnnnnnnnnnnnnanaaaaaaaaaacctngnccctttaaactttnggnngcntttncntaannccnnacttgaaaaancn

SEQ ID NO: 2720 - DNA, 768 bp, Homo sapiens
acatacagctacttgttctttttgcaggatcccatcgattcgagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatcaaagacaacccatcaatatcaggagcctgagcatgagttaaagcatgtggatggcctggaactatgtttttaaaatggtattaaatattggttttttactt

SEQ ID NO: 2721 - DNA, 735 bp, Homo sapiens
  misc_feature (1)...(735): n = A,T,C or G
gagaggnnnttttgaagncngctngnngncttttngannagttntcgtcngcangatgnacacacggagacagatactgtggaccccanaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttcagtcttgcgaggacagcctcatagagaatgagattcaccagtaaggggagggaggggccctggaggccacatcctgccccaccccacccccactcccacngacactaaaacgctaataatttattanatctaaagccccttctncccagcccctgctttcattaaggtatttaaacttgggggtttcactgctctccccccatgatggaaggagggagccccccaacctcagtgagganagccccgagccggccccggggcaaagaggggtgcagagggagttccccanatcaagtcccccaacccttcccactagtacatgaccagganagggttaatgataccaacaagagtcctggtgcacctggtgccggtggctggagacctggggggcangtggatctggggctgatcccccctccgttttttcacccacatttctctgggatttgc

SEQ ID NO: 2722 - DNA, 716 bp, Homo sapiens
  misc_feature (1)...(716): n = A,T,C or G
tnnnnntttttnaaccagnnttcnaatccttggcgnnaggctacttgttctttttgcaggatcccatcgattcgaattcggcacgagaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgnnnnncnnnnnnnnnnnnnnnnngnnncnnnnnnngnnnnnnnnnnntnnnnnnnngnnnnnnnnnnnnnnnnnnnnnnnnnnnnc

SEQ ID NO: 2723 - DNA, 751 bp, Homo sapiens
  misc_feature (1)...(751): n = A,T,C or G
gagaggnnttttanagcctgctacttgttctttttgcngatcatcgattcgaattcggcacgagaaatacctcaggaaaaacgaggaggtgaagtattggattcttctcatgatgacataaaacttgaaaaaagtaatattttgctgcttggaccaactgggtcaggtaaaactctgctggcacaaaccctanctaaatgccttgatgtcccttttgctatctgtgactgtacaactttgactcacgctggatatgtacgcgaagatattgaatctgtgattgcaaaactactccaagatgccaattataatgtggaaaaagcacaacaaggaattgtctttctggatgaagtagataagattggcagtgtgccaggcattcatcaattacgggatgtangtggagaaggcgttcatcaaggcttattaaaactacttgaaggcacaatagtcaatgttccagaaaagaattcccgaaagctccgtggagaaacagttcaagttgatacaacanacatactgtttgtggcatctggtgctttcaatgggttacacagaatcatcancaggaggaaaaatgaaaagtatctttggatttggaacaccatctaatctggggaaaaggcagaagggctgcagcttgctgnagaccttgnttaatcnaaagtggggaatccaatacttacccaagacattgaanaaaaagatcgggtntgcgtcatgtggaaaccngagatctgattgagtttgg

SEQ ID NO: 2724 - DNA, 749 bp, Homo sapiens
  misc_feature (1)...(749): n = A,T,C or G
gngagnnnnntttanaanatcaggctacttgttctttttgcaggatccctcgattcgtaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtnattgtttctctcactgnttatacgttattcatgattgatggctactataatgtcctctgggaaaagcttgacgattatgtctactacgttcgttcaacaggcagtattattgaatttatatttggagttgtaatggttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgnaataaaagggagcccgcttacaagaaataaatgaaggtatgtgcaatctgctatcatgagtttacaacatctgctcgtattacaccgtgtaatcattatttccatgccc

SEQ ID NO: 2725 - DNA, 746 bp, Homo sapiens
  misc_feature (1)...(746): n = A,T,C or G
gagnnnnttttaataacagctacttgttctttttgcggatccctcgattcgaattcggcacgagcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtgggtagaaagtgtgttcaggctgacactggcaatgagtacagataatttcactttcctcttcaggggcaaaggctgatggcctctacctttgtatccaggagaaactgcagagcagccctgtgactttacaaaatatgctacctcaaagtgctacccgataaacctttctaattgtaagtgcccttactaagggcacatgtcttaatcaaagttagttttttgttttctggtttgntttttttttttgnatattgatgaatgagatcttacctattaaatatattattggattatgggtcctgaaggtcattaaaagtttgagtgtgtgtgtgtgtgtgtgtgtgtgtgtgtgtgtttatgacttaaatatctttacgtgnggtttttaaaacttgggt

SEQ ID NO: 2726 - DNA, 967 bp, Homo sapiens
  misc_feature (1)...(967): n = A,T,C or G
agtanggcgnttcctaatnnannnggctaagcgactttnaaagangaggctngcgtgntgaataccgnncgaggggggatnacaatagtanacnnggtnccaatncatgcttaacaccgcatntctttaccccccnannnncacanatgcagacncacacatngcanncgnacacncagacacacacangcaagcactnncatgcatggcccatgctcacacacntgnannnaacatgcngtagacatntnagacacgtcatgtnacacatgnnacacangnnnaanacactgctttncangcanacncagacggcacnnngagacanacatgcnnaaacaacatgctcnctcacntnnanncgntgggccngtagtagtgtactgtgggtgnnactgggtgccatcnacnnngtattttacgnnctttnaactaaaaancttggagccttnanttnntntggtgantncaatncctanaantnncttgagngggatgaaccctaanancctggccctnntnccnctttcaaggccnagnaattganattattncntantngnncacgaagcttntggtancangngncccgagnnctnttnaaanttnnctnttttnanaatnaaacattttancggttctnagganccgngcctncngggtanggannnaattgtncctgggnatagttctcacaantnatnttnaaggggnnaagngatnngngnggnccntntatgnggcnngccaannaanggggtcgnngttaanatattccaagntaacanangnacnatggnaccnatccctntnngaagnaaggaactncctgnncgactannnactatgnnaaatattctcacatntacanaaaaagnaggnnccnnggtncttnaagnttntgcatagnnactatncntgggacgngttaacnnanattntatgctttannngatnggggcttnnn

SEQ ID NO: 2727 - DNA, 967 bp, Homo sapiens; identical to SEQ ID NO: 2726
  misc_feature (1)...(967): n = A,T,C or G

SEQ ID NO: 2728 - DNA, 738 bp, Homo sapiens
  misc_feature (1)...(738): n = A,T,C or G
gagagnnntttntaatnncagctcttgttctttttgcggtccctcgttcgagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtcccgtgtaggacgctccaaacaagcagctactaaggaaaatgattcaagtgaagaagtagatgtgtttcaagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatctttttttttttttggtcaagcttgagcttgataaagcctttgatgcacaaaatgggctgctgaaaatggacagttggncttactttggtgcccctactttgtggcacatctttaccatcac

SEQ ID NO: 2729 - DNA, 747 bp, Homo sapiens
  misc_feature (1)...(747): n = A,T,C or G
gnngnngnnnnnnnnnnngnnnnnnnnnnnnngnnngnntttatgnatcagctacttgttctttttgcaggatcccatcgattcgctccattgtgaagatccaggcatttttccgagccaggaaagcccaagatgactacaggatattagtgcatgcaccccaccctcctctcagtgtggtacgcagatttgcccatctcttgaatcaaagccagcaagacttctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcattntnnnttttttttttttgactcaaagagagttctcattttccctattcaaactaatacccatgccgggttttttaccttggatttaaagtcaccttangttggggcaacagattctcactcatgtttaananctggtatttcagcttcataagatcaaagaggagtctttccctttctcttttaccctcaggatctcatcccttacagctgactcttncaggcaatttccatagaactgnagtcctgctttggcacaagctntntgtg

SEQ ID NO: 2730 - DNA, 716 bp, Homo sapiens
  misc_feature (1)...(716): n = A,T,C or G
ttnattaatgcttggctactcgttctttntgcaggatccctcgattcgaattcggcacgaggtcctaaagccgctgaagcaaaaaccatgataaaacattctgctttcttttcttttacaaccccacgaacgcaaaaaaaaaaaaaaacaaaaacaaaacaaaaaaaagaaacaacaacaaaacccaaactatttgtaggaaaaaatggttttgtacatgggatgaaacaatataaattcaaaacttacagataagggttagctctatcactcaactctttaaaaagtttatatgaatatccagtcaaaaccaacacggtattgcccttgaaatgttaactagacggatttccaaggagaccacaggactgtatactgtcttggaatgtcctcagaaggctctgtcattgatcaggtaacagtaaaaaccccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattangccccagcaacacgtcattgtgtaaggaaaaataaaagtgctgccgtaccaaaaaaaaaatnnnngnccnnannncnaanncttngnnt

SEQ ID NO: 2731 - DNA, 731 bp, Homo sapiens
  misc_feature (1)...(731): n = A,T,C or G
tgnnnttttnnagtcaanccttggaaatccttggctctngccgctntctgcaggatcccatcgattngctnngcagctccccttccantgagagccctncacacnatttnanaaaaccntncgnatgcatnaactttcaanccatancatgcatncnggntattgntncatgctgatcatnnaacctnnngtccaacagggcggnncngtaatggntgnttnnttnactttttantntgtggngtatnnnntagnncncgcggngcnggctcannttactggaccttgcanatcctnngattnngcnntgngngnntcnggctcnnacnnacatgngnttacagacatnctggcatgttcatntcnncgtgntntcnctnngtnaananggngnctnancntgntngccaagctgntnnnannctcctgggntacnttnanntnnnatnttgactcataccgttgctgattncaaggcntgagccaccactcctggccaangnngcgttgcttgacattncnactaagactatgactatnatgntnccgtgacgacactatagtcctccnnacttntcngtcaagtggcatctgggattgtntcaacatggataaangggccttctanatatcnnggcgttgancntcatttncctgcnttcctganaatttngngcactgaancttanagggccttattcncncnngancancacncgnngatactancc

SEQ ID NO: 2732 - DNA, 731 bp, Homo sapiens; identical to SEQ ID NO: 2731
  misc_feature (1)...(731): n = A,T,C or G

SEQ ID NO: 2733 - DNA, 750 bp, Homo sapiens
  misc_feature (1)...(750): n = A,T,C or G
ccttnccttgaaagccncaagctacttgntctttttgcaggatcccatcgattcgaattcggcacgagattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtctattaaagcatgaaatgaaaggttgcatatcatgcattcaggntattacctaatttttgnnctgacagtgcatgnctntggaagcatgctgaaacaccgattaacacaggagtcgngtaacacngagaaacatttgatanatgtacagcattggctattgcattcctatagtgtatataccngggtattgcttcaaaccctgcngaccnctattttcccntctncnncccctgtgttctttggtcaaacntaatnnannacatncatttgcnnttgngttnnnaaactttananntcntngatngtgnanntanacnangtaactttttacctaaanggtgtngcctgnccccaaaattgccattatngggnccncntatttccncnantntananttgttcncacattncg

SEQ ID NO: 2734 - DNA, 712 bp, Homo sapiens
  misc_feature (1)...(712): n = A,T,C or G
anttgaanctttctaatgcttggcnntgcaggatcccatcgattcgaattcggcacgagggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccttcacatcacttgacacagctgagctttgttatccatcttcccaaactttctctttctttgtacttcttgtcatccccactc

SEQ ID NO: 2735 - DNA, 710 bp, Homo sapiens
  misc_feature (1)...(710): n = A,T,C or G
nttaancnttnanannngttntttttgcaggatcccatcgattcgaattcggcacgagggcangggacttnctgtaacaatgcatctcatatttggaatgacccagtcctctcccaagtccacacaggggaggtgatagcattgctttcgtgtaaattatgtaatgcaaaatttttttaatcttcgccttaatactttattattnngtnntattttgaatgatgagccttcgtgcccccccttnccccttttttgtcccccaacttgagatgtatgaaggcttttggtctccctgggagtgggtggaggcagccagggcttacctgtacactgacttgagaccagttgaataaaagtgcacaccttaaaaaanaatgcatanaaaaaactcgagcctctagaactatagtgagtcgtattacgtagatccagacatgataagatncatngatgagtttggacaaaccacaactagaatgcagtgaaaaaaatgctttatttgtgaaatttgtgatgctattgctttatttgtaaccattataagctgcaataaacaagttaacaacancaattgcattcattttatgtttcaggttcagggggaggtgtgggaggttttttaattcgnggccgnggcgccaatgcatngngcccggtacccagcttttggtccctttantgagggttaatngcgcgcttggcgtaatcat

SEQ ID NO: 2736 - DNA, 714 bp, Homo sapiens
  misc_feature (1)...(714): n = A,T,C or G
tctaatccngnntttnanttncnaatcgcnaggctacttgttctttttgcaggatcccatcgattcgaattcggcacgagaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccacttttcagatccatttacaggtggtggtcggtatgttccgggctcttcgggatcttctaacacactacccacagcagatccttttacaggtgctggtcgttatgtaccaggttctgcaagtatgggaactccatggccggagttgatccattacagggaatagtgcctaccgatcactgn

SEQ ID NO: 2737 - DNA, 707 bp, Homo sapiens
  misc_feature (1)...(707): n = A,T,C or G
aatntttgctctcgttctttttgcaggatccctcgattcgaattcggcacgaggctatctgaacacagtggaaagatgggaccctcaggctcgccagtggaattttgttgccactatgtctacccctaggagtacagtangtgtggcagtactaagtggaaaactttatgcanttggtggtcgtgatggaagttcttgtctcaaatcagtanaatgttttgatcctcatactaataagtggacactgtgtgcacagatgtcaaaaagganaggtggcgtaggagtgacgacctgnaatggactgctgtatgctataggggggcacgatgctcccgcatccaacttgacttccagactctcagactgtgtggaaagatatgatcccaaaacagacatgtggactgcagtagcatccatgagcatcagcaganatgcagtgggggtctgtttacttggtgataagttatatgctgntggggggtatgatggacaggcataccttaatactgtggaggcttatgatccccagacaaatgagtggacccaggtattttcacatacttttgaggacagcaaagatcacctggtggccatcaagcanaccatctggaggcaaaactccttatctgaggaattcagaagtcattagactgccctattatctaaagcccggcatcttgtactaggcttctttaccaaaaatgtat

SEQ ID NO: 2738 - DNA, 706 bp, Homo sapiens
  misc_feature (1)...(706): n = A,T,C or G
ctttaaatctcaagctcttgttctttttgcaggatcccatcgattcgggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctncagcggaatgctgagtttgtcatgtcccatgggcctttggctccctgcactaatatgtatagtagggtttacaagatatgaaatatattttacttttttatatcttataaacctcactaccccttccacaata

SEQ ID NO: 2739 - DNA, 752 bp, Homo sapiens
  misc_feature (1)...(752): n = A,T,C or G
tnaatnnttgctctngttctttttgcaggatccctcgattcggtggtggcacatacctgtaatcccagctactcgggaggctgaaacaggagaattgcttgaacctgggaggtagctgttgcagtgagaaagattggtaccattgcactgcggtctgggccacagagcgagacttccatctcaaaaaataaataaaatagggatggggtctcactgtgttgaccaggctggtcttgaactaatgtccncanntaggcctnccatatcancttnnannggctatncattacaggntcntgtccacatgcnangncnctattacnaactgcatcatnntttgcaccccatatntatganccgnattttaattttncancaatntctnataacattgnngatctgnatanannctatnttgctgctnacaaatctgaatcatcntttccanancatnttggacacacatcacttaattnaacaatttaatgcanctatttngctatnctcctnatttgttncttcntnccacantatgttcttatgaanncatctattttncaattnngaanaaaancacntattgnntgnntatgtannngtatatacntnntcaataccgnctacttttnanctaaacctttccnttgnatanttantntnatgttnncacacttacgggtcnntccattaattntcctacatgnnaanttttacntatntcattagtanactttatnntaattaattnttcc

SEQ ID NO: 2740 - DNA, 704 bp, Homo sapiens
  misc_feature (1)...(704): n = A,T,C or G
tcaatncnggctctngttctntttgcaggatccctcgattcgaattcggcacgaggctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtattcagagtgctcgtatagccagcgttttgtatagtatttagtacagtagataatacattgactatgtagcatatagtggtgatattgagtatagggcatgtcgtgttttgaataatagaatatatttttgtaaataaatctgttacttctcttagcgcagcccagtcattttggagacaaaggagctgaggccaagagaggagtgacttttataagggtcattttgcaaccagctttgtcagaaaattgtcagttcttttttttttttttttttgccagaaaattgtcagttctatagtaaccagcatgcttacctctttggttttatattaaggtgttgatagcaaaattgaatatttgaaaatgtcatttc

SEQ ID NO: 2741 - DNA, 753 bp, Homo sapiens
  misc_feature (1)...(753): n = A,T,C or G
tncnaanggntngnantcncctctnngnaggancccntcgattcgaattcggcacgaggtcaagcctgtaatcccaacactttgggtnnaccgaggtgggggtatctgattgagcctnggaggtcgagatcagcctgggaaacacagggaggcccccatcgctacaaaatattttaaaaattagccaggtgtggtggcttgtgcttgttgncccggctacttgggaggctgaagtgggagggtggcttgagtncaggagttcactgcactgagctgtgatcacaccactgcactccagcctggacgacagagtgagacgtccatctcaaaaaaaaaaataaaaaactcgagcctttanaactatagtgagtcgtattacgtagatccagacntgataangatacattgatgagtttggacaaaccacaactagaatgcagtngaaaaaaatgctttatttgtgaaatttgtgatgctnttgctttatttgtanccattatnagctgcnataancaagtttaacaacnaacaattgcatncattttatgtttcangttcaagngggaggttctggnnaagnttttttnatttnncggccngctggcgccattggcattggnccccggtnccccaaacttttngtcccccttttatctgganggggtttaatttgnctccctttnggccgattatcatgggncaatagcatgntcttncctgngggnngaaaattngtttattccnttncaacnn

SEQ ID NO: 2742 - DNA, 702 bp, Homo sapiens
  misc_feature (1)...(702): n = A,T,C or G
tcaatacnagctntngntctntttgcaggatcccatcgattcgaattcggcacgagcaagaagagttttctgttcagtttggaacaagattttgagaagacatttaggatgtactagtttgagtttttaaatgtatatttgagatattttctcaactttctctttgggtctgtagctaaaatatgcagtataatgttttatttatttattttttaagagatggggtctagctattttgcccaggcagactcaaattcctgggctcaagtgatcctctgccttggcctcctgagtagctgggacttacagacatgtgccaccaaacctagtggctatataatttttaaaaatattcttaggatatctttacatacttttcttaaaaaaaaaaagttaacctttgtagttctgtacctttcagtagtctgcaaattttctaccaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtctgagactttgtgggcctcagacaccaggaagaaagttgggatacan

SEQ ID NO: 2743 - DNA, 709 bp, Homo sapiens
cagctcttgttctttttgcaggatcccatcgattcgttgagacggagtttcaccatgttggccaggatggtcttcaacttctaacttcgtgatccacgctgctgggattacaggtgtgagccaccgcgtgtggcctctgggcaccttttgaagctgaagcagagagagaaggcggcaggcatcagcgttttcttctatgaacttataagatcaaagactttaagactttcactatttcttctaccgctatctactacgaacttcaaagaggaaccaggagtacggaaggagcatgaaagtggacaaggaacgtgaccattgaagcaccacagggaggggttcaggcctccggatgactgcaggcaggcctgggtaacatccagcctcccacaagaagctggtggagcagagcgttccctgactcctccaaggaaaggagactccctttcccggtctgctcagtaacgggtgccttcccagacactggcgttaccgcttgaccaaggggccctcaagcggcccttatgcgggcatgacagaaggctcccctcttgccttctattcacttctcacaatgtcccttcagcacctgaccctatacctgccggttattcctaggttatattattaatgcaacagagtaatattaaaagctaatgattaataatgtttataataatgatggataattggtcatgatcatcgctgg

SEQ ID NO: 2744 - DNA, 709 bp, Homo sapiens; identical to SEQ ID NO: 2743

SEQ ID NO: 2745 - DNA, 727 bp, Homo sapiens
  misc_feature (1)...(727): n = A,T,C or G
tnnnnnnttttgnanttgaatncttggctctcgttctttctgcaggatcccatcgattcgcagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatagctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaagtgttacgcagtcggctagaagaagttcttggaagaacttggagcgcttaaacaggctggagaccctggccgccattggangtnggggaactggaaagt

SEQ ID NO: 2746 - DNA, 706 bp, Homo sapiens
  misc_feature (1)...(706): n = A,T,C or G
tnnnncttcaaatcgcnaggctacttgttctttttgcaggatcccatcgattcgaattcggcacgaggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgacctcgtgatccgcctccttagcctcccaatcctctcttaaaaaagtgatagctcagaaatatttgtaaaagcaaggtttttatttcattttggctctgcattttcagaggcaaagaagtttggcctgtaaaatagagtgctagagctcttaccccctccc

SEQ ID NO: 2747 - DNA, 807 bp, Homo sapiens
  misc_feature (1)...(807): n = A,T,C or G
ggnnnnnggggantttagatcagctcttgttctttttgcaggatcccatcgattggaattcggcacgaggtgtgtgtgtgtgtgtgtgtagaggagagaaagagaccattatcatatgagtgtgttggggctgctgagagggtttcgtttacaagtgaccttgagtgtatttcatctctggaatgcatggtccctgcgctcaagctacacaatctgattagtgaagtattactaatacactagaaaaatatacatagtaattaccaaatgactgacacaattttatagggggttcanagaaacatctgtgaatgggtaataatgaaaaaagaaaagnttttctctttgttntagtctgacccttttaacagtctctattcataatgtgaggaaatcgctacaaaaactgaaatattgtanatactgttcattngcatatggaaatacttgtatgctgtgtgttgttctttcatgggacaaactctacccctnctctntncacacacatatanccaagctataagttagcctanctttcgccataggaagttgctggcttttttantgagaagtcaaagaacctggcttgntaaaagtctttataagaaannaananttnctttnnnnttannntnnncnnatgntnnntnannnnnnnttnnnnntnacnnnnanannnnannanttnncnaancatattantgtnananannnnaatatnnnanantnntttnnanccnngnntnntnnnnnaannnnnannnntnannnnanttntannnaattnncnnnntnntnnngnnncng

SEQ ID NO: 2748 - DNA, 716 bp, Homo sapiens; identical to SEQ ID NO: 2722
  misc_feature (1)...(716): n = A,T,C or G

SEQ ID NO: 2749 - DNA, 718 bp, Homo sapiens
  misc_feature (1)...(718): n = A,T,C or G
tnnnctttttaaacctgcnttcnaattncnagacnctnggctctngntctntntgcaggatcccatcgattcgaattcggcacgagnaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcanaaggctttccggtctacctgatgcatgatctctacagttctgagaagcagaactataaaacaatgtaaaacaataagggcatatgtctggtgtgtgtgtggggggtgtgtgtgtgtntnntnanncncgtnnntnnnancnnannnttncnanntntgattncnnttnntctnannnnnttnnnntnnttcttnaatnnncac

SEQ ID NO: 2750 - DNA, 718 bp, Homo sapiens; identical to SEQ ID NO: 2749
  misc_feature (1)...(718): n = A,T,C or G

SEQ ID NO: 2751 - DNA, 726 bp, Homo sapiens
  misc_feature (1)...(726): n = A,T,C or G
tgnnnnttttntaanccggnnntttcaaatcgcttggccctaggctacttgttctttttgcaggatcccatcgattcgaattcggcacgagagnaataactaccagacaacatttgttaaaactcaggacagtatgtattttaaaggagcaagtgcatgtgtgaaaatggctcattcagtttataaaatattacattaaatttgaggtttctgttttttttcttttgtgacagtcttgctctgttccccatgctgtagtgcagtggcaccagttcacctcactgtaacttccacatcctggtttcaagcaatttgtgcctcagcctcccaagtagctgggattacagtcatgccaccatgtccagataatttttatatttttttgtagagatggtgttttaccatgtttgccaggctgatctcaagctcctggcctcaagtgatttgccaccttggcctcacacgttgctgagattacaggcatgagccaccacacctggccaatggggcgtttcttaaaatagctactagactatgacgtttatcctaaggtttgaagtctatcatcttccttacatatccttcattgtggtatctgggaatgaatcaacaagatgagagagccttcttcattcagtgtggctccttcatttccatgcttcctgaagattaaggncactgaatttaaaattcaatattctgtgagttacacaccatggagtaacn

SEQ ID NO: 2752 - DNA, 710 bp, Homo sapiens
  misc_feature (1)...(710): n = A,T,C or G
cntnnctttgaanttgnaaatngctnggctacttgttctttttgcaggatcccatcgattcgaattcggcacgaggtcactctgtcacccaggctggagtgcagtggtgtgatcatagctcactgcagcctctacctcctgacacaagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtatttatgatgaccattgaacaaatgtgaagaatactgtgaattctatgactttatcaaaatcagccacatccaggagcttgcagttgttgaccaaatgaatgatgacatagagtagttcagatctatcatgtgctcttctatctaatcagtcaatatttccttggccctcaagccaacattcattttttatgtataaccttcttcatgattttgaaattttgatagggtaactgctaatgagttcacaaatgtagcactttaaaaggaaaataaatggagagtgaaaacaacttggctacgtataattgtggggttttaattttctggttttaaaanaaa

SEQ ID NO: 2753 - DNA, 710 bp, Homo sapiens
  misc_feature (1)...(710): n = A,T,C or G
tnnncttcaaatcgntngctcttgttctttttgcaggatcccatcgattcgaattcggcacgagagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaaattgagagaaataaacactggccttggaaagaaggcaggcaaagctgctgagtaatagtcagaccctaggaaatgat

SEQ ID NO: 2754 - DNA, 727 bp, Homo sapiens
  misc_feature (1)...(727): n = A,T,C or G
gtnnnnttttctaanttgnnncttnaaattnctaancgcttgttctttntgcaggatcccatcgattcgaattcggcacgagcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcanagatacagaaatgttagcaactggggcccaagatggaaaaatcaaggtgtggaagattcagagtggacaatgtttaangagatttgaganggcacacagtaagggtgtcacctgtctaaacttttctaaggatagcagtcagatccttaatgcttcttttgaccagacaattagaattcatgggttaaaatctg

SEQ ID NO: 2755 - DNA, 708 bp, Homo sapiens
  misc_feature (1)...(708): n = A,T,C or G
cttcaaatcgctnggctacttgttctttttgcaggatcccatcgattcgaattcggcacgagggcagaccatccacatcagtttcagagaaaaacaataatcttgtttgtgccgtgatgaagaggactgacagctaacagcagaaacaatagtcaggaggttgagaacaggctggttaacatggtgaaatgccatctctattaaaaatacaaaaattagctaggtatggtcgcagacacctgtaatcccagctccttgggaggctgaggtgggagaatcgcttgaacccaggaggtggaagttgcagtgaaccgatagtgccattgcactccagcctgggcaacaagagtgaaactttctctcaaaaaaaaaaaaaaaagatgtcaagccccttctcttcctttctccaccatcatggtgtgtacttgactctgcttctcaccagatcttctcataagactatcaggattaagcaattcctggccaagaaaaaaagcaaaattgttccattccccagtggattcagatgaaaactggtaataaaatcaggtacaactttaaaaggagacattggagaagaaccaatccgtgtctataaggaattgtcatgagatggcacacatttttatgctgtctgagcattcaatcacgttaccatatcaagcagaaaatgtcaccattatctggagagttggacatgttttattg

SEQ ID NO: 2756 - DNA, 730 bp, Homo sapiens
  misc_feature (1)...(730): n = A,T,C or G
ttnnnnntttaancnttcaaatcnctaggctacttgttctttttgcaggatcccatcgattcgaattcggcacgagcccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctncctctacccacccccttcccccgcatgctgatccccctgcccaggtaagggccctgccctggaagactggagggaggccccaagccacggggcatccccctctcccaggaagcagggagggggccgggaggttttcctctcaagccccaccctgggggcccgggggcgagggctgccccctcctcccctccccagtgagggacattttttggtaaaacctattttcattttggaaaatatttatgaataaatagttttatatgaaaaaaattntngnnnttnnnatnnnanaataaaancntcgnncctcttaaaactatagtgaagtcgtattaccttag

SEQ ID NO: 2757 - DNA, 710 bp, Homo sapiens
  misc_feature (1)...(710): n = A,T,C or G
tntatntacagctacttgttctttttgcaggatcccatcgattcgaattcggcacgagaccaagagaacgcggtcagaaggaggtggaactggggagtcctctcagggagggacaagcaaaagactcaaagtagatggacagaaaaactgctgtgaggaggggaaagaggagcagcagggatgtgcaggggacggtggggaagacagggtagaagagatggttatagaggttggagagatggtgcaggactgggccatgcagagccctgggcagccaggggacctgcccctgaccactggaaagcatggagcccctggagaagaggggcagcccagccacgcagccctggcagagcgggggcccaagggacatgaggcagcccaagaatggtctcagggtgaggcagggaagggggcatccctgccctcctcagcgagctggcgctgtgccttgtggcaccgagtgtggcaagggcggcggcgagcccgtagacgcttgcagcagcaaaccaaggagggagctggaggtggcgctggcacaagagcanggtggctggcgactgaagctcaggtcacccangagctgaaaggactgaatggtggccaaagaaaggcccagaaactgagcccctgctgaacttttgtggccgtcttgtcttcccggctgacccgaatgcttactgtgaccccgcttcangatccccaaggnc

SEQ ID NO: 2758 - DNA, 716 bp, Homo sapiens
  misc_feature (1)...(716): n = A,T,C or G
tnnnnnttcaaatngnnagctcttgttctttttgcaggatcccatcgattcgaattcggcacgagccagagctggcagaagaaaacagtaaagcttagagtagaaataaatgaaataaagaacagaaaaatatagaaaatcaaaaataccaaaagttggctctttgaaaagatcaacaaaattgccaacccttttaagtagacaagaaagaatgaattgttggtggtgcagtggtgagcatagctgcttttcaagaacaaaaaagactcaaatgactaaaatcaagaatgatcaagaatgagagagtagacattactacagatcttacagaaatgaaaggattattaatgagtactgtgaacagttgcatgccaacaaatagtctaagtgaactagacaaatatctagaaagacacaaaacaaccaaaaccgaatcaagaaaaaaatataaaatctgaatacacgtataacaagtaaagagattaaattggtaccacaaagaaaaactgtcaccaaggtaaagtccagacccagatggcttttttggtgaattccaccaaatgtttaagggagaattaacaccaaatctaaaactaaaccagacagagacattgcaagaaaaccacagaccaatatcccttatgaatatagatataaaatcctcaacaaagtactagcaaatcaagtccatgaacatatacaattctattttactt

SEQ ID NO: 2759 - DNA, 715 bp, Homo sapiens
  misc_feature (1)...(715): n = A,T,C or G
gtnnnncttcaaatcgcttggctactcgntctntntgcaggatcccatcgattcgaattcggcacgaggggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataaagaattgtaacacttctctaacctattatanaattgntaatacctttacccttctcttgaacacatcaaaaggatgtcattgagtgttggtattggagtatagcatatctattattcng

SEQ ID NO: 2760 - DNA, 706 bp, Homo sapiens; identical to SEQ ID NO: 2738
  misc_feature (1)...(706): n = A,T,C or G

SEQ ID NO: 2761 - DNA, 726 bp, Homo sapiens
  misc_feature (1)...(726): n = A,T,C or G
tnnnnnttttntaatcnngnnttnnctttgcaaatcganangctacttgttctttttgcaggatcccatcgattcgaattcggcacgagatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgtttggtttttgatgggagggaaagagtactgaaatgttttgtaaattttttttaatgtgctgctaggttttttgttttgtttggtctgaagagaagagtggtccatatgttgcaggaagt

SEQ ID NO: 2762 - DNA, 710 bp, Homo sapiens; identical to SEQ ID NO: 2752
  misc_feature (1)...(710): n = A,T,C or G

SEQ ID NO: 2763 - DNA, 740 bp, Homo sapiens
  misc_feature (1)...(740): n = A,T,C or G
gnaaatnngctcnnntgcngctncttgntctttttgcaggatcccatcgattcgttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcanagtgcaattgtgatgaaagtcagtgggaaccagtctgtgggaacaatggaataacttacctgtcaccttgtctagcaggatgcaaatcctcaagtggtattaaaaagcatacagtgtcttataactgaagttgtgngnaagtnactgggnctncagancngaaaattactcancgcacttggggtgaatgcccaagagataatacttgtccaanggaaatttttcatctatgttggcagttcaggncttaaaactcttnggtcctctggacaaggaggnnccacattaatttggtnactgtgaanatggttcnncctgaattggnaagg

SEQ ID NO: 2764 - DNA, 734 bp, Homo sapiens
  misc_feature (1)...(734): n = A,T,C or G
anngttnatgaagcnctttgnaannnccnncnangagncctcgatncgcaatgaactactctgcagcctcattttttaaaaaatgagataggtnagtgtggatataaataactgtccaacatatatagctgagtaacanaaatagcnaactagaaaacnatgtattatnccatntgtgctgaaatatgnatgntggtatgtgnaaatatgtatggntgtatagacagatctttnctaaaattttttcattnntaattnnngtgggtacatactangtatatatntttgnggggtcctgaggtattttgatacaggcatgcaatgtgaaataatcacatnnncntnnntggggtatccatccccncaagcanttgatctnntgtgtgcaaacattccaanngnatncctttagttntccataaatgngcaatnaanntngnctatngtcnctntggagannnatcngnantnatctcaatcnncccatntgtnacttganccattgaccattcccaccaatcctgaatgcctcantacccttctcaccnatggnnctcttgcttatangctntntgtcnatgagttcaatcgtagtgantttaganncnggacttccatgcgaacatgntnaaggccggcctntntggcctggncttacttaaatnaaccataatattgccnatgacaggaacggatactntgctaacggccnnatagttccncatttgggaccc

SEQ ID NO: 2765 - DNA, 728 bp, Homo sapiens
  misc_feature (1)...(728): n = A,T,C or G
ggnnnnntntnnanatacagctacttgttctttttgcaggatcccatcgattcgaattcggcacgagtagggtcttagtactggtttgggcataattatactcagtgtttgggcctctgctaaaattctaagacgataagaatatcagtttaagttctgttacagttgttttcatgaagcttgtaagattgatatttaagtggacaaagtgggaagtagtcagttttcagggctccaggggtcatcactttgtgctcagagtacagctgtcaactagtgatttggtgcatttagacaaggaacaggagcaaagggcctatttcaagagggtcatagacactgccttgtgataagtgaatggctagagggtttcttggtaaactgaagtccttttcacatttttagctttttctgtggcaacctgtcttttacagaagctactcatgaactctggcttttcattttcagggttgggctggacattctttgatttnntgntttgnttngntttctgagacagagtctctctccatcacccagctggagtgcactggcgtgatctcgctcactgcaatctctgtctctcgggtcnggtgatctcctgcctcagnctnccgagtagntgggactgcagtttcatgctacacgcccaggtaaatttttgngattttgatagaanacagggttttgncatgttggccgggctgnctcnaactcctgacctnaat

SEQ ID NO: 2766 - DNA, 712 bp, Homo sapiens
  misc_feature (1)...(712): n = A,T,C or G
cangctacttgttctttttgcaggatcccatcgattcgaattcggcacgagcatttcttgtctttattaatttgacttctctagggacctcatttaaatgaaatcatacagaatttgaacttttgtatctggataaaaaatatatacagcattttgctgactgtaaaatgtatttttttgggccgggtacggtggctcatgcctgtaatcccagcactttggtaggctgaggcaggtggatcacctgaggtcgggagtttgagaccagcctgaccaacatggagaaaccccgtctctactaaaaataaaaaattagccaggcgtggtggcacatgcctgtaatcccagatactcaggaggctgaggcaggagaatcgcttgaacctgggaggcggaggttgcggtgagccgagatcgcgccattgcactccaagccttcaattcctatctgtgagtaggtcctcaaggcttcctctgctcccagtcggacaacccatcggctgggacagtactgattctccagctnctctgcagacatcttcttncaaggaaccttgcttgggaaacccacaccaggcctntagaactatagtgagtcgtattacgtagatccagacatgataagatacattgatgagtttggacaaaccacactagaatgcagtgaaaaaaancttattgngaaattgngaagctatgctttatttgaacc

SEQ ID NO: 2767 - DNA, 751 bp, Homo sapiens
  misc_feature (1)...(751): n = A,T,C or G
ggnntttgcnaatnctaggctacttgttctttttgcaggatcccatcgattcgaattcggcacgagcagctactcgggaggctgagggcacaagaattgcttgaacccgggaggcagaggttgcagtgagccgagattgtgccaccgcactccagcctgaatgacagagcgagactccacctaaaaaaagtaaaagaaaaaaaagaggaagaattagcacatttctattacagaattggacttgaacatgcaaaatcatgtctggatttctcagtgaaaagctgttttacgttagtggactcttctaacattttgaaatggtgatctggatttgggatctggctatcactgacccaccttgggtctgtgaatgaccaactcacctaggngggagtcagttacccctgccntacantggcccatggancacctgcggnaagaangnntttntgcttactgattcttncatctatggtgtccaattgggaaggatcctgngccattgactganctctntgagggttgttatnaagcttgtggatccattctcatgactactgggaaatttctgtgaatttgaccctgcccctgaactccaaggcagcttttcccctnnaaaggtnaaatccaanccctattataactgggggganttgttngacaaaattttngggctantttaccgaccaaanttttcnctgncctanaaatgttcgnacccnncccgnantttggnnggcttcaccccctc

SEQ ID NO: 2768 - DNA, 800 bp, Homo sapiens
  misc_feature (1)...(800): n = A,T,C or G
gtaanntttcnaatgcttggctactcganctctntgcaggcatcccatcgattcgtncntcntgtntangtcgncncagnccttantngggatacttaaatntactatttttnccnngtactctcnaggatttggatatgacttnncagatnnanatgngnnaactnatnngagnataatccntgaacagnntttgttcnncncatncttggagaggncntgntatatncagntcatgcaacactatcnantnagggtatnnnccgncatccatagtgaatnatngntaanccactngagggntncntannnatntctgtnnagcncagaccncnatnannangannaagagcacntgncatatngnagngnnagttactncancntcntgangtggaatacnnatgacatcaatcgagntnaccatnacgcanntgtactgaganttgngancctctttntaccaggcatatgtcaatggtcnaanagagnccatnnnacntnnaccnttntggctnnatgttngntcnnccnttgnangctntcctntgcatgantggganntcaaannttcnggacnncaatttangggncttaanntnaaaggnnccannctngggctctcnataataaccantannggnaaaatctgnaacccttgctctacctanncctagggngancctgggatttgtnnnnnnaaaantcccaacccttnantacttgagangntnccncgnntttnnaagnnactttgnngatagcnnccnaaatgttnnncnnntcangnaatccnntgn

SEQ ID NO: 2769 - DNA, 718 bp, Homo sapiens
  misc_feature (1)...(718): n = A,T,C or G
gctcttgttctttttgcaggatccctcgattcgaattcggcacgaggatcagtgaaaaacattagtatacgtttttaaataggctaatttttcaacttggatcattaggcttacgtactacttgtttcaaatgtgtcaaatacaaaaatggtaactaggttgacagatactttgtatttttcttttgaattcagacctggaatgtaagtaagtgacaatgcttatggaaagccagttagttagaattggaaatctgtcttgtcattttacaagcattagattcctttcctgtgtgaagaaagcctcagtgaaacaggtctttgccataactttatgaagtgctacagaaagcacaaagaattgattcatgttcatcaatacctgctgagagtactgtcccaggaatatccagtggatggattcatcatccaggaggttcaaaagtaagatggttttcaaatcatttttgagactggtgcataacagcagggtacctgaaaagagccttctgggagttagtgaactaggtanatggttttgntcacatacgccccatcaacttaaaagtgaatggctttggtataaatgangtcactatggacttaccctaaagatcttctgtacttctggcttccataggacaaatgataagtnctacttnctcatctcttngggttattaattggaanncttgcattcatgggtattgaaattnaaa

SEQ ID NO: 2770 - DNA, 730 bp, Homo sapiens
  misc_feature (1)...(730): n = A,T,C or G
gcaatagttgcnaatagcnaggctacttgttctttttgcaggatcccatcgattcgaattcggcacgagctttttctcactgaaatatttaagcactgcattttaagaaaacttcctattcattcgtagacttttatctggccagatttccactctgagggcttttctttctagttatctgacaaaccataaattttatttcctttaagggcaaaaccaacctccaagcacatttatggcccatgttttaagagctggccgncctttctatcctgtatctctggttaaacgtgttttctttntcttggagcaaatttttcaaagaggggctaaagctatgtgttcctctggagagaactnctgcctacccagcangaaagaaaatgccagagaagcctccgacctgggttctgcccctggtagccaggtctcaggctanaagccttctttttggttgcattggagtccttctctacctcacctttattgcacttccttcttggttcnnatgtatnctcctctgnctnctttaaagantggcaactttttggactttggacaattcctgtgtagcaatctgggctgattttagagaggccttctgttcctgcttccaatgagctgattgggtgatcagctgattttattacctttccctggaggaagtanagtcccaggatgntggggaaggcccnntggggacccctgaagccctttatgttgacccctt

SEQ ID NO: 2771 - DNA, 755 bp, Homo sapiens
  misc_feature (1)...(755): n = A,T,C or G
gnnttnananagctngnnnnnnnctacttgttctttttgcaggatcccatcgattcgaattcggcacgagcagactcgcattatggacaagtcccttctccccacacaaaggaagacatacaccgcatagtccatttcatttcagctcctgatggcatctgaccgccgtggacacttcccagnggtntggcttttggagggagagtanagcggnggatgatctgtgccagttggncactccttggatattggngttatntccactggtcttgntgctcctctgtgttgattttcattaactcatttcacctnaatgaattctggagcctggctganatngtgcntactctntgncagaggatcatcatgaacaaccccttatgtagcaagnttcccaggttttttcagaagtggtgaatccatgccttggcattcntggattattccatgtcatgtcagatcattcatnaaatnnatattgacacatgtcatgtgatgcnttctatgctgacaccatcaggaattcaaaanggtgaccacacgttgntntgntcctgaggacttccagggttanaaaaananataaaaaaaacttgagggctntaaaactatatgagtccnatttacgtngnancngacatgaatncngaatncattgaatgaantttggccaancccnnaactatgaattgccgttgacaaaaaggcctttttttgngaaantttgngctgcttttgnntttaatttgnnaacc

SEQ ID NO: 2772 - DNA, 632 bp, Homo sapiens
  misc_feature (1)...(632): n = A,T,C or G
gttgagctgctcttgntcttncnctggtncnatctgcaggatcccatcgattcgaattcggcacgagcccttctgagnntgtccattcatnggtggttctgcccctactccccnagccctnaataccccatctgctgttcctaccnatcnnncanccaccggannntncattcagcnntttgtctgacccctgnagcccngagggnnggagcagtgcnntacanctcctttnncaattgctggncagacngctatntgtnnctnanattnaanactttctgtctanttcganctgacnttcannactaacgctncaatcngngattcnttctttaatccntnaggtatctntnattnctgngctnangangngccttnaanngctgagcttacntgccngngantgnngntattgngannanggatnctgacattgncttgntcacagtcnntntnagcgtgcactgngatganaancttgaccctgaccattanttgcnnaccgattnattgcctgatgtacanatcttgntgnnangaccactgatctagatgntctnatctanatnatcnactgntgacattgtctaaancatcacnnatcaaagttttagatgcagtgnttgagaatc

SEQ ID NO: 2773 - DNA, 744 bp, Homo sapiens
  misc_feature (1)...(744): n = A,T,C or G
gtctatgctggntannnatacaggctacttgttctttttgcaggatcccatcgattcgaattcggcacgaggaccaaggagatgtgagtgaaaatgatgcaggctgcttccaggtgtgaccagtaagatacttcccacataatcttcctactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaaatactagcaaatttttaagaaggaagtaattccagtatttcacaaacccttccaaagaatagtaaaaacaaagagctttcctttcctcgttatctaaaattagcctaactttgatagcaaaaccagctaggagagttgcaaagataataatcagaagccagtctcactgaacataaatgtgaaagtcttcagcaaaatattagtctacttcgtgttcacatctttcttatgggagactnttttgtntggttggttttganatggagtttcgctcntggttgcccaggctggagtgcaatggccgtgactttggctnaacccgacctacgcctgggagacatttttattttcagaatggacccattttctctactggtntgggcncaaaactagactctggattaancctcccctgngggttangaagtgggccatntna

SEQ ID NO: 2774 - DNA, 760 bp, Homo sapiens
  misc_feature (1)...(760): n = A,T,C or G
gtctatnctttgaanctctttgctacttgcnngntctgtntgcaggatcccatcgattcgaattcggcacgaggatctctttngaggtgatggtgctntccgagctgtttctggagatgctccagagggattttggctatagagtttataagatgctactgagccttcctgaaaaggtcgtgtccccacctgaacctgagaaggaggangcngccaaggaagaagccaccaaggaggaagaagccatcaaagaggacgtggtcaangagcccaaggatgaggcacacaatgagggcccggctacagagtcagaggccccgctgaaggangatgggcttntgcccnaaccactctcttctgggggagaggaagaatnnaaaaccccggggcgaggcttcttgaggacctgtgtgagatngccctggacccagaactggtgcttnnganggatgatggataggaggaagtttgnaggagcaaagctggatgatnctgangtncggtncngnncctaaaccagtcacagatggagttctntncacttcaagacatgcccaaggacntggatccctnntgctntgcttcccttanactgnctggttccttttagnggttcttttgatnccaactgatgtngcttncttgcaccggccangacttngnganggaaccttcttacccttgggatcccggnttaaatggnanaccanggccaanccaaatggtttaccnagggnnggngaacccnanaaaaattttn

SEQ ID NO: 2775 - DNA, 737 bp, Homo sapiens
  misc_feature (1)...(737): n = A,T,C or G
gggnnnnnnnnananatacagntgttctttttgcaggatccctcgattcgctggaattagattgtgtagggcccgacattggatttattttaagtacaataggaagccactggaatgtgataaccagaggcttgatgtaatctagtctaatctattaaaggattgctgtctagtttgtgataaatggagccttgaccttggtgtcaagaaattgtccttgataccagcaaggccaatttggaggttattgccattctgagatgagaagcagtaatgacttggtgtttatttgagatagaaagcaagtaaaatagaaacattttctggtagtagaggcaagaaaacttggtgttaatattatcaaagcagataataagaaattgttactgggttgtagtaattatctcactgatatttaaacccttgggtttattggactgggtggccgatgtttgggtaagaaggaaatgagaagtgtttttaatatgggagataccttagcatatttataaacaaaaactgataaacaaggacaaaacttccacttatggtcacggtgaagtaactgatactggcccgtgttttctctccattaacaactagaaatctggttgcatacccaaagaagctggctctgatccacactaatnaaattgnnaaaaatncangctttaatgatctaggatcccaaaagtantgtggtcaaagccaaatncaaaagtcttttaaggaagacc

SEQ ID NO: 2776 - DNA, 769 bp, Homo sapiens
  misc_feature (1)...(769): n = A,T,C or G
ggggnnnttgcaaatncnnggctgttcttttgcaggatcccatcgattcgccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctnccccacttgatgtttgtgttttgtttggggggatatttttcataattatttaaaagacaggccgggcgcggnggctcacgtctgtaatcccagcactttgggaggctgaggcggncggatcacctgaggttgggagttcaagaccagcctggccaacatggggaaaccccgtctctactaaaaatacaaaaaattagcncgggtgtggtggacgtgcctataatcccagctactcnggaggctgaggcaggagaatcgcttgaacccggtaggtgggggttgcngtgagccaanatcgcaccattgcacttcannctgngcaacaaagaaccgaaactctgtcttaaaataaatnaannnattaaaagacagaaangcaagggggtgcctaaaattctaaaactttgggggtccaacaccngggcaaccggnggnttgcaaacccaaacaaccttggnaaggcttccattttntttcccaaagcccnnanncagaaggggtcattgccgggccccaaaaggaaaaaa

SEQ ID NO: 2777 - DNA, 769 bp, Homo sapiens; identical to SEQ ID NO: 2776
  misc_feature (1)...(769): n = A,T,C or G

SEQ ID NO: 2778 - DNA, 735 bp, Homo sapiens
  misc_feature (1)...(735): n = A,T,C or G
gctatgtggaaatcgcnaggctacttgttctttttgcaggatcccatcgattcgaattcggcacgagaggaagctggttgagaagaagaaggaaaaagtcgattctactgactgacgtttccccctgctgttaagaatcccaaccacacactttcacacactattccaggttctggctactgaatgatcccacagctgaggtctattgncatcgctccacttctatttttagcagcactaaaaacattcccaaaaaaaatgttttttagctttttaactgtagattcaccactaagaaattggcattggaacagtccacagagcttattcaaatttcacccattttacatgcactcatttgtgttgcatgtgatatatagttctatttcattttatcacctgtgtagatggatgaaaacagcaacataagcaagatacagagctgttccgtcatcacagagctctgccatactatccttttatagccatctctacctctgtcccccatttctaacccctggaaaccactaatctgnncttcataattttcttatttcaagaatcttacgtaaatagggatcacgaagtataacctttgagaatggccttttcactncattcccttgagatacatccaggtagtngcatgtatcaatagntaattcctttttattgctacacagtctccatagtatgaatatactatgtacatagcatatntatttataggtnacc

SEQ ID NO: 2779 - DNA, 759 bp, Homo sapiens
  misc_feature (1)...(759): n = A,T,C or G
tgcgtcgnngagcgtgcnantcgcatngccnanaanaatggcggggcgcatccctgacagttggataataggttccaggaagttcagtggaaaattttttcaaagcaacatttatagctgattgaacttgaaaagccattttggtgttgaatggcaaatatgtggacttcagcattcctggagcctgatgcatcccgctggatggccctgttcctgtgtacatgatggcctggggactcagcagtgtgcagggtactctcctttagagggtgctttgaggaaagaagtttgctgccacttacagaagtccccttcccatacagtgatataacacaagtaccccatgtccagggagcatctttcctctgatggcttgaggacttatttattaaaaggacaggaatgtctggcaagaaacagaggagctcttaagtactgtaaatactcctagtcactctgcatcagggctgcaagtntaagcagattgctgtggtgtatacacatgattttagcatgataacacttctgtttaaatgnccttagttggtccgggngccaccactggcgtgagccttaagaaaggctaacgccgntgngaagaaagggctttataggccgngnntggagnggntaaattntctttagaacttaaaagaagaacttgcaggggatggggaaggggaaaaatgaacccatnggtncanggaaatntaggtgaacangagnaattgaaccnatttgcaagnnttaaagaaaang

SEQ ID NO: 2780 - DNA, 678 bp, Homo sapiens
  misc_feature (1)...(678): n = A,T,C or G
nttnnanncncagctacttgttctttttgcaggatcccatcgattcgaattcggcacgagcgttnacngactacgtgtngagcnctgtgncagacnctgantncacnntggngaanatganngtctaggggnctcagcccgtntnnttcntaatccagtgaganacnaanacatgtacacaggctncgatnanttgtgncaattgggaaatgtgccatgctactaggggatggatgagatcncagcttantcttggnaagaatgagtgngncntngcaantaagggnggaanagaatattatcaagagaggtgangaaagttgncgngacctcaagtgtacaganatgagaatacnttgctgtntaaatnactgcttnacctcnatangggnngaggtncngtntnnntgagctaatcgtatntcangngatgttatcnggaagaanaaaggctnnnaaacnntcncttttnagncacgtatgtgcacttaactgcaaatggtactgggggagccatatatggacttatctgaaaatgacctancncaattgnctttagaaaaancccngctgccttgtaactngtaatggcaactgaggtggtagacatatngatttgcactatgagtngaatncttatntctgtnngagtgcattccttcgtggntnggactgaac

SEQ ID NO: 2781 - DNA, 682 bp, Homo sapiens
  misc_feature (1)...(682): n = A,T,C or G
ggcacgagattttttttgttcgaatgagccttaatcttntactagtgattttttgtttgaaggagccttgatcttggccaccgaaaaggtnaaaccagtggcaagcttgaatgcttgttttatggtagacttagatacgagaacgggtaaagggtactggataaacttgggatataagattgcttcttttatgcataccactcataccactggtgggaaatttcatttggaattactccctagggccatggagtcttcctgcatatgctaataatgtaagttcccattacctttggtaataagaaaatatctttaaaacaagttagcttttcctattgnntatatatggaaggacangctgttttccctnctgtgcatttagcattttgngtatnctctcattgcncnaantatgcttataacattgtgaaaccccgtctctactaaaaatacaaanattagccaggcatggtggagccgtgcctggaatccctgctgcttaagaagctgaggcncaagaattgcttgacctgggatgcaaaagttgcagtgancctacatcacancantgccttcanccttggggacaaaactgtttctcnnnaaaaaaantaaanaantttgagcctttaaaactatngtggagncgtattacnntanatccngacntggatnagaatcn

SEQ ID NO: 2782 - DNA, 784 bp, Homo sapiens
  misc_feature (1)...(784): n = A,T,C or G
cgntgantntcnannngcgggcctcgctctttcannaagncnngcgnggngaattcggcacgaggagntcgnanctcctggtggcgcttttttgagctgcagtgctacaagagtggcctgantccaccaagagaaggcccaggaggaagaagagaaaaagatgctgtggttactagtgccaaaaatgctggcaggaacaaggaggagaagacaatcataaaaaagctgntcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggntctcttggcatcactttctccctggctgcagaactagacacccttgaagatttggcctgggccagtgagactgaaatcaagaaaaacagaagggatgtgcaaggtgggggggtccacttnctgctcccatgtcaacccccanggccttcagcgtgcagacgcctgncctactcatctgctcccacnggatggaccctgggctttaangggtaagcanaaagggagaaaaagaaaacccggaaaatgngcctattggagaattcccagngggggaccttcacctggatatttaaanggaaanattnggattttaagcccaacatgcccttncttttangggggaantnnggggattaaaaaggnaaaaaaggattcc

SEQ ID NO: 2783 - DNA, 741 bp, Homo sapiens
  misc_feature (1)...(741): n = A,T,C or G
nnnttnntnannnttgggctaacgccctnnaagnaaccagtcggnncgaattcggcacgagaagacctgcagcttcagcatcacttgagaagttnttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcatcttcaaagactagtacttacacagtttagaagatttcaaggtactgctgacagtagtttattatgtcagtatacatacgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgntttttactttatgtaagttcagaatcctttttttaaagtgatgactactgatgaaataatgntactagtagctgaatttagacttgatgctatgntgataatatttaaatggtgaaaagtaattaaggcaaaatagcaattnt

SEQ ID NO: 2784 - DNA, 721 bp, Homo sapiens
  misc_feature (1)...(721): n = A,T,C or G
nttcnnnntnnttggctgttnttcngcaggancccatcgattcgctgcctcctccttaggcagagagctccttggttccatttgaaaaccttccttccccttttgctggaattgagagactgaggacacaaagtggtgtgctggagaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtnagaatacgtgtaaggtacgtagcaatggttatttacaaaatggactctgcctgcagattattagtatgtctcagatgtaaaaccagctcaaaagtactangacgatttgtagtagtatttaattatttgtaaacttacaccgtttttcttcacgtttgcagaatacaaatctttgncagtagtgaaatgngaatctagtaggattaaactgngtgtaaaccttgtgggcgggatgaagagaggcagaagcgcgtactggtgctgtagttgcccgcaagctcaagggcccactatgtactgctctgggttgcactgcccagaggtaaggggaagcttccttaagacnt

SEQ ID NO: 2785 - DNA, 730 bp, Homo sapiens
  misc_feature (1)...(730): n = A,T,C or G
ggnntttnntannatacagctacttgttctttttgcaggatcccatcgattcgaattcggcacgaggggttctttaacctgtgcttcctctgtcctacttcccatcctgcacagttcatagagtcactttctgactatcctatagacacagtaattggacctgtgtttttttctaatctttatatgacagcacatttcctaattcagggaccatcccctatcccaaattccatcctgtgagatgtgaaacctgtgagttcatgtgaatgagtgtttgaagggcttgacgccatgtagtctcttaggaaggcttcagggtgctcttatgttgatgctttgccattatcaaatggcattgattgatccgagggactcagaaagttagggtagactctataaataatttcattattcctcatcctctncgtcatcattttattggttagtcattctgccagatcactaagattcttcctctacaggccccgcaaaattncacagagccctgattctncacctgcagatggagtctccctatcccattgctcagcttttcaagatttattatgatgctggcaagtganggaatttcttaagccgagaaatcagaagttcatgcctgttacctcctaagaacccggngtnaaagaccatntatcctggtctganatggcgggcctttagtgagaaataagttgtttttaagttggttcagaaaaaaaaacccacc

SEQ ID NO: 2786 - DNA, 759 bp, Homo sapiens
  misc_feature (1)...(759): n = A,T,C or G
agagtttgngtgtagcgccttcnctaagannntggcggtncgaattcggcacgagcagggatccacttgccttaatttgcacagtgttcttataaatcaacagaaagtacacataacagaaaaatttaaaaggttagggatcatttaggaaaaaatgcaaatgccaacaaatgtgagaaaatgctcaatcttacttataatttaagaactacaattcagccaggcgcggtggctcatgcctgtaatcccagctacttgggaggctgaggcacgagaattgcttgaacccaagagggagaggttgcagtgagccaagatcatgccactgcactccagcctgggcgacagagcaagacttgtctcaaaaacaaacaancataaaacaacaaanaaattaccattaaaaatgagagagttttcattggcaaagttaaaaagaaaggtgaaagaaaaacctactcttcttgatttgtgtttggtcacttatggagaatttattttgtcataaggnctgaatcataattaaatatgttctttgggtctancagttcttctatttcttgnattataagtaaaccttggaaccatcttanacactgatcatgaagactaatttgnaataanaaagtttctagcctttcattccnatggaaatatggttgcccgntaaaaaaaaaagcctctagaacttttagtgagtcgnattaccgttagatccngaacttgattaaggatacaattgattaagtttgggacnnt

SEQ ID NO: 2787 - DNA, 751 bp, Homo sapiens
  misc_feature (1)...(751): n = A,T,C or G
gnctttnaaatcnnttgctacttgttctttttgcaggatcccatcgattcgaattcggcacgagatggggtatagatggttttccccctgtgtactctagtaaatttctatgccatttctcctatcgatctgccttttgtcagttgatttttcagcttaacttcagagagcaaaggggaaggtggccaagtgcagtgtctcatgcctgtaatcccagcactgtgggaagctgaggcaggcagatcacttgaagtcaggagttcaagaccagcctggccaacatggtgaaaccctatctttactataaagaaaaataagtcgagtgtggtggtgcacacttgtaatcccagctactcaggaggctgaggcagaagaattgcttgaactcgggagatggaggttgcagtgagccaaaatcgcgccactgcgctccaacctgggtgacagagtaagaccctgtctcaaaaaaaaaaaaaaaaaactcgagcctctagaactatagtgagtcgtattacgtagatccagacatgataagatacattgatgagtttgggacaaaccacaactagaatgcagtgaaaaaaatgctttatttgtgaaaatttgngatgctattgctttatttgnaancctttttaagctgcaataaaccaagttaacaaccaccattggcatttcattttatggtttcaaggttcaagggggaagttttgggaaggntttttnaatttccnggccccggngnccaatn

SEQ ID NO: 2788 - DNA, 739 bp, Homo sapiens
  misc_feature (1)...(739): n = A,T,C or G
tnttatntgngnnctttgnaantccccaggagcnnngcgattcgctggatgaagactaagcatttaaatactaagttgagggcatantagcttttntgtgcctataatcccagtgttttgggaggcctaggcgggaggatgccttgagcccaggagattgaagctgcagtgaattatgagccaatgcactccagcctgggtgagagtgagaccctatctcaaaacagcaacaacaacaagatacaaattgagaaactgttacttgatttgcgatatgtattctgtccagcagtgatagaataacaaggactgggtttaccttgctattttaagcaacaatatatgaaatagcaatttgtaggcattgggtaacaggcaaagcaagactgtggtcactgaaagctgggaaacaaacctactgagctctatggttgccccaatttattatctggaggtagttttcaggctgcagagcagggatggggaagtcaaacagagcatggtgtcttagaattgggaggacaagatgggggttggcggggagggaaggttgtcatcattcgtggggcagagtaccagagaagtgggaagttgtacacagaacttccagtgataggtggaggagtcttctgaatctggttgaatcctgatctacaggtgcatgaaaaggagaacaccctgaggncagaaaaagaacccactggaaaccacaggccaaacaattnctgggactcacact

SEQ ID NO: 2789 - DNA, 746 bp, Homo sapiens
  misc_feature (1)...(746): n = A,T,C or G
ttagnnnncgncgcgntgaccnggaaanccccaggagcntnncgntgcgaattcggcacgagtcttctaggaatgaggggcatcagcccaccccaggnttttcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgnttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgacacatcactncatatgggggaggaagaaaggatccctggcaccttctcctctctttaanggggcccttttgcaagccctagncn

SEQ ID NO: 2790 - DNA, 814 bp, Homo sapiens
  misc_feature (1)...(814): n = A,T,C or G
nccngnggnncagacggaaagcccangagccnggcgaggcgcnganacatganaancacttgaaccngngaggtggnngatgcagttttnttttgattgagccattgcactcnagcctgggcaacatagcgagactctagnctcaagaagannanaaatagactgaganaaagaagangaaaaaactnnngaggccaccagtcctgngaagacaacaaagaagcagggctctgagagagancnangagggcataggtggcccgaggacatnagangggttnanctncangngaaatnggngggaacggtgntccaggcntagggaatagcncatgnaaangccgtgataaagggaanaaactnggtgngatggaggaatgncagagagggcagaacagancnagagggcancattcgtaggagacgagggaatcacgggcctgccaggccatgganggggtgnggattctannacgaagcctgaggaaagtnaaggcngggannancacancaaagatgccancnggcttgggcttacgnacctcccccatggcngcatgggaangaaaattaanatgnncgcaccaaaaagttgnaannaangnngaacgcagcnnnggtgnnanngnnccccanggcgaaaannggncaaagnangggnccggggtcnnggggcttggaaaangataggacggggngccaagnaaggctccaanaaaaatcgganccnngggaanaacnngggagancnngcnngganngggacaaaaattngggncccnggccaaggncccgggnggcacccanatgggcg

SEQ ID NO: 2791 - DNA, 750 bp, Homo sapiens
  misc_feature (1)...(750): n = A,T,C or G
cnnncnntgtactgnacnggnantcccatnagccnanngattcgaattcggcacgaggcatattgtggagaggcacagttcaggaggaatagntttcgtcttgaagaggaggacactttcctgtgaatcatgagggacagaagatccatatagaagaagacaatagctttgatcttctattacaagaaaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaanaaaatgtcccacatggcanaaatgatgtacacctgatagcaagaagctaattcatatgctttaaaccaatgaaggcttgncaaagagatttagttaatggcagaccttgnggccactttntgtgagaagacatctctttntgctcactgtcttgcaataaaaacttttnttggcaaaanaccaaantttagagtnanccnttaaangaaaaaccttggnccccttanaactnttntggaggcgnatttnccntngaatcccgaccttggattcaggaatcctttgatnaantttnggaaaaaccccccacttggaaatgccc

SEQ ID NO: 2792 - DNA, 770 bp, Homo sapiens
  misc_feature (1)...(770): n = A,T,C or G
agcttncnntnnatnagtnnnggaactngccgcannatcccancnantcgctccgcagcaggcccctgctgtccccccacctgctggctgagctcntnctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagantgtgggtgcagcctggctgttgctcacccaagtgctagctctgcacttcgtgtctgctgagagcaaccaagaccttccatgtcctcgaggcagctgcaactccccgcgagaccccgcanntgggtgggatgaacaaagcaacgcagaccacangcgagtgcctgggaaggagtggnccanggtggttctggagccattgtgggtgagggttnagggccaccgaagtnccgcncaccgntgnctgccctgcactggctttaacaagttngntntgccaaanactnttcaatttaccatcaagccggtctantgtcttcaaggnattggagcctgcgattccttcggggcaccntggggcccccnccggctntgggntcccttggngggaaatgggcccaagccgggctttgcnggtttccttccnttanggg

SEQ ID NO: 2793 - DNA, 806 bp, Homo sapiens
  misc_feature (1)...(806): n = A,T,C or G
tctanctttgngtgtancgcctngcctannagantgggtggncggaagatgaggaagccagcactggatctcatctcaagctcatnttagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggtacggaaaaaggaccagatcaatattgaaacaaagaataaaactgttcgttttataggagaactaactaagtttaagatgttcaccaaaaatgacacactgcattgtttaaaggttagtgctgaattagttgattgtttttaattgaaaagtttaaagntttaattatnaatggtggataaagtgaaataatncaatatttgattaatccaaaagaagaccangaaangaagaaaaagtnacgtttaacaagtgtgcanaatacaaaacanatagtgagatcttagatacttatgcagttctaccgagtnnttaccgtgaaatntaaaaaagggnngaaaatantntccaaggttaaagcctttaaaaantattannaactttggattcaaaaacaaactnncttatggaagccnttttnccaacnaggangtccanccctttaaaatantgaaaggattntgtaaaaaaaanannnttaaaaaaactttgngcnccctttttaaancntnttttgggngggggccttttnnccgtnaaaattccctacnctttgtattanagnacncctttnggg

SEQ ID NO: 2794 - DNA, 737 bp, Homo sapiens
  misc_feature (1)...(737): n = A,T,C or G
tnanttnnnnggttggnngttcttcnntaagatncaancgatncgaattcggcacgagggcacagtcagggagttagttagtgggtagactcagcaggagttggttgctattcagatgtgttggggaaagtgacaggcatagctgactcggggtcattcactaagccaggagcccaggaagacacacagatgcaagcagagatcgtgccattacactccagcctgggctacagagtgagactctgtgtcaaaaaaaaaaagaaagaaaatgggcttgtgtggtagcaggtaagaaattgaatctctgttgtacagcagctagctgtactgcatgatcacttcccattccccagctgacagtggctgtctctggaactcctaccacagtcttcaattggtaggccagccctggtgccagtgattttatctgggcatggaaaatgccacttgcttctgtggaagagacacttaaaagatctggcagtcggccgggtgcggtggctcacgcctataatcccaacactctgggaggtcaaggcangcggatcacgaagtcaggagatggagaccatnctggctaacacggtgaaacccttgtctctactaaaaaaaaangnaaaaaaaaactcgagcctntanactatagtgagtcgnattcctagatncngacatgataagatncattgatgagtttggacaaccacactngaatgcntgaaaaaaatgtttttttntat

SEQ ID NO: 2795 - DNA, 726 bp, Homo sapiens
  misc_feature (1)...(726): n = A,T,C or G
gtaaagtgctcttgttctttttgcaggatccatcgattcgaattcggcacgagggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctnacgacccagcacaggagctggaagccaagtgcacgcgangctcttcacagcccaagaaggcagcctgtcaccctgctctccgaccaagggccaangtgtggggggcacaagccatnctcatcctgncaggccccgctttcagaatggggtggtgccaatgctccactnaaaccct

SEQ ID NO: 2796 - DNA, 721 bp, Homo sapiens
  misc_feature (1)...(721): n = A,T,C or G
gnnnttangatcagctcttgttctttttgcaggatcccatcgattcgaattcggcacgagccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggcttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattcctttttttaaacaatgaacatcggaaatgagactgtggggtgtggtnctctctctctttttttttaattttctttgttgggtttttgagcaacctcatgtcccttccagggagcttttaattacctcttanaactcaagtggatgggaagtagagcactatgtgtcaatatgctttggtttctgacacgattacncagcgaggctttaatgccattgggtaggtgagcttctgcctt

SEQ ID NO: 2797 - DNA, 750 bp, Homo sapiens
  misc_feature (1)...(750): n = A,T,C or G
ggggttttaatgcttggctactngnnctctatgnaggancccatcgtttcgctntcggtggccttnctgtggaagtgacatgctcattttngccttattngtgnacnnggggangnnctaaanttggcctgtntncangggttaaggtcacactgnnctaattngcaatgggaacaccatgtactnagttggntncnnccgtttntaggaaagctttcnttatgcaagggataacatcnaatagggcacttatcccaaatgaatgcagcaatttaaaccanngatgtttacgcatggcaagaacacngttaggcaggantntggggtcaactangctgatgtctttgaacacccatgagctcactggaangtntgnatatcnggtggccgatgggctnngggngtntnntgnttgctcatangcgnaatttaaangnngagttatgtgggnganaatatgtatgtttgcaattacacatggaatgtaaaccaaagatacanttctnagcnccctaaccnctaantggatnccctcntntcanncaangggnntntccacngggaacctgaaacactagttnaggctgtgatggacatgagtgggtggacatgcctncatggnaaggaattnntacncnactnaccttcatgaacattcnancngagacctttaagggtnancaaganatgacttttgngtnnggaatatgaaggtggaattgacacanaggcccttgaaatggnaatgna

SEQ ID NO: 2798 - DNA, 761 bp, Homo sapiens
  misc_feature (1)...(761): n = A,T,C or G
tcnccctnttttgccgctcttgttctttntgcaggatccctcgattcgaattcggcacgaggaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttnntanatgctncttgcaaaactactacnctcatatggcatgatccattnacantaccgtnncnatatctgncntctngctgnaccnntncnnnatctncnntnctcacnncnntnaccnctgnannacgtgacgnagcnctcnctnagatcantganactgantatntntcangatcatntcacaattcnnnctctntngnacnncactgtangncnatcaatctgccttacnannccacancngantgnncanncntgngagaccnccnctttnnnangccaatgcnnnnggatcaccttagnccntngtcctgccgnccctgtnctcnntnnngaaaccnnntcnttactcccaatangnnnnatgcctncnnntntnctnancncgcccntttaantnccancnttcnttggcnaggccccanacactggnnnantnnacttnntncccccaanttngnggannggctnnnannnnaanccnnnatttgnncncaacntnnnnccnnnccngngcntnaatnccatntnnnannnaannnnaanaaccn

SEQ ID NO: 2799 - DNA, 698 bp, Homo sapiens
  misc_feature (1)...(698): n = A,T,C or G
gnntnnnnnnttnnnncacgctcttgttctttttgcaggatccctcgattcgaattcggcacgaggcacaagccactgtgcccggccaatactgcanaatattttaaaaagttaaaattatctcttctggctggtcatagtggctcacacttttaatcccagcacactgggaagctcagtcagaaggattccttgaggccaggagttcaagatcagtctgggcaacacagaccccatatctccaaaaaaataaaaataaataaataaaacagttatcaggctgggagtggtggctcatgcctgtaatcccaccactttgggaggctgaggcaggcagatcatgaggtcaagagatcaagaccagcctggccaatgcggtgaaacttttgtctctactaaaaattcaaaanntaaaattagccaggtgagttggcgggcgcctgtaatcccagcccgcttgggaggctgaggcaggagaattgcttgaatctgggaggcgaagttgcagtgagttgagttcttggccactgcactccaacctgggtgacaagagcaaactcatctatnaaaannaagacactnagcttnatagttntgagatatctttagcatgttntatttccaatgttagaaaattatctttgntattgtcattttgtggtgatactnagctctttgctctgatactataatgngct

SEQ ID NO: 2800 - DNA, 741 bp, Homo sapiens
  misc_feature (1)...(741): n = A,T,C or G
gtntangncngcactncttgntttgtgcnngatgcncgatntnngaattcggcacgagacctcttcttcattgttaaaatggaaataataatactacctagctcgtgggattgttgtgagacaacaacaaatgagacaacagagatctgaaactctgcctggcccctggtatataccaagtccacagttaaattagcctttgttactaaatcattgtttgggtagaaatcctcagattttggatttctcaagtgctccttttctactgtccaaaaggcagaatgttatttttgctcgattccattatgtaatatcctatgaatttgaaatttcggaggaggcacagcatggggctgtggaaatggtgcaggtatctgcatccgaaactccgaagttgtgtggggaggtcctctctcctgagcccagaggcaaaaagctgctcccaagaaatgatctttatgccccacagtccaaagccccacattaaacaaagtctcaagacaagaaggcaatgtgaccctggcccccatgttttgttttgacttttaatttcaaaataatatcattgtgggggggcttatagtttttaacagctgaaagttatatagacagaaaaaatgctcaatgagtagaaaanggaaaaaccttacttttaagaaaacgtgattaatcaaagagatattatgcttgacctcaggccatcactttgaactctgncactggntgnaaaatggcttncca

SEQ ID NO: 2801 - DNA, 730 bp, Homo sapiens
  misc_feature (1)...(730): n = A,T,C or G
gggnntntantatcagctcttgttctttttgcaggatccctcgattcgaattcggcacgagagcctctgatcatcaagacatggcagaataaaaagacaagtcacaggctagctgaagatatttgcaatacataaatccagcaaagacttatatccagagtatataaagaagttctgtaaatcagtgagaaaaaagacaaaccccccaattaagaatagtcaaaagatttgaacaggcacttcacaaaaggggggtattgaaatggccaataaacacataatcattacttatcacagaaaagcaaattaaaaacagaaagagataccacaacctcctccccagaatgtctatatggaaacaaatgtcaataccagggtttgaccaaaaccaactggaactttcacacatttttgctaaagtgtaaactggtacaacctcttcagaaaactgtttgacaagatttttgtttttgtttttatacagttaaacacttaacttatgactaagcattctgctcctaggtatttacccaagagaaatgaaaatgtatccaaacaaagacttgtacaagaatgtcacagcagctttactcaaaatcctacaaactagaaagacccaggtgtccaccaataggagaagggaggaaaaaactaaaaccactttggtgnaatctctgccagtaaggaatgaattactcgtgcgtgtacaatatggatgtgtcaaaacaaa

SEQ ID NO: 2802 - DNA, 732 bp, Homo sapiens
  misc_feature (1)...(732): n = A,T,C or G
gtaatagcagctcttgttctttttgcaggatccctcgattcgaattcggcacgagggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaangcatttgtaatcatgatgaacaccgtgatgactcttgngttcatcactgtgaagaccaagangatgatggtgatagttgtgttgaatgttnggccaatctgaagagaacgacccanaanaaaaaannnnnnnnnnnnnnnnnnnnnnnnaaaaaaacctccc

SEQ ID NO: 2803 - DNA, 732 bp, Homo sapiens
  misc_feature (1)...(732): n = A,T,C or G
ggntcnaatgctggctcttgtgcntnatgcaggatcccatcgattcgacggagttgagttgctaacttttgtccttttcctcagtttccagatgagtttancagtaaagnatgcttttcccaggcncaaattgggaatggaaatcacctagntccgttccctctgacagctgtaatccanagagctnagctgnttacttcattagctnggtataagctgacgacagcagtgcccttgctttatntttgacagagctaggaaanaagccttctttgttnctgctgtaatcatagttacccttganctgaaatatcttacattnattctcaagcaggtagggagagganaaaagacattgcgaaaatnacacctgaatgcctggagcatggaagacattctgtccctagccttttccctntgantttggancctgngcccactatgcccaaagactgagctttctaaancatntatngattnatgttattncnctccctanaaggctttcagaggatctccatggccntacgaagaacttcagatccttancatgctacagaactcancatgatcaggnctccttatttctctaattgatttaaccacngatnctatgtgtccttacattcagactcaataanntncttaaanttttcctgnanaccaannagatnctataaaggctngagccctttaaaactanangnggtcgaattccgnagnaccagaann

SEQ ID NO: 2804 - DNA, 729 bp, Homo sapiens
  misc_feature (1)...(729): n = A,T,C or G
gaaannagctcttgtcttttgcaggatccctcgattcgaattcggcacgaggcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtactttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgccgcctcggcctcctaaagtgctgggattacaggcgtgagccactgcgcccagctatactgnatattttaagaagttccagcatgttgcatctctgcatttatcctatatcattaaaagaacataagttatcatggtgttgggtaaattagcgaaaatcaaccctttctaagtttaagggaaaaagtatttttaaaaacaacttaatnaaaacttacactcttttattacaagaatgtatttcccttaaatn

SEQ ID NO: 2805 - DNA, 729 bp, Homo sapiens
  misc_feature (1)...(729): n = A,T,C or G
gcatgtggctctngncttttgcggaccctcgattcgctggaattagtggcttgctgataatctcattttataatttgttcagcaatccagcangaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatacagtaaagtgcataaatcttgagtgtcaattcaatgaatttttataagtaaacacactttgagagcaagcatcctaagactccacttcctccagaattagctgatgttcaggcataaggttgtttacaggtgaattcatgacacctttgactcttctactgnctcagaccttaggtaacatacctgcagctgcttttctaacaaactgttgatcagcaaaaataaaggggctacagaaacactcattttatgctggtcctctttgggcttcatgccaagacaattctgnggtaaatgtncagttgactctgatttggnaatatgaaaatcaagtccatccttggtattaaaaaattttttacaattgnaattattattgatggtcatattgggn

SEQ ID NO: 2806 - DNA, 739 bp, Homo sapiens
  misc_feature (1)...(739): n = A,T,C or G
gcaaagnggctcttgttctttntgcaggatcccatcgattcgncggcggctctggctgcccggcggtngagagcatggactctccaggggcangtnnggcgcctccggagttaccggagcggaactgcgggtaccgcgaagtctnntactgggatcagcgctaccaangctcagccgattctgccccctacgattggttcggggactantcctccttccgtgccctnctagagccggagctgcggtccgaggaccgtatccttgtgctangatgnnggaacagtgccctgagctacganctgntcctnngangctnccctaatgtnaccagtgtggactactcatnantnntngnggctgncatgcaggctnnctatgcccatgtgccgcagctgctctgggagaccatggatgtgcggaanctggacttcccaatgcttcttttgatgtggtnctcganaanggcncgctggatgccctgatggctggngaacgagatccctggaccgtgaactntgaaggngtacacactgtggaccaaangttgagtgangtgagccgtgngnttgtcccatgcaggncnnnntatnncantgactacatgctggccctcgctttatgggccnaacctntgcccaagnntattatggataggaccctgaagcatgctacctattggnaatgggtttcacnttccattgngnacctcatgctncaaaggccggtaaagcttnaaacn

SEQ ID NO: 2807 - DNA, 728 bp, Homo sapiens
gaaagcagctcttgttctttctgcaggatcccatcgattcgcaaaaagttaaaattttatttttctctcatgtaacattttggataatttgatgattccctaatgttgggacccagtcttttctgtcttaggctcacaactatccttgagcctgtgtcatgggggatgactctgaagctgcgtgcaccctgttcattcacattttcttggcctgaacttagtcactaggctattcctaactgcaagagaagctggaagatgtagtcttccttctgaccagccatgtgctcaaccacaaattgagtttcagttattggagggcagaaagaatagatatggggctgctttgtaggctgctgctcggggcagcctctgctgtgttatttgagatttataattttccttggcttcccagatgacagtggaaaaaggcatagtcaagacttcaagtgcggaaaatgttggcaactctgacatgcaagttcttttccatatagagctgagttatgctggagtattttggttacaaagacttcattttctcacctgtctgaattcctgtttggattttagttactcttgatttatcagcatggattaaaaattgaaaagacttggtattttaaaattatatctgaaatggcagagacagcatctgaggattcctcttgctactataaggaatgagtaattagtttgatttttctttaaatccaaataaataagat

SEQ ID NO: 2808 - DNA, 739 bp, Homo sapiens
  misc_feature (1)...(739): n = A,T,C or G
gnaaancagctcttgttctttntgcaggatccctcgattcgaatcggcacgagacanagcatatgtaccaacaatgcatgtttatattctgtgccatgccaggggcaaattcatagttggcctgtttccataagtgtggggatggaaccttgaaacacaggacatctcataatgctgtaagcagggaccattgaaattgattcctagagtcttgttctacaacttctttaaaaattactgatttgacagcagtatgtattcaacatttaagactttctgnctaattttgagcatacattcttgactaangctagcaattagagattctttctttaatttatcagatatctattaattgtctacttttgagtgggctctgtgcaaggcgctaaaaagccagttactggggttctgttccttaaggatcctganaattgagttgctaagaattaaatcagcaggcgtgcaatatgactgtcaaagcttgacccctgcttngattccctttgttganacaggttcttataggacctggattctcaccacatcctctggtctgtttaagggaacacaaagggtaagctcaactctgtgtccaggagtaccttatagtccctttcccttaactgngtcnggttcaacttgatccaagatcagggattagtacaagctttgtaaaaaaaaaaaaggtttattttttaccaaaaataganccagatgccctttggaaggtaaaagn

SEQ ID NO: 2809 - DNA, 736 bp, Homo sapiens
  misc_feature (1)...(736): n = A,T,C or G
gcnatgcttggctacttgttctttctgcaggatcccatcgattcgaattcggcacgaggagagacagtgagagagacacaccatggggcctgatatggaggcacttacgtccaccaatgctgtaacatttgcattcgttaacaccctttcattaatttattaaatcattctccagtgtaacttctgtagaattcccagtttttgcttttatgaaattctgtagttgatgaacctcagattttacaagtaattgaacttaactacaggagaaggaggagaagaaggtggagggaaaggacaagaaaaaaaagcaagatataactttttttggttcccctcttttaatattttttctaaaattcatactaataaatacaatcatttaaaaatgcaggtatctaaaattacatataaactggtccttcgagtaagtcagagaatgctatttgctcattgttaactgtatttttagtatcttccaaacaaaattctctttatcaaaattatcatttgcagcttttctaggtagtttccaaagtggatgcacgcttatggttggaaaggatccttcttgacaaagctttcacactcagaaactactatcaaatgcagtcaagcacaggaagaaagaatacactgatgacccgagtatgctgaaataaaagaaacataaggngctgctgtctgaattcacactggagtttctttcactggtgtcaagtggtggtaacctatc

SEQ ID NO: 2810 - DNA, 732 bp, Homo sapiens
  misc_feature (1)...(732): n = A,T,C or G
ggatctagctctgntctttttgcaggatcccatcgattcgaattcggcacgagcattagtatttttgtgatttcattttttacacttaaatattgattcatgtggaattcactttgatgcagggtgcagtagggctccagtttaatttttttttagattgctactcagttgtttcagtactgcttagtgaataagccatctttattatcttgagatgtcacttttattatgtactgaatttctctgtttatgttgggtctttagctgtactatgtggtctcttccattgatttgtcttttactgggctgtgtcatactgtttttaattattgtagtgttatattttagtatttggtgaggctagaccctcttcaattaacttttgctttattttttccaaaggaaatttaggagccggacacatatgtgtgttcatgtattttcattgggaatgcattaaatatatagattaatttaagggatcattggcacttttgtgatgttgagtatgtctgttcaggaacatggtatngcttttccatttattcaagtctttcaagtattttttgggagcattttaaagttggcttcatatagatttgnatattnnctttctgngaaaccaatagactncaaaagctttantggcttatggcaaccaaanggttaatttctcattcaccgttacatgccacctgtaggtcaatggcagccctgcttatggttcgatgn

SEQ ID NO: 2811 - DNA, 735 bp, Homo sapiens
  misc_feature (1)...(735): n = A,T,C or G
gtaanntnnnaatancangcttgttctttatgcaggatcccatcgattcgaattcggcacgagatccaatatttattgagtgtctattaggtgccaagcaccttaataggtcctatggatttgaaatgccgtccctgtcttagatctcacggtctactggaggacacagagaagtaagcaggcagttgcagtacaatgtaacactgagtgctgtctgtgtatgatgctgaggagggaggttagcctgagccggggaagcggagcttgcaatgatcggagatcgcgccactgcactctagcctgggcaacagaacaagcccctgtcttaaaaacaaaacaaaatcttcagagcaggcttaaaaaaaaatctccctaggggaataacaattacctgccttctgtaatcatgcatgtattgttacaatgaatgttacaaagttggttacgtgatgttcatgtttttaaactgagttattgtcattttcactcagattctgccacagtaattctgaaagggtttaattgaaaatattttctttctcagtttactcgtttactcattcattcatataaaaaaattgcttaaaatgtcaatcatcggctagaccccatacccaaagccaataactggcctcaagaatttacaatctagtgaggaagacatgtttagacaggcattaaaaaacccaacctagcaccaagctatgtagaactcagagaaccattnattgaagt

SEQ ID NO: 2812 - DNA, 744 bp, Homo sapiens
  misc_feature (1)...(744): n = A,T,C or G
aaacaagcagcnccctgtaaanccctcnntgcnggacccatcgttcgaattcggcacgaggacatacgagaagaaattaaatgtgactttttatttaaagcaaaacaccgaattgctcataaaccgcattccaaaccaaaaacttcagatatttttgaagcagatattgcaaatgatgtgaaatccaaggatttgctagctgataaagaactgtgggcncgacttgaagaactagagagacaggaagaattgctgggtgaacttgatagtaagcctgatactgngattgcaaatggagaagatacgacatcttctgaagaggaaaaggaagatcgtaacacaaatgtgaatgcgatgcatcaagtaacagactctcatactccttgncataaggatggtgcaggtcagaaccattcaatggncaagtgaatagtcagntgaacnggtcagtgaatgggtccaggtcttacccagtgatgatgatgatgatgatgatgacgacgacgacgaccacattgacgacgatgatggngatacgccatgangctttaagggttggagaaaattctattcccacaatttattttcacatactggtgaccctaanagggncccaaataaaaccgggaagaatcccnctttnaaaaatccctggnaaggaaggaagaaagccnaaccgtaancnaaagaacaanccctggcaangggcacttntggccnagaactggccgaccaatnangncg

SEQ ID NO: 2813 - DNA, 746 bp, Homo sapiens
  misc_feature (1)...(746): n = A,T,C or G
ggnntnnaagancagctcttgttctttttgcaggatccctcgattcgaattcggcacgagacgaaatagtgacatgcacttattagatntggaatctatgggcaaaagttcagatggaaagtcgtatgtgtattacggggagctggaatccaaaatccccacattttcaagttgtaaatgaagaaactcctaaagataaagtcctgtttatgaccacagctgtagatttggtaataacagaagtncangagcctgtncgatttctcctggagacaaaagtncgcgtntgctcacctaatgaaagattattctggcccttcagcaaacgtantnctactgaaaattnctttttgaaactaaaacagataaagcaaagggagagaaagaataatactgacactttatatgaagttgtntgcttggaaagtgaatcagaaagagagaggaggaaaactacagccagtccttcagttcgcctgccacagtctggatcgcaaagttcagtgataccttctcctncagaagatgatgaagaggannataatgatgaacctctnctgagtggatctggtgatgtatccaaagaatgtgcanaaaaaattctttgaaacatggggagaactgttgtcaaaatggcatcttcaacttggaatgtgaagacccgaancangttggcattccttagtnaggaaaccgtgtnccttgaagctcttcnanggagaagtctngccacctgcttnccangg

SEQ ID NO: 2814 - DNA, 729 bp, Homo sapiens
  misc_feature (1)...(729): n = A,T,C or G
ggnnttnaaatncagctacttgttctttttgcaggatcccatcgattcgggagaccaggtgggagccactcacagaaatcagtaacatgaaaaccacagccacaaaaccaccactgtcactcaacgcccatcatcacgggcaggacagttctacatcatctccctccggcctgaggcttcccaggcagtgtgggaaggggggctgcatctcctggctggggttcacacctaagtttcctgaggtccaagctgacctggaaagtttctagtgagtggcacatcctgtcccaacaaggggaacacgggcaggatgtgcctgcaccctgggaaaagtgttgtctccgcacacggggaagaagttgtctgggggacagaggagttccaggtagcaaacacaggctacagggcaagggttggaagaggctggcagctggatgtgagacagccaggtgggaaggggtccccaggcccctccagccggcctgtgcactgggaggggtgcacactggggtggagcccacagaggtttgtgccatttgcggcggggagaacctgccctcctcttcctgggtggaattcaatctgtgaggcangaagcccatggcaggaaacacactatcttgctttgctganggtctctatttccctttttttttcctttttgcccaataaatccctttttctacttcttcaaaaaanaannnnnaaaaaaacttgagcctntaaaat

SEQ ID NO: 2815 - DNA, 711 bp, Homo sapiens
  misc_feature (1)...(711): n = A,T,C or G
caagctcttgttctttttgcaggatcccatcgattcgctctcactagccctgggcacttcccactgcctttgtggacttctgtttgctcttctgtagaatgggataacagtgccagtcctgcttactatttagggttatgtgatgcttgcagatgtacagggaaagcaccgctgatgggagctgctgaagtttctaggggaggtgaaggtggcgcctcctcccctggtctaagtggtagatggtgcagggagaggagaatttcattctgtggcagcagctgatagattccaggtctttaatactacctgggaaaccttaacaaagcagtcagtcaccaaaactgacctagcttctgagcattgctaaccatgcttttagagaaacaggagaattgcttgaacccaggaggtggaggttgcagtaagccaagatcacaccactgcactccaacctggacaacagagcgagactccatctcaaaaaaaaaaaattgtgttgcctcatacgaaatgtatttggttttgttggagagtgtcagactgatctggaagtgaaacacagtttatgtacagggaaaaggattttattatccttangaatgtcatccaagacntanagcttgaatgtgacgttatttaaaaacaacaaccaagaaggcagaccnggatatactngaaaaaggatgcttttttttttttactccctctaac

SEQ ID NO: 2816 - DNA, 739 bp, Homo sapiens
  misc_feature (1)...(739): n = A,T,C or G
gnnntnttaatacntnaggctcttgttctttttgcaggatcccatcgattcgctctagcatgtgccataaattacagtgacctttaaaatctcgcttggtcactgctgaatgggtgagaataggcttggttccagtttttaaggtcacactgtcctaatttgcaatgcatcacaccatgtactaagttggtaacaaccgcttagaggaaagctttcgttatgcaagggagaacatcaaaaagggcacttatcccaaatgaatgcagcaatttaaaccaaagatgtttacgcagggcaagaacaaagtaaggcaggagtttggggtcaactaggctgatgtctttgaacacccatgagctcactggaaggtctgaatatctggtggccgatgggctcggggtgtctcgtcattgcttagaagcgaaaattaaatgctgagttatgtgggtgaaaatatgtatgtttgcaattacacatggaatgtaaaccaaagatacaattctaagccccctaaccactaaatggatccctnctctcagccaagggcattccaaagttaacctgaaacactagttcangctgtgatggaaatgagtgggtgggacatgccttcatggaaggaattcagacacaactgaacagcatgaacattcaaacnggagaccttaagtctacaaaaccagactctttgtagccattaagatgcttgatatgacagaaaggccctgaaagcaatana

SEQ ID NO: 2817 - DNA, 730 bp, Homo sapiens
  misc_feature (1)...(730): n = A,T,C or G
gtnntttttntatccctttcnanttgctctttttgcaggatcccatcgattcgaattcggcacgagagtaaattcagtgtttctgttgccgaagagtgtttattggttctttcactttcatttcatagggccctttcttctactggcattctcactttgaattactaagaagtttcttctaatatccctctatctcctttttctttctagttttagataaagctgtcaaaagaacagttatcatagaaatagaaacatttaaattaccggcacgatagcttatttcttgctgcaaccattcagaatatctatttgtcactgccttgggtgctttgaagtgaaactgtgcttagatataaaaagtttaaaactcactttgattacatgttaagctcacagtttttacactgcagttcctgaatttagttccatcaaaactgtatgactaggccacatgtgatggctcatgcctgtaatcccagcactttgggaggccaaggcgggcggatcacctgaggtcaggagtttgagaccagcctggccaacatggtgaaaccctgtctctactaaaaatagaaaaattagctggatgtggtggtgcgtgcatgtagtcccagctcttgggangcccagcaggagaatcacttgaacccgaaangtggangctgcantgagccaagaatgcgccacggnactntacctgggtgactncatctcaaaaaaaaaaaaa

SEQ ID NO: 2818 - DNA, 727 bp, Homo sapiens
  misc_feature (1)...(727): n = A,T,C or G
ggntttnatcagctcttgttctttntgcggatccctcgattcgaattcggcacgaggccttttgtggggtctcatacataactcagtttccacaaagctgtgccccagctcagccctatggatagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggcaatgactttttagatccagcaccaaaggcaggatccaggaaagaaataattgataagctggacttcattaaaacgaaaacttctgctctgtgaaagatgctgccaaaaaatgaaaagacaagccacagactgggagaaaatatttttgatggaaatatctgagaagagaggcttggtatccaaaatatacaaagaatttctaaaactcaataatttgaaaataaacaacccaatttaaaaagtgggccaaagatcttaaatgacgcctcaccaaagaagatncncagatggcaaataagcatatgaaaagatgctnccggctggcacngtggntacgcccgtaatcccacactttgggatgccaaggcagn

SEQ ID NO: 2819 - DNA, 730 bp, Homo sapiens
  misc_feature (1)...(730): n = A,T,C or G
gtnnnnnnnnnnnaatgcttggnnnnntccngacccntctttcgaattcggcacgaggtgagatacctgcccctactttgccttcttccatgattggaagcttcctgaggccaccccagagtcagaagccgctatgcttcctggacagcttgcagaaccagtattcactgactgctgaaactagagcatcactgagaagcaagagatagactgacctaactagagggagagctgccatccaggatgatgccaccatcacaggaggtgagaaggaacacagcatcttctgcaaatgctacagtaaatagggacggggtgcagcaatgtgaggaaagtggaatgaacttggactttgaaggcaaactaacctggaatcaaatactggctctgctgtttgcaagtgtgatctttgggtatgcttcctaatctgtgagcttcaacttcctcctctgtaaaccaagatcaaagacaaacagggaaacctacttgtctggtgcccatccccttggcagaacactcctctgaaggatgacagtttggctgtgccagggcaganctgncgacaccaaatgagccttcatagcaactatctgatgaggaactcactggcctacctttccttgacagctngggcctgccaccttgaagcatgacttcacaacgnccctacccaanggcatggangttgctgctgatgagcaactggttatatttaatccaggttctgctn

SEQ ID NO: 2820 - DNA, 727 bp, Homo sapiens; identical to SEQ ID NO: 2818
  misc_feature (1)...(727): n = A,T,C or G

SEQ ID NO: 2821 - DNA, 733 bp, Homo sapiens
  misc_feature (1)...(733): n = A,T,C or G
gnannnnctaatgctcggctngttctttttgcaggatccctcgattcgaaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtgtaggaggaagtttttctccctttnctgcatccttcctttgngcgtaaaatagaaatgtcttccttctgaaggattcaaagagaatgttggcttttctttcattctc

SEQ ID NO: 2822 - DNA, 739 bp, Homo sapiens
  misc_feature (1)...(739): n = A,T,C or G
cgcatttttaatncagctcttgttctttntgcaggatcccatcgattcgaattcggcacgaggttgtaggcctccttcatctgttcattggctgtggcattaggccagctactctttgcacttctgtnaagtgagacggtcgatcttgtctgcctctctagaggatggctgcaggtgtcaaatggggtagttaggtggganggcatttcacaaagttaaaaaatatgactttggaggcttgttatattgatgaggattataatccctgagaattcctggtatgaaaaagggaaaagaagataatttgtgaaagaaataagtgtccagttactagtctttgaaaagggtcagtctgtagctcttcttaatgagaataggcagctttcagttgctcagggtcagatttccttagtggtgtatctaatcacaggaaanattgtggttccctccagtctctttctgggggaatngagcccacttctcatttcatttaattagatgaaatagaactcaaagtacaatttactgttgtttnacaatgccacaaagacatggttgggagctatnctttgatntgtgtaaaatgctgctttgtgtgctcataatggttccaaaaattgggtgctngctaaagagaagatactgttacagaagccaccnngaagacctctgttcattcacaccccccggggtatcaggaattggcttcnagnggtgtgccaaatccngtttgcctatn

SEQ ID NO: 2823 - DNA, 730 bp, Homo sapiens
  misc_feature (1)...(730): n = A,T,C or G
ggttnaatagnagctcttgttctttntgcaggatcccatcgattcgaattcggcacgaggatgtcctgctatacaccatccactgccctgccccttaagcctcacatctttcatctctcctagttccaacccatggtctccagacgatgactctgcctccctgttctggtagcattcacagattgccttgtttagtagcctttcacatgagatccacttgacagcccctgtcctcacccctcctcaaactcctcaccacactgaaactcttccagctccatgagtaggttcttgggtggtttcttcacctgcaggttcaggtcaatgctcagccggggactcgacagggatgctttgcaggtctctggagtgctctttgtgcagtccctcctctgtggtactctgcccttgaactctcactgccttggcctccccaaagtctaaactttgtctcctcaactcagaaagtcctctgggctctgtctgggctccccttccctgtatgtggaattaaatctctctgcangcaggaagttggggcaatcctagggctcactttgttatcttcccatctctcagggatcactgtcctgatgtctattgncctggaaaccgntgtttcattttttttctngnnntggtttaaacattattttttcangtggganggtaaatcagctttgntactncatcttggctggaaattcataaccnaaggttaactgtttta

SEQ ID NO: 2824 - DNA, 739 bp, Homo sapiens
  misc_feature (1)...(739): n = A,T,C or G
ggtttatatgnngctcttgttctttntgcaggatcccatcgattcgcgccgccccactcgccccagccgccgccatgaaggccgnggtgcagcgcgtcacccgggccagcgtcacagttggaggagagcagattagngccattggaaggggcatatgtgtgttgctgggtatttccctggaggatacgcagaaggaactggaacacatggtccgaaagattctaaacctgcgtgtatttgangatgagagtgggaagcactggtcgaagagtgtgatggacaaacagtacgagattctgngtgtcagccagtttaccctccagtgtgtcctgaagggaaacaagcctgatttccacctagcaatgcccacggagcangcagagggcttctacaacagcttcctggagcagctgcgtaaaacatacaggccggagcttatcaaagatggcaagtttggggcctacatgcatgtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaagggaaagaaacacttcccgaaaaggaagaccgcaatgccagcaacggggctnaaggcgacgttgtncttttgaacgggaaccgtaactnaaganggaanaattantntgttattaat

SEQ ID NO: 2825 - DNA, 747 bp, Homo sapiens
  misc_feature (1)...(747): n = A,T,C or G
ggttctatagctggctcttgttctttntgcaggatccctcgattcgaattcggcacgagcctgtgtccagcgtcctcggttcaggggaaatgttttggtgttcatgagtagtatgtcccccagtgccccattgtgtgggcgtcctcatggggtatccattcttctaggaagatcctggggctgtttccagttcgaagccattattaataaagctgcaaggaagaaatatttttatggatgtgtgtttttatatctctgataaatatattcaactggaatcattgggtgtattgggccattctcccattgccaaaaagaaatacctggccaggcgcagtggctcacacctgcaatctcagcacttgggtggctgangcaggtggttcacctgaggtcangagttngagaccatcctgaccaacatggcaaaaccccatctctactaaaaatacnaaaattggctgggccgtgggtgtcaggtgcctgtaatcccagctacttggaagactgangcaggagactcgcttgaacccaggaggtggangttgcantgagccgagatagcaccattgcactgcancctgggcaacaagagccaaaactcttgtttgaaaagaattcaaaaggaataccttgagcctggtgagcccaagaatgnactactgnacttccagcctggggtgacaanagtgagactgtctcaaaaaaaaaanaaggggattttttaaaaaaaagcccttttgaacn

SEQ ID NO: 2826 - DNA, 728 bp, Homo sapiens
  misc_feature (1)...(728): n = A,T,C or G
gggtttaagatcagctcttgttctttttgcaggatccctcgattcgactcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgtncttcccactagtaaaagcagccaaatgatcaccttcacctttgctaatggangcgtngncaccatgcgcaccantgggacagagcccaaaatcaagtactatgcagagctctgtgccccacctggggaacagtgatcctgacagctgaagaaggactggatgactggcantgcttttgna

SEQ ID NO: 2827 - DNA, 729 bp, Homo sapiens
  misc_feature (1)...(729): n = A,T,C or G
gtnnnnttttgaanccttgcnnttncctttatgcggatcccatcgattcgtgggttgactcgctacatcagctcagacttggctgtgggtntncccttgtgaattgttgtttccacatgtgtgttgcttcatttttggctctccgttgtccccatcaccttcccgtctcaccatagggtttagggtattttgctgtgtgttcaaatagaacatgaaagaagccttttaaaagtatttctgtgcctattcacagtcccctaaattttattacagtttttacgttggtttaaagagtattttggtttgatttatatggaaaacttcttttttaacattatagtaacatagatttttaaaaaatgaaattctaggaaacaaatattatagactagttagatggcaaggagaacaggagttttagaactaacttttaatctccataggtactagttgtctggactagctgagtcatttcatctcagtaatacttggtagtgctgtgaatagcagatcttgcatgcacagaacacagcccagtacctgcatgtgacaggcactttattttctggtaaagttaagtacagttgacccttgaacaatgtgggggttaggggaaccaaccttccacacagtaaaaaatctggggtgaacttttgacttcccaaacttaacttctaacagcctactggttactggaagccttgctgatnacngaaacagtcaattatc

SEQ ID NO: 2828 - DNA, 775 bp, Homo sapiens
  misc_feature (1)...(775): n = A,T,C or G
ggttttntggnngggggttttcaacncnggctcttgttctttttgcaggacccatcgattcgaattcggcacgagcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgctttattttttattttttgagaggtatgattctttctagagattttttctcatggctactattagatcaggaatgggtgattggagattattagattctaggttaacttctaccactttaccctaatacataaaactttttcctaaatnaatgatggaaggaatnaannnnancnnccncntnnccnctantacaaaancnctagcccttanaacntttngnnagctnnnttnncctnnntntcccntnntcnnnccccnncctnnttntnccnnnctnnctcnanccccacnanttncnntntnnnctncnnaatanattncncncntnnctcctcannnnctnntcnnnnctcnn

SEQ ID NO: 2829 - DNA, 725 bp, Homo sapiens
  misc_feature (1)...(725): n = A,T,C or G
tcttttatnngangttnggaagcncaggagnctcnntcgttcggacaaatcacttaaggagaaagtagaaaaaaagctgtatttttcaaagaggtattctaatcggcaagacaatgaccaaccattacgaccaaccattatgagaatatagcttagggacgtttgtgctcagctcctcttttacccaatgtcaatgcctgcctcagtgtattttcttctggaggagagttttgtggatgccatctttccgttacggaaaaccantggaggaatgggcagtttnttgccatgacccaccatcatttaaacaantggngtttgagttcagaaataagctcatatatacttgaattccatgggttaaataagccattgagttaaagtggtangaaattaaaggtagaaaatagaagaatagggtgggcttggtggcttatgcctctaattccagcactttgggaggccaaggtggaggatgacttgaggccaggagttcaagaccancttggncaatatggtgaaaatncatctttactgaaaataccaaaaanattagatgggcatngtggcctgtgcctgtaatcccagctactacagaagcttgatgccccagtattctttgaaccttggangttgaagttgcantgaacccaagatgcccactgnactgganctgggcaatgaagtngnaccctgnctcaaaagaaaanaatnttaaacaactn

SEQ ID NO: 2830 - DNA, 841 bp, Homo sapiens
  misc_feature (1)...(841): n = A,T,C or G
ctntngggcccntagnnggggctttcnatanggcgggctggtngttctntccgnacgatcccnncgntgtcgcagngttttgagcagagcaagtgacactatcagtacttaagcattaaaagaattgtccaatgaatggctgtgctgaaaatatatnngaggtaaagtaagctagaggcaggggtattgaaatcaggctaagagatgtttgtggtttgaattaagtggtagcaggaggtgttaagaattagtcacattgtgtatgtattttgaaggtacaaccaacaggatttccaggcaagatagagtgtgatgtgaaaaagaaagaaaggagtcagtagtgactcangagtttgtctgagcatccgaagtgtggaatttcatcacatcctganaggtgaaagaggctgtangaggagcaatatgtgggaaagatcagaagttcagtttnggacatgccaaatattacttggccaaatggttngggtggatgatngggcgatcntgagtcatccctnataaaatcggcatgcanatngcntttaaaaaactccagactggntganatcccaagttgttcgattgnaannacngngnnctcntttgnnantgctccnccntttaaagccacttttggggaaacccnaccaagggacantgnaccatnncnnnattcccttgggnnaacccccncnaaagtaaattanacgcnaggccntcnntccanccnntcaaaatnctttnntctnacntccancacnctttttantcaaaaatttnnctctcccntatannccnnnctnggcnntctttcnccanctttnggnnanctntnccncct

SEQ ID NO: 2831 - DNA, 803 bp, Homo sapiens
  misc_feature (1)...(803): n = A,T,C or G
cnnncnntcnnatgggnnnntgtanggnctcctccaatctcctggctgcncctgantcgcctaaacanaaaggctggggcgaattcggcacgagattaaagttgaagcctntctaatttttgaaggttgagcactttggttattcatggttttatatgacgatcatcttttatccatcgctgcagttatctattttgacttgaattggaggcagagctccaccaccccagtgtgtcgtctgatttcccagactanagtccagcctttcctgtgcttgcctggcttccctccatgtngcttcctaccccaccatctatacccttcacatccaaaatccaaaacctcacactcatacgagaatccctgntagggtcggtntatatttacacactaaaaatctctaattttgaatttgttgtgcctataaaggaataccangaataccttaaagttataattgattnattagcatctattttangtcatncttgggggantgatggaaagaatccacatagactccaganagatggncnangngtttacctgcccagccttgaaacatttcctctttcctcacannggatgggctctcccataantaanttcatngggcccccnaagctntaaagnaaaaantaaagtgtctttctcatttttaaaaaanngcaacctttgcctgttcaaaatatgtccaatncgaanccccgnaaaatgtttaaaaangcnntctntgggctcnaaatggnggttcaanggtncnncctgacctgncnnttctgcncnaanncattntccntcct

SEQ ID NO: 2832 - DNA, 755 bp, Homo sapiens
  misc_feature (1)...(755): n = A,T,C or G
tnngngggtttgnggggctttcnaaatgnngtcancgctggctntcngcaagatcccatcgattcgaattcggcacgagagaaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcatangaaagatcatattatgggaatgataatcctgttactgtggattaggtatagtgccaacagtttgaatggtaagacaacataatatatatgatagtgatgaaaaanaaaaaaaaaaaactcgagcctntagaactatagtgagtcgtattcctanatccagacttgataggatccattgttnanttnggcaaaccnccacttga

SEQ ID NO: 2833 - DNA, 883 bp, Homo sapiens
  misc_feature (1)...(883): n = A,T,C or G
nngtggntttngtgggctttcnaattccnntaatcgctngctntccgcaacatcccatcgattcgagcaagtcagcaaatgtgggagatggaaaactggcttcctncacccacctaggttctttggctgggctacaaattaaatggacataaaatagattaacaggagaaaaaacacagnaattatgtgtatatgcctgggagtcccacaaaatatgagactcaaaagaagggtccgaagagggaagcttatatagccccctgagccacagaaaggaatagggacctggggcttctggtgggtggtggagacaagttatggaagagtgaggggaggaagtgtagggtgagtaaatgtggtcttgttatgcccataaaatctcttggtacatcacagntgcctggagcanccncagtcctgatagagatactttactaatgtagattttcttgatggatatcattgtgttttacaaangggcagcttttnanagccactcctgtgtctgcaattttctcagnataacccagcccccaaatattgacaaggtnttagtttggggtgngnaatatncctggccttccctaccangttngcnatttttnggggggttgggtaatttgctnccccgaagnccccccaaacccaccangnaaanaaaggggaagggggccaanntnnnggggaaaatttttaaaggnaaattttttccaggnattnaaaaggccatttcctcnaattttttgggnaaangggaanccaagctnngcangggnaanggccttgggaacccaannantnagnaaaaaggtnnaaacctggcattttngggaaaanaatgncaagtttttggaaaaaaacccnnttgtancaanngttttnt

SEQ ID NO: 2834 - DNA, 1090 bp, Homo sapiens
  misc_feature (1)...(1090): n = A,T,C or G
tggttnttnggggggnntttngntcgancgctntnngcctngtccngncgcnggancccatcgattcggaaatatacttccttaaatgatggncattcctaaatccatctaggaatgttggatgtatctatctatctatntatctatctatctactgnattaagccccntctcaaaatngtagggtcagaagtatggacngataattcataatcaagttcttnttctttatgcccagaagtctgnatnctgcncagacttgcntacccctagctgcgctaaagntcanaagntttgagcngccactgaagtattgactgtggagaggcggtgtatncctgttnccaatgangngcctttctgtccaggatnagccttatcggnanttncncnaggaagttgcatngcnttcagtccatttnnggcttanagccncncggcnncncacgtgttccttatttgttttgacggagnggtcntcnngctcnatntctttacnctgattctgctntttcatcnangtgnnccttcctcannnttattnagtccaaaggnngaatncngggttannctatnnnggcnannatcttnntnttctngnaatccncttgggntctaataccnttgtcttcaccnancctttttaacccctcttactctctccnttaanaatanacctcnttntatctccncttnnnacnttataantttngnattgggncnannggggaattttncanactagtcctantgatnntctctccgtccttantctntntttatncacanntacncgtnagntnnaanancaaccntctcngggnngngccccttctttnanaganaaccctntatntnagttnggaangngncccggctatntttatcccggttangnnaattcccccanggcacctcttgggaatttaangggatncccccaatttnngngatctggaaagtnttttnggggggcaccctaanacncnnacacnaanncttntgggaaaattggcccanntgnnaaaaaaaaaaaaanangggccctcntnaaattttnggnnggaaaaanttttnggnngtanctccnt

SEQ ID NO: 2835 - DNA, 807 bp, Homo sapiens
  misc_feature (1)...(807): n = A,T,C or G
tggttnnntnnanttcgctnactnaanatcgntccantnnctctgtntacgcnaagcaancnggcnggnctaattcggcacgcagatttcagcctgggcaacatagtgagactcntgttnntaaaaaaaaaaaatcccacaatcctatcacacagagatggcaacacttagcatttgttctggtcacctttggaaggaacttttanatcaatgtcttgcttctctgtgggttcttttgtgactcacacctgcttctgggtatagtatgactataaagttgatttcttgggtaaggcatgatctatgagaggaagctnntaattngatgancatcanggtaatnntagctgggataccttttctttgccctctccaatcaaacntgagaagttgaaaatnnaaaattatgcttttgaaggcnttgntgtnaacctaaaatataactcaagtgatctgtagttntccatatgtgcactgtcaacagctatttgcttttcaaatccaaactantttcatnaaagaaaaccantttggagtgtattcagcttataattngnaagctagacatgaaagnnttnaaaagccnttntagcctagacnacntggcccncatntttnngtnanntcntgcnttntgggaacttgnncnatgctaaccccantaccncccatcntgcnncctcctnttaaantgccntttgaaagngggcaaaacngnantagnaccnnntancctntcaaaaggttgnnnngttncttgcaaaatggaagcccnggccttttaangggncggncttttcctttncc

SEQ ID NO: 2836 - DNA, 752 bp, Homo sapiens
  misc_feature (1)...(752): n = A,T,C or G
gnnnnnnnanggggggtttcantctnnctgcagccgttttcgttctttnngcagatcccatcgattcgaattcggcacgagaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgnccaaggaagacagggaaagtcttcagatggcantaggcccattcctccacatcctanagagcaacctgctgaaagccatggactctgccactgnccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctanggagtggtttgtgcaactctattaccacnggaaggagcangtgcccagaggttgccctgatgggctcttgccnctggacatgttcttgaatgccatgtcagtttataccttaagcccagaaaaataccctgcactctgctttcaaactcaggtganngaaattggaaaatnaana

SEQ ID NO: 2837 - DNA, 745 bp, Homo sapiens
  misc_feature (1)...(745): n = A,T,C or G
cnaatcgntgcgaattcggcacgagcctgaacctgcccatggagacagttgtnttgagggttgccacacacagtgagggcggagcagggtggctgagggcacaggtgcctgggtctgtcccacggggcanggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttgggttgcaccggcccagggaggaagccnngggtttgtcangtgggctctcctggaggtcctcnagtggcangggtgacgaggggattatntgangcatctgganatgtatatcctgtggnntnccctgcccctctgnttccgatgaagtgtaccgatgaatgaccttgactaaaanntnagtttgccacananaaaaaangggaggnttantgggnttcnaaaatcaagnaatggtngcaacctnggccttcgcagaatggaaantacnaaanacggggnaagatcctcatgnccatttcccatggnnttggnccagnttttggaggnattctnnggncccggcaaaggccccatttnaaanttnatctagncnggnaccnggnctattncngnctaagggnnttgcncttntccttnaacncatngaatcccttaaatnant

SEQ ID NO: 2838 - DNA, 719 bp, Homo sapiens
  misc_feature (1)...(719): n = A,T,C or G
gtngnggnagngatcgtganccctctncctttngnccaggcancccatcgattcgcaaagatctaatgagtcacaggatgggggangtttttgggaaaggtcnggattagcagagttgcggcagaaagaagtagaggggaatatcttanaaggcacttggacagaatgggggtgatataaaagatgtatgctgacattntggttttggcncctagaaaatntagcanaaagngagaatnngtgccatacatccngntctgcaccctaatatggaantttgncnttccacacnagnnttcctncacaattaacctntaaggcatttnatgccnntgcctccacancnnggaanagtacgacaaacntcctanangactaganaaaatngcccnnttcaganacattancagtacgtgtggntagaactaaaatggctcncaggctcatactggnagtgancaggnatgcaganaaaaangaaaacccccangtgtcantgactgtgaacaggcctantncagangcncttattgngcaatngcccttaaganattgccccaanganncacctgannaccccccggaattgccggaaaagaatacngatgaggagctnacgcttatgngaagatgnatnaaccctatgttcagtgtaaacggggntacaatncnccaaanagcgnanctcaagaacnagccttcccgnnaggcnatcccaa

SEQ ID NO: 2839 - DNA, 786 bp, Homo sapiens
  misc_feature (1)...(786): n = A,T,C or G
cngaangntgtgatgnatgtagncgttcccnaggaanccangcgattcggnttggcgaattcggcacgagcccaggtgtctatccacttgctagnatttnntcatgagagttagataccagttttctgctggaaatacagaacatttcctgaaaccgtgtggttgaggtgaaacaggcattttgcagtcttatattttgagtaaggccaaacctgcctagtgttataaaactagacaaaaaacccaggtacccggtcttgcaggatagaaatgtgtgactaaaatgaagcatcgatctgagaagactacaaattagcgggaacctttggacaggagcatgctatacattacttagattaatgttgatatttaaggagccangatnttgatnngtntttgaggggtgcccatntacttcatataagaggctataaactgnacttctttcagttantgcttaatccnagctcaaacaagaaataattgcttattccaaagtagacattggnacatctttttctaggnacgtaatctgngatgaagtctgataaagctccttaagaaattcttatagtacaccctcacaagantgtattcatctacccgtggtttaaaccngaaaattaaaaattntaaccctcgnnggagaaaatttaccaaagtntttaatgggtttcaggncccttaattaaaaaaactttttaacccctggccttggaaccctttaaaccttaattnatnggatctnaaaaacaaatgggntttnttgnnngaaaagtcnnanct

SEQ ID NO: 2840 - DNA, 739 bp, Homo sapiens
  misc_feature (1)...(739): n = A,T,C or G
tttttggntgtgtggtcgccctcncctannntgcaggatcccatcgattcgctggaaggttactgcaaagacagcctggtgaaattgttntnagtacagaggctttaatgggttctttgaggtcaggtagaggttatggggggagcactacagtgagcatatacccaaaatgaagccagacttccaaggtacgttctcactggagagggagcttaatggtaaagtttaaactttaagggtttaggttttagattaaggcccaggagatccaaggggaangaggagggtaggaaatcananataagaggagctgttgtcatcgcaggtatagtnataattaanatatgttaaactttcataggattttgcatttatttcatcagnttttttttctagattcttaaatctgcatatatctaaatcttataaatttggggaaatgtacacatttacatggtacatttcactcaattttanagnntggctnttcttgtgaaatagaattaaatatatgtgagtaaatcaagacccctaaccatcattaatgtattatttggttatttctggccaaggcccttcttgattctttnaaagtgtgctaagcccattttcttcattacatccctcttattttttgtggccaaattnactaaaatntangtatcttttggtggantttcanatttttgaaacctaccttgttttgaaaatncatcttttaaaaacctnttttccaaaa

SEQ ID NO: 2841 - DNA, 767 bp, Homo sapiens
  misc_feature (1)...(767): n = A,T,C or G
agnttttnaatcctttggccantcgcnctttntgcangatcccatcgattcgaattcggcacgagaaaaagtnaagcttttcatgagcacanntnccttgcattgttngatgttactgatattcgtaaaatgaatattttctgttttgttctgttnnatttttttgagacaagtcttgctttgttgcccaggctggagtgcaatggcatgatcttggctcactgnaacccctgccttgcgagttcaagtgattcttctgcctnagnctcctgagtagctgggattacaggcgctcaccaccacacccagctaatttctgtcttttnagtngacacagggttttaccatgntggccaggctggtctcaaactnctgacctgaaactnctcacaccngtnatctcagcactttgggaggctgangtggaaaggatcacttgaagccatgagtttgagaccagcctgngcnacacagcngagaccccngtgntgtacaaaagcttncnacatttanctggctgaggagtnnctcacccntaacttccancnantcnnttaagcnnanncatnttgaacacntgagcccanntanggtcgatgctnntagtnaaccgtgactggaccacttacagtccaagcccgggtngccttataaaagaancggaaaacatttcnttaattcgggttnnagcnttanctatttcggaatnccttgngttttnaaaaacttgaatctccaanaaacagggttttttcttttggnccann

SEQ ID NO: 2842 - DNA, 873 bp, Homo sapiens
  misc_feature (1)...(873): n = A,T,C or G
cgtacggaactgancgggaaatccctcnctgcaagcagcccangcgacgcgaattcggcacgagacctaatttttgagaacagcaagccctntttgaccactctcttcagcctgtgtgttccggctgttttgaagtaatcaaatgctgtgcatggtattttacctgagctgcaacctgntatggacntgaacntcnggataagntgaaagcaagagtccctgagtataaaggaaaaacagcanaacaaaaagcaaacnagggncaaccgcgaaagnctaaaaagncccantggtgangcccnntaaaanaanctagcttncagctgtcaggagctaatactctctgnaggaattgganatgggatnagggcgaacaananagggtgtaaacngtggagctggcatgagtactgcangcaacctgaagagacttttaacntantnaccacagctattnatnatgcggtnngcaacaaaccagcaacnatcnacaagcgtcataaagaagttcagactntgaacaattggngaaaggtngattncagaacccgnctgcaaaaaagccatcanncaccataantaaaaaagaaccncangaacanggggaaacccngtgggaanaaaggaagtanaanntngccacctcangttnaaccattaaaaaccctnggaaaanntggccannagggaaaccccttaaaangcaaaagnncctnggcnaaaaaaanccccggggaatttaancccaangggncccaaaggntnanntggggccnnaannggggnaaaaaaangggggcnnggaaacccccaggnnnaantncnaaaggggaaaaagnaaaaannanggggggncnnnnnaaaaaaaaaann

SEQ ID NO: 2843 - DNA, 777 bp, Homo sapiens
  misc_feature (1)...(777): n = A,T,C or G
tgggtttnnggnttngggctttcttnanatgntgtaancgctgctngccncancannntggctggncgaattcggcacgagaaatggggggtgttcttcatagtggatttctttttttaaacataccatctttgtgtatatacatttctctggaaatgtttgtgaaaaggtaaagataacttccttagtgtaattgtgttgaagtggaatgtttctagtgtttgtgaagatatcaattgctggctgatattttaagctggatgaaaaatgtgggtgaagtaatcttaaagggtgatagatttgatatgagaaatttaaagtaatgtgctcagtgcgtagtggtgataaaagaatgtagcctacttgttttccatagactatatttcatcattgttgcataaagtcccttttggccaatttagtgaatgctgctgggtcttcaggaaagaaaatcgtttgtctttaaccagagaaataattgtggggatagaaagtagtctttttcttgatgataaaaattcattttanctttttaaattacagtggtaatagcttgtagtaatagnggtaatatccttggtttttggctaatgatttttantgtgctcccncttaatnttntnncgaattattttnanngtgaccaaacccntntatnnnacntngccttnaacaaatccncncttnantnctctncnccnnaaanncnnnncanctcccncctnccnccccnnntcncctnacncaccccccncnccnctctcnctccnccccccc

SEQ ID NO: 2844 - DNA, 892 bp, Homo sapiens
  misc_feature (1)...(892): n = A,T,C or G
tntagggccttnnnnannngggtntttcttntccantannccgtgtggtctcgttctttctcnnannancnanncttgtcgctgggctcaggcaatncacctgccttggcctccaaagtgccgggattgcaggcataagccactgtacccggccccaactaatttttgtattttttgtagagatggggtttcaccatgtcggtcaggcttgtcttgaactcctgagctgaagcaatccacccgccttaccctcccaaaggtgctcagattacaggcttgaggcactgtgcctggccatgggtgccatntatctaaagagtgatgaacttggtgttaaaccagtaattgaaatcaccaaaattcctaccatcatgagctcagtctanntggangagacagatgaaccaattangcanntctgntgaattttggggttcancagtgcccanaggtggggtgtagtgaagaggaatgccanaattttggagaggtggagcacacgacccacgggtactttctgaggatgtaacncanaagtcgtgatcagaaagganganaggganacanntggggaaantnnctgggaaanancngtcnattccaggcagtcagcttgctnnancncnttgggccttnctttnanaacnccctttgcctttggaatnccttgaacccnaagttttcaacttnaaaagaaattcctttgggnnanngaaanncntatatcacnctnntatnacaaaaaaacnttccnaaanccncttttttanaaaaccttttttccctngnnaggtccccnaatttttaaccntangnaattccccntaacctttgntatttaagnattncccatttnggnatcaanntttctgnggaaccnaantccccccct

SEQ ID NO: 2845 - DNA, 768 bp, Homo sapiens
  misc_feature (1)...(768): n = A,T,C or G
gnnnnncnnnntgncnnnnnnggggggntttnntttttccaaanggcgtggaactcgttctntccgcaacagcccngcgnntcgcttcttctcaactctctgattgcttatataagtgacgtcttctgaaggaaagttcagcattttttctcagatatgataataatatatgctaagatcttggccaggcacggtggctcacacctgtaatcccagcactttgggaagccaaggtgggcggatcacttgaggtcaagagtttgctgccttcaaatcaatcattacttcttagcacctcttgaaatagaaaataaaaaatttggccaggcggtggccaggcgcagtggctcatgcctgtaatctcagcactttgggaggctgaggtgggaagatctcttgagcccaggagtttgagaccagactgggcaacacagggagacctcatctctacaaaaaagaaaaaaaaaaattaattagccaggtgtggccccatttgtacaaaaaaaaattttttttaattagctgggcatggtcatgtacacatgtggtcccagctactagggaggctaaggtgggaggaacgcttgancctgggatgtcaaggctgcggtgaggtgtgattgcaccactgcactccagcccagcaacagagaaagaccctgtctcaaaaaggaaaaannannnaaaaaaactcgagcctctagaactttagtgagtcgnattacgtanatccagacatgatangatcattgatgagttttggacanc

SEQ ID NO: 2846 - DNA, 905 bp, Homo sapiens
  misc_feature (1)...(905): n = A,T,C or G
ttggggtntttaggtgtgggntttncttttttcnaatngccngggntctcgttctttctcgnagnagcnnngcgnttcgctcaccaaggaacacaaataaacagttgatgaatccatcacatcagtgatgaatccagaatgtgtccatcattttcgtaagtcttagtatgcagagaatctcagatagcaaagcagaaaggatgatgtcacagacgccttgggtacccagcacctggatgcagctgtttgtacacacatactttctgatattatgttgacagtgacttacaccacttcaacctcaggcaggattctatcagtttctttactacagattgatttgtttctttaataatnattgtaattactgtcagtaaaaatctgagtctgactcagcaattagttgctggtaactgagtgtgttgtaatgctggggaaaggatataaaactngtattttgaacagaaaggcncacatgtgggtgagcagtgtttaccaccacagaatttccgtcttcacanaatnganatanctgcacatgaangtatagtnagcantgnangttnntttnnanaaagtaaaagttaaattacccntnataagcctnctggatttnncngnnnttngttctgnatttcctcctntgccnccttcaaattnnaantttananggtntncttnttctnctcaatatctctccccnacanntntngttnntgcnctgannccnnatctcttccntcnnnccngatggtgtatgnncnnggcnattncttcnacccattnntatcttatctntcnnatcnttnnatnntcntntncctcatnggnaacnnttacacnttnnangnttntngggccatnntctntgttcatntgtggggntctnagnatctttttctaan

SEQ ID NO: 2847 - DNA, 774 bp, Homo sapiens
  misc_feature (1)...(774): n = A,T,C or G
tggnttttnaggngtgggnttcttttttactaatggctgggctacttgttcttttngcaggcatcccatcgnttcgatctgaaccacatgaagttgagtaaaaaaagcaatttgcagaaggatacatacaaaatgacaccatttatatagtagactgaaagcatgcagaacaatccattgttgtttacgtgtgtaacagtcataggaatgacaaccactgccttcagaattatggcgacctctgcgatggaagagaatgggatcagagaaggatacacaataggctttaactgattttgtgattattgatattagaaatgtttaaaattaagatattaacatttcatgaagctgagtggtgagcacaccagtgttatattctctctatataactttgtgtatatttgaaatgttttctcataaaaagtatttaagcaagtttaggaaagaatattgataaatgaaattggtagagaaccatgaaattacatagatgcagatgcagaaagcagccttttgaagtttatataatgttttcacccttcataacagctaacgtatcactttttcttattttgtatttataataagataggttgngtttataaaatcaaactgtggcatacattcttctatacaaacttgaaattaaactgagtttttacatttcctctttnanaaaanannntnttaccnttntnnnnannnntntcnnccccctncnntntccnctntcnctncnnttctnnnannanatccttnccctcncttnnn

SEQ ID NO: 2848 - DNA, 806 bp, Homo sapiens
  misc_feature (1)...(806): n = A,T,C or G
ggtttttcnnnaggccggtttttcctcnngnctctncctgccccngnancnccctctcgccgaannagctnggcggtgggcgatttatttgccctatttcctccatgtacggagacattacnttttntgcccagtcagatttttttcatgctatcttttagtcagatttaatttaatgtgtatttctagtttattgcttctgccatgttttattctttatgaagatccccgagtattgagtgtgccagttaccagattctctcccagctctaaattacctcttcattacttgatctgcaatattggagcctaaccctttaggccaggggtgtccaatgtcttggcttccctgggccacattgaaagaattgncttgggccaatgtggactctatatggtataaaggagtatgtaaactgtggagagaagtanggctattttctacagcagtggtcttcaaattttnnaatngggtaccttaccagaaaacatttgaatanaaaacctcaatatnagtatgtcctaattataaatcatatgtataaatatatatactatntcggcttatatagngntttcaagtctgcttatgatgtaattatatgtnncagaacaatttnaatatactctttttccngntcnccttcaancggtcaatcccnttgnacnggnnaccnacttnccttcatannnnctnncttaaccagtgaaagntnnangnctnnnnaaaaacctctttcccnaanataancntngccctccnttncccattncantcggcnaaaccnancnnnattgnccccnnc

SEQ ID NO: 2849 - DNA, 758 bp, Homo sapiens
  misc_feature (1)...(758): n = A,T,C or G
tggtnnnnnnngnngngggtntcntttnttatnanggctggactanttgttctttcngcagcancccatcgattcgaattcggcacgagataacgcccgtggtgccccatccctataggagctggtgagattgcagcctgctgcctcccctccatcagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggnagggacggcggngcagctcctctacagcaacttgcagcatctgaagtggaacggccagtgcagtagtgacctgttccagtccacacacaatgtcattgtcaagactgaanaaactgagccttncatcatgaacacctggaaagactagaactatttatatgacaccaactatggtagcacantagcanagtnaccnnatttgnnnaaggagcatgacnccctnctgatttcnaantcangtgatgnaagcntgngaagtgann

SEQ ID NO: 2850 - DNA, 829 bp, Homo sapiens
  misc_feature (1)...(829): n = A,T,C or G
ttttccntntnggcctnnatanggggcttttctaatccagatactggnctggtttncgcacgcatnccancnnttcgaattcggcacgancaaanacaagccttnatggaaaaggaaatncnctcccctccatgtatatggatgangggagcagcacaagncacactcccaccatcctcacnnaattcctggacccatgcggtggctccgtgagctgggtgactccagcctnacctgcacaccccaaccctgcncggggccnttcttcctaccancatgccctcggtnagctaggaattnagatccctgcntgtgaannanggaactnatgtgcacagaatccncaggnntgccatatccttnggcatgatttagatnaagtcgccctgnntncagantgaccccgnngctctncagngagttntcaagccccangaaatcggccttggatgctctcnttacaagacagnntnacncctgggccctcgtgcatnnncttcactgnccccctggatccccncattacccccaaangacagngggnaaacacanngnnanancacancnttgncccctccagcncnnttcacnggcancttcttnnattcaccccgnttcccnccnnnacctnntccccccaanccnnnacaancntnntccccaactacangcccccttttccttgggngnaaaatgctccnttggtancccagttataanaangccntncngcccccctcancntgattctcccgcatncncanacccctanncccaannattnaannaccccaatcccccnnanaaaccctcctttccancttnnnct

SEQ ID NO: 2851 - DNA, 847 bp, Homo sapiens
  misc_feature (1)...(847): n = A,T,C or G
ntaggnncnnnnnnagngggctttctaatttactannggtggactagtngtncncnnaanancntnncgntgtcgaattcggcacgaggggtgacttcctgtgacctccaaaggaagtctcagctctgctagaatgggaccaaagcccagctccaccttgaacttgngtcatagccttgcttcttgttccctctncttanccgggcanatgccttgtcctttgataaaggcttnctgtcaccttctgagggctcttgtgctttttgcaggtggatgccattacctttaccgctgagcctnccgcaattgctntgttcacacgctgtccgccatctgcctgcaagggcccangcagggtnttactcatcattatgtcattgnttnaatagaagcctaatatnttgtacatagtagtcaggaagcccagaaaattgggtatgttctatagatttaccaccattgcttattgctgtntcnctttaataaagnttaacgaaagtnaancaaaccacantaccccccaaagacagnnnngggaaacacactngnggaaagccccancatggcccnccttcnancccccttttanggnactcttngnnatcaacccgggntacccgtccnccacttgntgccccnacccactccagnnntnttnccaaannacaaccnttnntntcccntgggggaaaaatgnntnnttggggtnccncngntncnaaaaaggccnnaatgggtnntcttaaccttnnttncnncatacnantccccacnacnttnaccccaaataantcanncnacntcctaancncannnncnnaaagccctttctncanctacttntnct

SEQ ID NO: 2852 - DNA, 765 bp, Homo sapiens
  misc_feature (1)...(765): n = A,T,C or G
cngttncnnaaacngtctgnggaaaagccccctttntgcangatcccatgcgattcggcctcatctcccactgagcaggtgccatcccaggagatgcttttggtggcgagaccttcccctcctgtgcagtctgtgtcccctgctgtgcccacacctccctcgatgtctgctgccctgcctttccctgcaggtggtatgggaggtggcatgttctaactcctagactagtgctttacctttattaatgaactgtgacaggaagcccaaggcagtgttcctcaccaataactncagagaagtcagttggagaaaatgaagaaaaaggctggctgaaaatcactataaccatcagttactggtttcagttgacaaaatatataatggattactgntgtcantgtncatgcctacagatnattcatttngtatttntgaataaaaaacatttgtacattcctgatactgggtacaagagccatgtaccagtgtactgctttcaacttaaatcactgaggcatttttactactattctgctaaaatcangattttagtgcttgccaccaccagatgagaagttaagcagcctttctgtggagagtgagaataattgtgtacaaagcaagaagaaagtatnccatttatgtgacaacctttntgggaataaaaaatttggtttaaaagttaaanaaanaaacaaaaaaaaaaaacttcnanccctnttanaacctttaggggaggnccgnaattaccgtagnancccaaat

SEQ ID NO: 2853 - DNA, 765 bp, Homo sapiens
  misc_feature (1)...(765): n = A,T,C or G
tttnnaaggggnntaagtgggtcttctttcaannggccgggtctcgttctntccgnancaannangcgnntcgaattcggcacgagcgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctncaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaanagttgccatgcacttgctgtgtgaccttgggcaagtcacttcactttttcttgagcccccgtgttccttcatctgtacaatgggggcttacgatacttactan

SEQ ID NO: 2854 - DNA, 785 bp, Homo sapiens
  misc_feature (1)...(785): n = A,T,C or G
cnnntcnnngtgttggnnttttgtggggtctttcctttcttaatnggtctgtgatncncgtnctcacctaacacaacnnggctgnngcgaattcggcacgagaggatgttgctgctgtgggccgcaagggtcttggtagcttcctctagggcaggcttgtgttcctgattggggttgggatgggtgggggcatcccctgtggcctcagcaatccagccctgcncatctgggtcccattacacagacgtagacattgaggtctanttngaangacttgccnngagtcctgtaatagagcttggcacttgggtctcttgactctcanggactgggtgtgagggaantgggctccttttgctccctacctgcagtgcctttgaggggatgagggtcttccatcatagttcngaanatgacctgcacattttactgccttanaaatctgctcgttggggccaggtgtggtggctcacgcctgtaatcccagcactttgggaggccgnngtgggcacntcaccaggtcangagacngnnaccatnccggcttacngggtgaaaccccatctctctaaaaatacaacaaaaattancctgccatggngnngggtgcctgcactcccactnctccngaangctnangcccgnannaatngcntgaacccnngaggcggnntcttgcantnaccccataannncgcccccngnactccanccctnngancacanaaanagacttccncctnnnaanaanacanctaatccnnaacnccanccctctnaancnt

SEQ ID NO: 2855 - DNA, 787 bp, Homo sapiens
  misc_feature (1)...(787): n = A,T,C or G
nncnnntntntnatggnnnngnctnggngggnnctttcttttcttaaatgntgtggntnctcgnncttnctcnnannagcntggcggnngcgctttgggatctttagatgaatggtatcatacagatgtgtattattgctaattctttgttctcaatcacttgttttcaaggacactaaaatccatgtagcccctaaaaaagataaataagggcaagtcacttttcttcctccagtcacagactaaagaaattatttcagataatatatagcccttcagccatgggagcaggaagtgtttactgctcaagtcagggtctcagttggtaaaataaacggaaacttctggtttagttttngggccttctttcaaataaaaacttcattttctctgggcaaatacattgatttaattttgtattattggtaaaatattcatcaagtcacggtcagnctttacagagtaccaaaacataactttgccgattttttctgtttaagggccagctaggttngttnaaaaagaaaancttnnagccaccaaaaagcctatggcatttctttctcttatgatctttaaaactggttcaagctcatcctgtttgngagtnatttaggtgtgtccctctttgaaaatgggcccccataacacttttttaatnggataaaagnngagaacatggagtcanaatggagcaaaantctgaatatttcacatggnctaaaccctttntttaaatcaanggnnaannanaacaaagttgcnaaaaaagcccaaaacatnattt

SEQ ID NO: 2856 - DNA, 765 bp, Homo sapiens
  misc_feature (1)...(765): n = A,T,C or G
tgtgntncggtangggggtcttctttccaggtgctggntatcgtcctntccnnanagccnggcngntcggtctcgctttgtgacgtagcctggtcttgagcgatccttttgccttggccttgccaaagtgctgggattggaggcatgagccactgcacccacccctgttttttatttaagtaaaccattataataactcatttataaaaaggttacttcaagagggctttcaacttaagaattattttcattttgaacatgaaaagttaaatagtaactaagaaactgagaactctgacagtgacctctaataggtaactttaggcaaaagtagacaagtttgtgggtattttgntgttcatgttaaaaggcacctgtacaagaatcaanatatgaatctagntcgtanagggaaggtcttatgcaaataccaaatcatacaagtggttacacatataatagatcatttggtccantaaaagtgggttcagcttgtttattccctacttttgntatcntaaaaacaatgattttttgcatgtaatagaangctttcacttaagatgctnttgagtgaatcagtgaggggttcttanagttagtattcattaattnaacntanaatattanctaaacagttttgggtcactgcaatgcatggtctatngaaanactanatgtttcgnctgaaatatgcttcaantgttgcnactatncanaanggctttttatgttntnnaatttnaaacntgccanttnnattnt

SEQ ID NO: 2857 - DNA, 794 bp, Homo sapiens
  misc_feature (1)...(794): n = A,T,C or G
nagntttttttggggggnnctttctttnggtngcgctggnctacttgttcttttngcagnagcccatcgtattcgaattcggcacgagattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccangcttggcaggctgcanggcangtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccaaggcggatgtgcctaccgaatcncactcctctgngtgtgtcccttttcaggcccctacatcattcganggaatggcnncccccnacgacttcccttncnaccantccaccntttnnttacanncntacttccannccccagnnctcttgtaaaagncccanncnancttccctanccctggantttttacccncnttnnctcatccacccctcttttctcccccccnt

SEQ ID NO: 2858 - DNA, 830 bp, Homo sapiens
  misc_feature (1)...(830): n = A,T,C or G
tgggntttaggcgccgctttcnnnnnngnnnngctggcggacttgtccttaatcnnaanagcccntgcgnngtcgaattcggcccgagcaagcagaaatgtgggtggtgtgactggggtttggtgangggctgctgnngctggaatggagggctgccacattaatggaaatggnaaatgaggcacgtaaggttngactggaggcatancgcccatgttgccngctttattaaatcactcttgcantatncananctanggcctgatgnnannagtgactgtgtcttgcactnntncaacntacagngggatgctnnaagaatgngcactgcananaggactngtnctatantaaccatatgtatgcntnncgtaanannatcgcnngctgactatctctaatnngngcggggaacgtgatcacattcncgnncnnttacatggaggctcctctcccngangnntctaanctannagangnccatgagtatgaaacantgnctnncaccacttnaacttacccnanntnncccaatatctnttgnctagctntngattctntgnnnagccttnactggaccctacttagacanngcctttcacacnctcannaacgattcntgtagtaaatnctantaacgcttccccctacacctnnntatgnatttatcgcncctctattncttnnccnntcncngnnntnantgaacnttacctccccttnnaannntccgcnncncttncaaccnttnanttncancatttcnctnatccttctcaccggggcattttnntctngggntccgggtnngnttntactcantgcnantn

SEQ ID NO: 2859 - DNA, 759 bp, Homo sapiens
  misc_feature (1)...(759): n = A,T,C or G
tgtnntttgttgggtgtnctttctancatncggggntctcgnnctnccgcancagccnngcgantcggactgacagnngtgccaacatggcattctgtttttgaaaagttacatgacactattaagtattgaaaatgttctaactagaaaaacgattttcttaatcatagtttttattgtggggtgtgtatgtaagttttaacgtgcaaattaacatatagaagtcactttgtgaggtttcatttaaatgtatttctcagattttgctgaatctgtaatagccattgaaatatttaagtaccttggctgttcctggcatcaataaacagatttttctttccctcctcatgccatacaaaagttgacaatagctttatcaccacaggaagaaagctgaccatcattgccctttatttgggcccagttgccatggttacagccctttagctaaattgggaatggtaaccaaaataacatttgcataacattcccttgttctgcccacctctttgcacatcttcaaatcaaggttttggtctgatcaccatactatgctgtagcctacttttaggaagtactttaggctaaatagatttgttncatttatgctaaatgctctcctggacactaccatactcagcatattcctggaaatctaacgcaatnatnttaccttttaaaacacccggnctccaacnggnnnnntacctntnacccncnctgnncnnnatntnttnncctncnttatcnantaaangc

SEQ ID NO: 2860 - DNA, 765 bp, Homo sapiens
  misc_feature (1)...(765): n = A,T,C or G
ntttaactnacnggctngganaccnnttctgcagnaagcnnnncggngcaattcggcacgagattctcttagtgatgggctggaggaagtttttnaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttanaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctgcttgctttctgtaggagaattgaacagcactattttgaagatcgtggtaaaggcaggctgtcatagagtatgtgttaagtctcangagtcttaactttnggaaatatggttttacttnaatgttacattagatatngggtgntacgaatttttanaaccaaattactggctttttgnaaccttcaaaatattataatggnatcttaatggaatgngcctntaanattgggnaatttggggtattacaattaaaaanaaaatnccg

SEQ ID NO: 2861 - DNA, 757 bp, Homo sapiens
  misc_feature (1)...(757): n = A,T,C or G
gaancagctctntnctttttgcaggatccctcgattcgaattcggcacgagagttgctgtcagtcttggtgtggaaaggagacgcatctatgacattgcaaatgtgctggagtcgctgcatctggtcagccgggtggctaagaatcagtctggctggcatggacggcacagcctgccnaaaaccctgaggaacctccanagactnggagaggagcagaaatatgangagcanatggcctacctncaacagaaagagctggncctgatagattataaatntgganaacgtngaanagatggtgatccagatncccangaacaacagttactgganntctctgaacccgactgnncctcttcatctgcnaacagtggaaaagacnagtctntgagaattatnagccagangtttgtcatgctgnncctcgnctncaaaaccnagatngtcactctggatgtggctgccgaaatactgntcgnagacngccaagatgccccagaccatagnanatttaaatgtaagaatnttcacctgcatnancttactagcacataaagggtgggatttnatgngtngatattntctgcttccgagattaaaaatctntntantgnttgttgacntangcatggaagtgcccnaaactcctgccttttaaaactntcnnngagnccatttccgtanattcncacntgattaaganncaatggtgaagtttgggnaaaaccgccacttggatgcaccggaaaaanatnt

SEQ ID NO: 2862 - DNA, 750 bp, Homo sapiens
  misc_feature (1)...(750): n = A,T,C or G
gaagcagctcttgttctttttgcaggatcccatcgattcgaattcggcacgagacattgtgttgcatcttataacttgtatagattgagctgattgaaataagattttgttccaagtattatctgatagaatacaagatgattcaaaattatatagatatttaaagcttttctgctgttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagccctggatgttaatgtgattgatcagcatgggcatatgtaaaatgnccttttctgggtggctctctatgccaatggggtcagatccttacacccntaattnaaccagtnngt

SEQ ID NO: 2863 - DNA, 742 bp, Homo sapiens
  misc_feature (1)...(742): n = A,T,C or G
gaaancagcttnnnaaccncttgcaggatccctcgattcgaattcggcacgagggatgggtgccctggagccaggcaaggcaggaggccccagaaacttggtgggggagataacggaggggatggagcaggaggaatcctgaaaaccggactgggagagatggggccgagtggacgatgcccagtaccagcgggcgtctgagactgaaacattaattctgaagaagaagaaactagacagtcagacctccaggactaagatgaagtgagccgagagganatcgtatcataagaatgcttctgtcgntagccgggtgcagtgctgtgtgtatctagttncagntacttgagaggctgaggcaggangattgcttgagtccagaaagtggcagttgcagtgagtggagatcgcgccactgctctncagcctgngtggcanancgagaccctgtctcaaaanataancaaaaacaaaatgcttctgtcagttaacaatctttattaaaagggtttttagtctttctttctcaacttgtatgttaanttggttgacaaatgcnaattnacgtctttattatnctttctttctnaanaaaaaagccnnnttntggnanaanctcnacctntgaactntgtgagtcttattacntnnatccntccatgataagatccnttgatnatttggacaaacccacttgaatgcnttgaaaaaaangcttttttgggaaatttnngatcctatc

SEQ ID NO: 2864 - DNA, 759 bp, Homo sapiens
  misc_feature (1)...(759): n = A,T,C or G
gnntagctagctacnnaaactctttggcnaatcccantcgattgcgnnttcggcncgagaactgacctaagcctcagtttttcagatctgtagtacttactttacatgattgctctttgaattgaataacataatttatgtgaaaacacttaattatgaatgctgtaaaactatcaaagccattaatatgtgtnatagtagcatcatacattttgcagcataatccagagaacaaggagttgttaacaagggagaggaagataatctggttgggctagtattatactctcaggtgctactgacttcttagatgaccttcaagatgttagtacaactctctacttggagatgctattttctggggatgttaatatccactctattcacaaaattttaagaaaagtcaagtagcatggatgaaactctccaaagttctgcttaaaactaaaatatcttagttgtcactgaagccacagatattttgtgaatgcagcatgttcccaataggcagtccctcttagcctcacagtccaagctggcaacaggatcacattccagggaatgaacagaaaggctggcaggcaatcacaccgctgatatcttangtgtgtgggccccccattttttttttgagatggagnctnactctgttgcccaagctggagccttttaaactatagtgagtcgtattacgtanatccngacattgttaggatncattggatgaagtttgggncaaccacacttggaatgcngncg

SEQ ID NO: 2865 - DNA, 765 bp, Homo sapiens
  misc_feature (1)...(765): n = A,T,C or G
gnaatagctaggcnatnagatctcgttgcaggatcncatctnnttgcaggatcccatcnattgcgaantcngcacgagggaccccctaattttgtacatgttgatgataggaataagggcttcgtttattttcactgcatgctctctatggaaagaggatgtgctaagcaaacaagcattgtaaacaatatttcagaggcaaggttttggcctgctttaaaaaaataaaatgtttgcaagtacaattaaaaaccagtataagggacaggggtgggatgaaaacctgtctctaagattacgaagcctgcgttatttcccctaaatccccttcgaggaagatttgaatccctcatcaacaaattttcattgattatgtttctattatatatactgtagactctatattcacgaatgtaatcatactcattcagaaaaatataggaagagaaaatgagtatgacctgtagcctgaatttcattataaaagatttaaaaatatacattttatattaaaattgatgtaatcttttaattatgaagtctttgattctttagatgttttcatccataacccaagagcaagatcttggcatcagttttttccangttatgtctatatcatctattattacttaaaagtttggagttacatataggatatattgatatntagagagttataggatatatgnnantttttttcaattccagtcccccaacccgagcaaaganccattttttatggaacttaaaaaaaaaaaaaan

SEQ ID NO: 2866 - DNA, 790 bp, Homo sapiens
  misc_feature (1)...(790): n = A,T,C or G
ngtanganactnnacgggaaatcccntntctnnangaanccaatcgatgcgaattcggcacgagccccagccagccttcagggtccccttgttnttgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggacaggcggcagaggcctnagtgcggcaaacacagccccagagcctgtgtggcaccagcagcatcttanagccccaggtatatgctgagancttatctcacgctgcctccantgtctggggggcccaaaatgatggcacaagggcangtgggcctgnaaggggccncaaaatgccctgnggttcaaagggaagggtggcccaccaatggggcccnanggtcttaaccccaaggaacccctttggntctnggtnccttaaacccttggcanntnacnggnaagnacctaatgggngggnactggncccangggccccnngtgnacctttgggggggccaaaatngggaaagggccccccctgaaaaaaaaan

SEQ ID NO: 2867 - DNA, 762 bp, Homo sapiens
  misc_feature (1)...(762): n = A,T,C or G
nacnaagatatcctnatnnctggctnnccntttctgcangatcccatcgntncantgcggcccgaggctgactgttggtcatcttgccagatcttntntgatgtcttttgcttcatcctgctgtgcatcttgcaggaaagtagatgctcttggtcatttgagtaatccgaatcttgttatttccagtcaactcagttggatttctgggatgagaattagaggagtcccattgaaaaactggaatgagagatgagaagtttgctgaaaacagaacatttttttgtgtgtggattgatttgcctcgtatacctgccttgtactttaaccacatctttgcagtttaaaatagaacacattatttcttcagattcacttattttgactacatcagtaatgctcttacaaggctgcatgacagatttatggtgacatgctttaggcagttcaaaatccttaaacctatattcagctccttttttcctagaaagtaagtcatcttaattttcaatctttctttctttttaatcttttaatgattttttgggggagaggaatcttggcagttagattcttcaagcttggctacaaatgggttaaaatataagtggtgaaaatnttatactttntcctatttngantttgnctgctcatttggnttcttcccatggtctcaagtatacaattnccaagtttattggggctgnntcacntgnttccatttctgcagggaaaaggctgcnttncnnaattggggttnggccn

SEQ ID NO: 2868 - DNA, 796 bp, Homo sapiens
  misc_feature (1)...(796): n = A,T,C or G
ttgttctttttgcaggatcccatcgattcgccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgnctggggtgtgggctcacagatccctatcagcctggttcgtggganggctcttcctaaagggacccccatctctaagtcactctgaaagggagttgtggagaggagacgccctncaaactcttcagaagtntntgaggacttgaactgggtcactcgggatctgngtncgaaatccttcccaacccttttcttttgggggagntttccttaaccctgctngcttgnaanccaccaaanggtttttgggnggcctntcctttttcttcnattttggttttaaaagggcaantngtnccaaaaaagcccatttcccnngaaatgcccaaanaacccangggggccttaattttnttaagggggaaagggnaaggttcnggttttcccaatngntttcccccttcccg

SEQ ID NO: 2869 - DNA, 748 bp, Homo sapiens
  misc_feature (1)...(748): n = A,T,C or G
gacnnntgtgnangnncgtggaaatgncctttctnnanganncccntgcgntncgaattcggcacgagaatacacacaacatataagacatggcantttnctgtttatgttatcaggtttaaggcttctggtcaacagtaagctatgagtagttaagtttctggggggacaaaaatttggttgtcaactgatgggggggcggtgttggcacccctaacccgtgcactgttgaagggtcaattgnactgnatttatatatgccancagctctncaactgtggtctgcagatctcatgaggtctcctttcaggggacccacatgggcaaaactatattcatactactactaaagccatttgcattttccactgngttgatatttgcctgatgttgcaaaagcnntggtgggtaaaactgccggtaccttagtgcaaatcgagtcaanggcactaaacgtatanttgccattagatcctctcttcancattctgtgctngcagntnaaannttaataagccngttttacntangaatgtccttaatgaagcaattgaaatgactaattttattaaaatctnaagccttgagtatatatctctttcaatattctatggaaataantggnaactatncattaagcatttctgcatgcaaatatggnactgnnttgaagnaaanctctgcgggtnncnaattgcnaaccttgaactacccattgatacttggatgtgcaggctncnggacaacc

SEQ ID NO: 2870 - DNA, 741 bp, Homo sapiens
  misc_feature (1)...(741): n = A,T,C or G
tttnnatgctggttgtcgttctntctnnaagatccnngcgngncgaattcggcacgagcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtgagcatctggagaaagatctggggagaagatcctcaaagcccctgtagcaaaagtcaaatgtggtttggacttaaaccagcattgaacttagtgctatacaagaagtagagtcaccagcaattggcagaacttctatactaggtaaaccaggtatttatgaagacagagaccccctgcgagtcttaattaagcccgagacaaaggtttttttgggagcccctggccatggatcccgttangttgncttn

SEQ ID NO: 2871 - DNA, 735 bp, Homo sapiens
  misc_feature (1)...(735): n = A,T,C or G
tgnnagagtanngnnnggtacttgctctttntnnangtagcccgtgccattccggagggcactgccctcctggaagagatgcattaggatcggtttgcncagtaatacctttacatgannccatttngagaatgatnacgggccaaagntaacgggtgnactgttangncancatggactnngagaangcaagggtnanggtgaccaggtctggcanagtaannagccttncgntnnaagngnacctgnnccngacccncagaggatngtnaccantnngactgnaggaatganncnngtnnggntgatntntctncatngannccataatctaatgcatgattangaganccaaatnggctgctcnttaanngacatcccanannctatctgatcctaatgcggnncatnctngatancttagtgctnntaaacgncgtgntcatacatnnactnatgcttnggcnanccactcnnngntgttangtnacntatgtannncnngacngganacttctnctctgtgnagcagtcatcacatctntacangnnctangtntantatngctntnaacncggnntgtagttgatactggagcatggctttctnntnacactgcattgctgtcacatcttggctgagcnnagtaatgtccgtcnagncttaatanatcntngaatgntgggcnatcgcctggagttccangatcntttggagtccgtcnacttttatnt

SEQ ID NO: 2872 - DNA, 752 bp, Homo sapiens
  misc_feature (1)...(752): n = A,T,C or G
agnangcgtgtgaagtatcgcccncctaanagaaggcgggcgattcggcacgaggccccagggcatncgggggatccctgtgattttggtgagggtgagcacccaggttccacagggctctgtcctgggcaggccagcagatgcagtgattgcaaatcctccttgtncaaatggaacaggcacgtgcatttgtggcacactcagagctgctggccactagtgngctttggagaatcagttgtctcccaggcggggaangtccctcagacataaaatactcacccatttagaggaatgacaacagcaaaggaaactatattctgctaatttactggtaagagaggaaaaactctgtcatgcatacacatgacagaggctctgcctaaagagagaggcagcacgatacagatattagcaaatgactactctccangaagaaacacaccagccaggaacggnactcacacctgnaatccagnactttcanaggccactccggtaggatggcttcanaccatgagtttgagactagnctgngcaacctggcngacttcatctntaccannaaatgaaaccatgcattccaacctncnannagatcantnangagacccacacctgggagtnnccagatatttcaaaggctnngcangaaggatctcttnggcccaggaaaanggaaggcttgcaattgaactatgatcctaccacttcactttcagnccggggcnnccaaanccatgacccctnnt

SEQ ID NO: 2873 - DNA, 771 bp, Homo sapiens
  misc_feature (1)...(771): n = A,T,C or G
tctangagatggnatgtntcgncctntctcnaagagnaaaggcttggcgnattccggnccaagatcgagaccntcctggctaacacggtgaanccncatctctactaaaaatacaaaaaattagctgggcatagtggcaggtgcctgtagtcccagctactcgggaggctgaggcaggagaatggcgtgaacccgggaggcggagcttgcagtgagctgaaattgcaacactgcactccagcctgggcgacagagtgagactccgtctcaaaataaaaaaataaaatgggaatatcaatagggcctatttagtagggtggaagtatagctctaatgagatggtccatactggtcccccagcacataggaagccctcaagaaataaaggctagtggtaacctgcacagtgatgggaggacaggggctatgcagaaaaacttggagcaaagaaacgagagcaaatatgggaaaataacaatttgtgtggggttgaacatatggttgttcatcgtactgttttttcaaattttctgtatggttgaaaaaagtgataattttttgggggaaaatctggcatgttcccctgcacctanggtatatcaaaatgtattgacaaaatccaaattaaaagccaaactcaaaaaaaaaaaaaaaaaaaaaaactcgagccctnttaanaactattagtggagtccgtatttacngtagaatncnggaccttggattaaggatncatttggatgaagttttgggacaaanccccaactttgn

SEQ ID NO: 2874 - DNA, 744 bp, Homo sapiens
  misc_feature (1)...(744): n = A,T,C or G
agnngcggnnnnnngnaaatgccctnnatgcaggaacccangcgatccgcctggtggtagttaccacaacacatgcctcattaagaaacantttncatcagagggaatgcctgcctccctgntaccagctctgcagatgtgcacatatcttcctgtcgtaagccaatgggacttaaaccttacctcttgtgttttggagactatcttttatttttttttttttgagagagtgtctccctgtgttgctcaggctggagtgcagtggtgtgatctcggctcactgtaaccttcacctactgggttcaagtaactctcctgcctcagcctcccgagtagcttggactacaggcgtgcaccaccacacctggctaactttttgtatttttagtagagacggggttttgccatgttgcccgggctggtctcgaactcctgaccttaaatgagcctcctgcctcagcctcccaaactgctgggattacaggcgtgtgccaccatgcctggctaatntttatattttcagtagagacgagggtttgccatgttggccaggctggnctcgaactcctgacctcaagtggtccacccaccttggcctcctagagtgctgggattacagggggtgagccactgngcccgggctcttttgctttcttaaaagactttggtcgggtatttgggntggatggagtattgngtctgggtgngggtaattcganncctnnnttngtnnggggggtanag

SEQ ID NO: 2875 - DNA, 755 bp, Homo sapiens
  misc_feature (1)...(755): n = A,T,C or G
tcaananncagctcttgttctttttgcaggatcccatcgattcgctgagatcggccactgcactccagcctgggtgacagagtgagactccgtgtcaaaaaaaaaagtcccaaactgtttggctttatttaggcagtaaatattctacttcgggatgacctgtcatggagccagtaaggcctctacaaatcacatcccaaacaaatacaactcagatgagcaaagtaaggcccagatgaaatgacatctcgatctcttctatggcagaaactcagcaagacataatgaaacaaagatagctaaagttcattatttaatgctctactcccaagagaattatgggactttaaggctactcactaacatacaaaattaccatgcagatatggggggaaagtccatgtccagaaaaaacttggtttgcaaaccttagaactatgtcattgcaggattatgtgtgtgtgcccgtgtgtgtgctcacaggctttgaagagttttatgagtatccattatccaaaatgcttggaaacagaagtgttttggattttagattttgaaatatttgcattatacttaacaagttcaagttcagcatncaaaacccaaaatgctccagtgagcatttcctttgagcatgtcagtacgcaaaaagtttcagattttggagcacttaagatttaggatttgggatatcagcctgcataatcaaaccttcttcattcaggaatgtaaaangaggtttaatatgagcttan

SEQ ID NO: 2876 - DNA, 771 bp, Homo sapiens
  misc_feature (1)...(771): n = A,T,C or G
agcgncgccgntgaactgaaatcccctttcngcaggagcccatcgatncgaattcggcacgagatcacctgatgtcaggagttcgagacctttttggtcagcaaggtgaaaccctgtctctactaaaaatacaaaaattagccaggcgtggtggcgtgtgcctgtagtcccagctacttggggaggctgaggcaggagaatcacttgaacccggaggcagaggttgcagtgagctgagatcttgccactgcactccagcctgggtgacagagcaagactccatctcaaaaaaaaaaagaagatggaattagctgagtttcatggctgcttgggaggttttttgcagacaaagactccctctctcacccagactggagtgcagtggcgtgaccctaactcactggagccttgaactcctggtctacggtgatcctcctgcttcagcctaagtagctgttattggcatgagccactgcccctggctcacatggctgcttaaatggaagagttagcagttgagactgagaaacatgaaggactangtaagtatggggctcccagatagagggcagcccacaaacgagataagcagaagctgcccaaagggggaaggaaagacagcccagacaggggaatgttaagaagaagactcaagccaactcaaggggtttaataaaaanggagcctaagctctctttaanncattcacccaagccatatgggatttcagcaaacttggccctgtcccaagggacctcccttttggcaagg

SEQ ID NO: 2877 - DNA, 778 bp, Homo sapiens
  misc_feature (1)...(778): n = A,T,C or G
tnnntttgacncnttncnaggctacttgttctttttgcaggatcccatcgattcgaattcggcacgagctgggagcgagacggtggcccggnccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggancagattccaaggccaggtggccgcanggacgatgcagatgcagagcccacgtnacatgctcgctccaggggtggggctgggctgactctggccggatcccaagcctgtggctagcagcactggggacaggaatggctggtcccttgaggaggtcntgacaggctcaacctgntggtctggangggactcggaaataaattgtancagctttccttgccaaaaaaaaaaanatnnannnnncnntnnnnnaaanaaaaaaactcgagcctttaaaactnttngngaagtcgtatttacttngaatnccaaaacnttgattaggatncctttgnnnnaattttgggancaaaccncaaacttnnnaatgccnntnnaaaaaaaaagccttttattttggggnaaaatt

SEQ ID NO: 2878 - DNA, 765 bp, Homo sapiens
  misc_feature (1)...(765): n = A,T,C or G
tgcatacacacgcttnggaactngccctctttctgcaggatcccatcgatncgcgctctccctttatagtttctctataaaaactggttttaaaattagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcantttaaaatgtacctcttgtttacataatttgcataattttaaaagataatgttgncnaactntggaaatgttaatgttcagactgaaaatctccactacatgtaactctcttcctctggatcactggcatggnttataatcccagccagtggtttgaactgntccantgtcaactgccatgtgctctgcttcaagggggaactagccttttgngaattttttgccataagtatttgttacnaatattttagcaaatgctttctattnctctagcttgtgcatatcttggctgggcgttacagaannnatagngtacccattatnttncttaccgnggaaatgaagggntantncctttccncttttantccggtccnntttttnactttaatgtanagggnggttgggataaagggaanggngatgnangaagcnttaannnacctnaaatttcttgaaccccnncaangncnnnngggttcntttttaaccccnaannn

SEQ ID NO: 2879 - DNA, 811 bp, Homo sapiens
  misc_feature (1)...(811): n = A,T,C or G
cntgntnnnnnttcaancctggnaancgcctttctnnannagancggtncgntttagaaatagaactcctgtagatgtgtagaaagantgatggnaaagagaaaggactgatgtccttcttttcattgaaaaagatattgtttaggtcctacaatggcttaggtatggtttgagactctggggttacaaagcaaagaaaacctggcctctgccctgctcagagaacagcagggatacagcatgttagcaaataagtatatagtgtggaaaggtctgtagtcaatagcagtcattttgacaataggaaaaggaatgtgtgaaacttctgggtctgtgtgtgtgttggggttggtgggtcaagggaggggatccaaagatggtttcactaagaagggaaaaacaccggacctgagacttgaatgcaagtagaattttgccaggcagatgatctgttcttccaggtagataatccatcctgggcagacaaaaccaggctgtagaaggaacaccatgtgtggagcaatagaaatatctcattggtactggagtataatgcatgccaagaaaccaggcaaggtagacanggggccacccgtgnaaggaaacctcttgaaatanggggaatggatattcatcacattttccattgtttaaggaccaaattgggaanaaagtttnaatantccaagaatgttaaggaaaaagnttaaatgggaaggggaagaccaaatttccaaggtggnttccaagcccnaaggggattgacncanttcccttaanttttggaaaaggnccnggggtntttgggaaa

SEQ ID NO: 2880 - DNA, 771 bp, Homo sapiens
  misc_feature (1)...(771): n = A,T,C or G
gagattttccttaactgcaatggctactcgctctttccgnagcccatcgattcgctgggtcatgaaataacagattaaaaatgttctctggtaattttaattaaacatttctgtaaatggaaggaaaagaaaaagatttcagagagtctgatcaataatagcttgtgggtcctagtgagtggagcagtgtataaagaggtaaggtttttgagggaaaaaaatactatgtcaaatggggggtgaatgataaaaatcgctctcattttcctttttttcacctttcatcttcatttatggaatttctatacaataaatntgnttggcatttaataacagtgcctctcccccggaatactgtttttattttatcttacttaacaaaatattntgtagtggttctgtgccaagtgctgttctaagcactttgcnaatattnnttcacntaaccctataaggtgggtcctgttttatgcctctttgttcgnttgccagcaattaatgaaactgaaacagtgcttgtccaagacaccntaagnagtaaatggcatagctggaatttggccctnaagtcagtcctcttaaccactgngctcttctgtctgctaatggaaaacccttataaagtggtgaaccanaaaaagccagaggtctgggtttannntnccattttnggcnttttnaaaaccgggntttttgcctcttgtccccccaagaanttgggggttttcaatggaacctttggntcncnnccanngggggctcnancnncng

SEQ ID NO: 2881 - DNA, 768 bp, Homo sapiens
  misc_feature (1)...(768): n = A,T,C or G
acngcncgnccancngntnggaantccccnctctgcnngaagcccatcgatncgaattcggcacgaggngaggcatnttggcntnaacntgcgctttttacagaagttatgtgccactgtggaaatngctggaaatacaaatgcaaaagaaaacacaaatctctgncattctgcagaaacagcattctnnngaccccntnnggcttattctatagatgtatatccttgtgcttacagaaacttgatcatattattntatnactngcnggttcatntaaaaatatcatgaacatcttnngtgacatgacatgtctcnnctntnaatgagngcatagacnnccaaactacaaatcttccatactcngtgnanagnncctccactgcagtccancctgggcaacacantgagactccgtcgcaaaaangncaanagacgngctattgacnncaattttgacnttggatganngtggcantaatntgantgccgtaacancgaatgcaggaggngagaggaananacccggagcccaagttgnattgggaaagtggntcaggccattggtantgnaaaaatcataattcncangantttganatgggagaaatgcgggcnggacttgaccgnatctnactgaaancgnanactncancgggaagntncaaggcnaanngntcattttaaaccccanggnnttccangctggnaanganncccngggattgnnccnactnnccttccaggcctgnaanaacaaaaactgnnct

SEQ ID NO: 2882 - DNA, 743 bp, Homo sapiens
  misc_feature (1)...(743): n = A,T,C or G
gcnttcctaaaccctttgntntcgctctntgcaggatccctcgattcgtaaagttacacttaaacagtgatacatagattgccagatnttttttggaagggctttgattaattaggcttcagggaaattgtgaataaaaacataaatcttgcaatagggtaggggaaagaaaataatcccactcctgaagtgatgaaatgaagagtggctagagaggagaaaagaaccaggacaggtgatatattagcaactgtcagtgtgaataatccagggtatgacatttctaatttagcctcacatttaaggtcatttctgattcaacctcaaatgatccttctagcctactgctcccctaaatattaatatattctttgtgccagtcacagtgtattaacatttccctgaaaacatcttaagcattttttttaacctatgtgacttttgccttcttccatctcaaccttttaaaatcttacctacctgtcccttacttcatcaaatgtttctaattatttagaaacaacttctaaatttcctaatatatatgtatatctgngttgagtatgtatgtgnnataactaaattagagctaaaatattcttttattagtatgaaaatttgtgnaattagttgatttatnccttcatatatctctgggagaaaatctcttggtcaagcctggtagccctcagagaactttaaagttttattgattctaatnttatgtatgtatgcatgnatgc

SEQ ID NO: 2883 - DNA, 737 bp, Homo sapiens
  misc_feature (1)...(737): n = A,T,C or G
gantcagctctgttctttttgcaggatccctcgattcgtgaaggacctgcctgcggctgctttacagtttgtttgtttttttttaaaataagtagaagatatacactaaagtaatgataaatgtatagtatagtaaatacacaaaccattaacagttgtttattttcaagtatatgtactgtacattaattgtgtgtgctgtacttttatacaactggcagcatggtaggtttgttcacaccatcttctccacaaacctgagaatcgtgttgttgcactgcaagtcattaagttaggaattgttcagcttcattataatttgtgggaacataagatgtccttaaatagcacataactgtaatgtgttttttttaacatcttggttttttcagcagctatgttagtatccagcagataactggcactctggacatttgatgggtgaaaatattcacggttcattcttttcttcgaatgagccccaataatcattgcctcctgaattcctctatcaatattttgcctatcatttgacatttttagacatttaaaacttcttagtaagataggacattactgtaagagcatttgtctgcatatactatttcagtttttttcccctttgtctgagttaattctctatctactggtcacagtaaagagttccataacatactacacttgcctaaacagatttaacctctggcagctcatctgactgaacacagtaagtaagg

SEQ ID NO: 2884 - DNA, 769 bp, Homo sapiens
  misc_feature (1)...(769): n = A,T,C or G
acntngttctgtnncngaannccctnnctcnaaaancnaggcggtgcgttntcagccacctccactgactcctacctccaaagntnatactttttagaccttattttcctaaggatgaggntagtangagggctgcttnccctcagcctggattactgctttggcctagaagatgaagatggcatatgtggttatgccttgggcactgtagatgtgacccccttnattaaaaaatgtaaaattncctggatccccttcatgcaggagaagtataccaagccaaatggtgacaaggaactctctgaggctgagaaaataatgttgagntnccatgaagaacangangnactgccanaaactttccttgctaatntcccttctctgataaagatggacattcacaaaaaagtaactgacccangtgtggccaaaagcatgatggctngcctcctgncttcactgaaggctaanggctcccggggagctttnngagaagngagaccanatgananaagaattctggaatcttacagcangttaagatggtnttgaaattgcaaaaaaaggaaggatttncaaaaggatgnnggctattactttggtcnggaaccctggggaccaattcnttgacactgggnaactgntncaaaaagtctcttaactgcaccctnggnnnantgggtaacttgaagggcntccataacagtcaagccncnagaaatgggnaccaaaaccatnccaanngganttcgcaaccnanaaagacnnt

SEQ ID NO: 2885 - DNA, 746 bp, Homo sapiens
  misc_feature (1)...(746): n = A,T,C or G
gaancanctctgttctttttgcaggatcccatcgattcgaattcggcacgagattgaattttctgataattgaagcttattaattgtctaaaattatcttaagatattttctgatgtacatcattttaaaatgagttgcacacatttctattctgtttcaacatattcaatataattttcgctcttgttcatctgttggtattcattatataattcanacgtggtctcaggtctggagacatgtgaagttattgctcctacactgagtgtttccatgtcattatgccttaatccttatttagacacagctatgataccctctttacaacataaaggataagcaaaaggatgtataaatgtatcctgggctggaaagtggcattattgactggccattggccatcagcaaaggggcctgagtggaaggatatgaaaggatgggtgtaatgtagatgacnggttgatgggtgcagcaaaccaccatggcaggtgtatacctatctaacaaacctgcaggttctacacatgtgtcccanaacttaaagtatagttaaaaaaaaaaaggatgantggtgagcacagctgacacaccccacgaatatctggggggctttgagaangttgctganatccagtaatcatgtggcaagtttcagttatttttattgagacctcttggctcaataggctgttgaagtccttggaactccatcaaaggtgggtttcccaatcctncatgactgcng

SEQ ID NO: 2886 - DNA, 749 bp, Homo sapiens
  misc_feature (1)...(749): n = A,T,C or G
acngcgnncnctgaacnggaaatcccctnttgcacgngatcccatcgattcgaattcggcacgaggtgatagagatcatgccgcttgggttnttttnttctccccctcgttgtaattcagcaggcttcccagtgtgccctgcatcctcatctgtgaggccgacttcactatcattcccacttataggtggaggagactgaggcacagagctcccaaagccccacagctggcgagtggcagggctagcgtgcgatgtccactagactggtgtctgacgcagaagctgcgcttctcacccctgggatctggaagataattctgatgtgtgagatccaggagaatgcattgtttaaccagaaaatgttttgtaactgcatttttgtttttgacagaaatgtgactgcccactgaatantgagcattggaattagagaccatctagctgccggggctgggntgggtcatcttgcgnccnttaagactgaattgggatgctggattccantcttaaaaaccggcatggngacataccacaaacagggtancntaaaacaacaaaatntttttcacaattctgaagggtaaaaggctgaaatcanggcntgtgggcacggtgagctccttcttgangcanactggtcccgttccttnccggaacctccggnnggcaacaagcttgccctngggggnnccctgncttggancctgngttaaccccanactnttgnccccgncttnatggggnancc

SEQ ID NO: 2887 - DNA, 742 bp, Homo sapiens
  misc_feature (1)...(742): n = A,T,C or G
gaatnaatcgcttggctactcgcncttttctgcaggatcccatcgattcgtgtggccccaagagtgggaggagtgggctgtcagtaggccacnttntaaatatctgtgttctggctgacccccatatgctaggatactggagatgaggaactggagaaggtgcttaaagagcacatctgtctggtagaggacacagagctgtccttcaagcatttgaacgatgttctcatttccctggaatcttctcctctccaggctcacatctctagctccttcaatgattcctcttgcgacatcattttagttctcttccccaacctagtctttttgcttttaatgaatgatcactgatgtatagccctgatgacatctggtgtccacagtggtgcctgatgctccgggtgaagttgaagtttgaccagtaagagggaagaaagaatggctcctccctcatttcagagaatacatcctagtcacaagtgcccctaatgtcactcaggtttttgatagctacattccctcactgatccagtagaatacactaccaactgatgcaccatcttgattaacaacagcaagccttcccttccttnctcaagnatctctcctnacatggcttccatncagatttgcttttaacctgccactttggaangggccccccgagatcattttaattaaacacgttattagaactgggttaataaggctancctctatgtctctgcnaatatttccaagc

SEQ ID NO: 2888 - DNA, 755 bp, Homo sapiens
  misc_feature (1)...(755): n = A,T,C or G
nggtttnangaccttggntaangccttttctgcaggancccatcgattcgaattcggcacgagctcttttcttgcttagtgatggcatccattttaaggaacaaacctggaaatgctgagcaaagaacacatacccttcatttccaaaggttcatttcccactcttactttagattgacaatgagttgtagttcaaaggctgccctgcagggaagctcatataccctataatttaaagggcctcagacgactcttgggaaacttggtaaaacattctatttagagacatgcctgctgatatgacatatatttttatagttatacccctttattgctgggacataaaacctgttttcactcaaaatgttcctgctttcagaaaatagaacaagagacatgcagaaaacagtgattctattattgtgtattatgacttttgttttatagttctcttttccaactcatctcttttccctgcagctgtggaatctggacagcaaaatcttgtggacgtttattccactaagcccagggatgagatggcactcangttaaagaactaacattttctgaaacccttcattactttttaccagcatcangccctcttaagttccaagtggtaagaaacccttcattcaaatctttacttccgncantncccatttccaagcccttctattatgaaccaaaatttcangaaaccnctagggatgccccttaagaaattggggttacatggttggncccaaaaa

SEQ ID NO: 2889 - DNA, 717 bp, Homo sapiens
  misc_feature (1)...(717): n = A,T,C or G
cnaaanatnnctggngnngcgcgttttgaactatcaactagatctgggaagatagaacaggcnttntcagattgccttgtttacaaagtgtcatcacgaaaagtgttcctctaggaaggcataatatgtggcctgatggatttgatgagtagattgtaaaagggttgggattctggcagaacaagaagagataactaattagtggaattaactgagaaaagagttcattagcatgttggctattagactctaataaaaatgggtgtgaaaagatgggatttggacctagaggcagtcttagagccataatcctttttttctccttttgtgaaagtgacaggtacttctggtctgagtccataaatcagctatatctaaatggaaaactatatcccactgggatggtaatcacccttttgatagaaaggttagaagccagattcttcaacagaaatggaacttatcaatttaattaagattcctcaacagtagatttttaggtcagtggaacccctgtgtaaagcgatgtgctactgcatgcctagaatcctatatcactgatagctgaaaaagaggcanagcacttaccattttcattagnctgtatncccttggaatgtaagccctttttgaangggaaatctactcaggangctgaagcccggaaaatnacttggaacccaggaagcanaaggtttgcttgtnacccnaaaattt

SEQ ID NO: 2890 - DNA, 717 bp, Homo sapiens; identical to SEQ ID NO: 2889
  misc_feature (1)...(717): n = A,T,C or G

SEQ ID NO: 2891 - DNA, 744 bp, Homo sapiens
  misc_feature (1)...(744): n = A,T,C or G
gagtacgangggcanaactggaaaccccatnnctnnangaanccanngcgatgcgaattcgggcacgaggctcttctctgtgccctttatccgntttttccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggtnttatatgttaaactccgggcgggtcagctctcctacaaagaagatccaatgggatggcaaagnttgntggctcaagactgntgctaacaggaactcngaagccccgggctttcaagccagaaacaatctcagcattcacttctgatccacacttctggcatttgctgaanattncngcaagccaactgngaacatggggcagaaaacaggaaantctggaactcttttcttcagnccccatgaaaggggtacccaggagacccaaaaaagttgcccgncatacataacaatggacaggctataagaaaacttgggaaaanaaaaatgtctgat

SEQ ID NO: 2892 - DNA, 764 bp, Homo sapiens
  misc_feature (1)...(764): n = A,T,C or G
angttatnaaaccctttggacncgctctttttgcaggatcccatcgattcgaattcggcacgagatcacgcccagctaattttttgtattttttagtagagatgggatttcaccgtgttggccaggatggtcttgatctcctgatcttgcgatccacccgccttggcctcccagagtgctgggattacaggcatgagccaccacacctggccacagaagggatcatttctaaatagcatagaatcacagggagtacacctcatgtgacttcacgtttagagtcagcatttgctcataatgaattacatatcagtaaatgaacatgacatgcttcaacttcaataatattaaacaaaactctttcagtgtgcttattcatagacgaaaaacagggcctgaaaacccagtgtgacttgggtgtcatatatcttcagtttggatgcactatatcagtgctaatcaataaaggccaggaatgattttggagtataatgtccagccttaaatcttaaatgaaagtgaaattcaaacacttagcccagcagtagaagaacaaacactagtgagacaagtataaatttgntaagacgaacatgggccagatcccattatctaatatatggggtccctcgacagtatgtaccgtctnngaanaggaagnaaatattcaaggtncccaaatggagccatttccttcaaaagacaggcccaaggagcttntgaaaanaaaanccaagtgtnggccaanaaangaagggggccct

SEQ ID NO: 2893 - DNA, 723 bp, Homo sapiens
  misc_feature (1)...(723): n = A,T,C or G
gnntnnnnnnnngnnctngtctttttgcaggatccctcgattcgaattcggcacgagatttcctgaggtctccccagccaggctgaactgtgagtcaattaaacctctttccccaataaattacccagtctcgggcatgtctttattagcagtgtgagaatggactaatacaagtaccattaataaatttcacaacgtagattaaatgtgcaaattccttgaaagacacaaattaaaaaatgacctgagaagaaaagaaacttgaatagatctgtatctattaaagaagttgaaattataattagaaaccttttgaacattagaactccaggccccttgttgtgaattctatcgaacatttaaagtagaagtgaggccaattttacataagctcttttagacaataaagaaggaacatggtttatgtgattattaccttgatgttaaaaccagacttaagaccttacaaggaaagaaaactgcagttactcatgaacatagatgcaaaaatacctaataaaagtttagcaaattctatccagtaatatataaaaatgacaattcatcatgttcaaatgggggttattttaagaatataagggttgctttaacatctgaaagtcagtcagtattaattaaccatactggtattaataacctagnaaaaccattttggagcatttcaatagatgcagaaaaagaaatttgacaaaaatggcccat

SEQ ID NO: 2894 - DNA, 738 bp, Homo sapiens
  misc_feature (1)...(738): n = A,T,C or G
tacaagctcttgttctttttgcaggatcccatcgattcgaattcggcacgaggagaggccatggcccgccagaccgtantctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcanatggtgaacagtttaagaagtggcagaaatgtgacctttcgnatattggatgtngactggtgtccgtcaaataaagtgatcttggnctcagatgatgggtgcatcaaaagtcctanagatgtctatgaagnctgcgtgctttanaatggatgaaccaagagttacccganccttgtntggggccccctatctccttgttncaagggcctntcttgccttgaaagccctttttattacacc

SEQ ID NO: 2895 - DNA, 710 bp, Homo sapiens
  misc_feature (1)...(710): n = A,T,C or G
gtttaagcagctctngttctttttgcaggatcccatcgattcgaattcggcacgaggggacgtccangatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggctctgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataagaaaaaaanaantncntnnannnnnnnnnnnnnangnaannannnnnnnnnnnaannggnannnnnannnntnaannnnnnnnnannnnnnnnnnnntnntnnnntnnnnnnnntnnntctcnncn

SEQ ID NO: 2896 - DNA, 702 bp, Homo sapiens
  misc_feature (1)...(702): n = A,T,C or G
gtnatgttgcnatgctntttgcaggatccatcgattngggaaccaggggctgcagaaccngcccntccccaatgaggaccccctntggacgcccctccccatggagaacaccaggagccacagaccccagaccacagagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggcttaaaggaacacatttgttctcttacagttgcaggggccagaagagtctaaaaacagtcagcagggctggttccncctgnaggcttataggggctgaatccggtnnctgncttttntagtatctggagggcgcctgcatccnctngcttatggcccctttcatcaccaaanccagtngtgtnacatctttccacctnttcctgaccctgacctncgccctttctcttaaaaggaccntgtgtnactttgggcctacctanntnatttagggtatttantatttaaggaaccctgnattttaatnccactggcnagnaccttttgccaggtnaagngacaaattccaagggttttaggatnaaaantgg

SEQ ID NO: 2897 - DNA, 709 bp, Homo sapiens
  misc_feature (1)...(709): n = A,T,C or G
gtcaaagctgntctcgnatgctgcggaccctncatgnncnagtgccttccgnaattgacccangctgggagctattnacacatgtccatgtgggatanagagngcatganagcncannancccancctgntggtnacacttgctcatctgaggnctnacctggatancananacctaatccatggggacnnnaancacctaatgngctnntntgtaaccatccnnntgggtgaatnaccngaggncgaggantngacnacctctgtgacccacnctgggatnaannggtgctantataantcgntgctggcttgactcctgtgcctaagtgatcctcctgccttnactngngactagtnaggactannggncnacaccggcacacntggctaattgcttaaantcncannnttntnnntgganacgggannntantgngnacgncnangntggncatgaacttttggccttaagcagaccttctgntgcggcctnntaaanngnnnggattgatccnctnagncnnnnccatggcncatannattanctanaggtttaatnttaggtgantttnaccgtatattgaaatgcncaantcttaactgccagccnttaaagaantccnatngagatgtaatccatatactntagaaanntgtncatanttcaccatgcnttatttgnagggtgaccanttcangggttattt

SEQ ID NO: 2898 - DNA, 709 bp, Homo sapiens
  misc_feature (1)...(709): n = A,T,C or G
ngttaaganacagctctgttctttttgcaggatccctcgattccgaattcggcccgagggctattaaaaatgtaatcagtgtgaaaattcatgccatctgaatcgtacgagtatgtaagggatttgagttccttacagaattttctgtaatttagtacttcaagtgacttataaatgtatatacttctctctcacaaaagtgttaggagaaggaaaatcttaaatactagcttgatttcttaatttaataacaaaaaacaattctcataacatgtatcacctaacatgtcactttcactttaaaagtctaaagagttgaggtttatttcttttcttttaaagttgatgtttatgttggtgatttcgaaaagatcagatcccccgttatgaaggatcttaaccttgtcttttagatctccatgagaaatgcagtacatgtagcattagccatatttcttttttagaggcctatgtaggatatttataacctgtaaaagtttgatgacttcatgctcaggagaaagcaagtaattacctagccaagccaggtgggtgttcaggttagtggtaaacagaaaggagatgttgaaagatttcatatctaaagggtaaaaacacangagaagtatatagagataaacatgtaaagtataagactggtacatagtaagctcctncgaagtggcagccattggtattatttttctgg

SEQ ID NO: 2899 - DNA, 710 bp, Homo sapiens
  misc_feature (1)...(710): n = A,T,C or G
tgtntatagcggctctcntctttttgcaggatccctcgattcgaattcggcacgagctctcaaatagaaatgggagataagaantatatctgtgcaatattaaattgaaaaanggnacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttntcccatcccagccatgaatctttcaaccttagtggtcaccaacttgactccattccttatatcaagccttgtcctgtcaattctcccttaaatgttaagttgcatccatttctaaatatatccatggccatcaccctagtgaaaagactattacctnacaccccgcnctttgatcttcccccnncttttaagtgactcaattccttatatnactgccncaagattaacanccntgtccatctttcatttctctgctgaaagatntcanggggtcccctgantccaaatannngttcgatccct

SEQ ID NO: 2900 - DNA, 708 bp, Homo sapiens
  misc_feature (1)...(708): n = A,T,C or G
gnttntcaagtgacangannagctctggtccctcgattcgcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttggnggctatttcatagattcttctggattaatctgggggtccctggtatctg

SEQ ID NO: 2901 - DNA, 709 bp, Homo sapiens
  misc_feature (1)...(709): n = A,T,C or G
tttttacatcagctcttgttcttgcaggatccctcgattcgccgnattgggctatggaattggaaggcctgttttggagtactctaaattaaaaaaaagttatatttgtaaaataaccaccacaagattgcctgattcacagttcttctgagtattggcgtaggtaattatttaagatgtttgataaattgtaaaatgctttttacattttttaaggaatcaattgaactactggaaaccagtatgtagtattcttggcaggtctaggtttcataatcctaatttctttgcagcccactattcagaaatgtagtgattaacagagtcaagaatgtttcaggatatttttggctacaagtaacaatacctaactaaaagtgacttaaataataagcagtttgttatttcacagaatgagaagctcagagccagagagttacagggttggttcagcagttcagtttcatcaagaacataagacttgcttactttaaagctcctctgcatgtcagcagagggctgccccaattttagataccaacatctggccaaagaagagcagggaatgcttctttaagtacttattagggagcaaaacttccttaaaagtctcataggaggtttttccttaggtctcattggatctcaatggctcttgcatctagaaaaaggccacattccttactctggcatttaagtttttataccg

SEQ ID NO: 2902 - DNA, 752 bp, Homo sapiens
  misc_feature (1)...(752): n = A,T,C or G
ggctnnttnnccttgttnctttntgganctnnctgatccctcgattcgaattcggcacgagaggagatngggacagagcatcctaagattcaggagnttttnctagtcacagggagcngtgctattcagaggccccaaggtnnganggagtttggnctgtccaaggaacgcaagaaggtcantgcanctgangcanagtaagtctgaangagagaggtcagggctgagatcanggaggtngtctgaggcccctctgagggggacctgataaangggtttgaattcattntgaantgtaatangtccatattagaagcanaaactataaaaggagttangctgataaacctagggntcataacagcacgaaaaaggcaatagataatangacacaagcaanaaaaaattcacgtgattaaaataatacacttgcagagcttacaaagagaaatgtnagtnatccaggaaatctantngcatctaagncttcattcatcttaccagataaatgaaatgctnaaatntnagttgcttgcatacntaacacacagatattcttttatatacacacattcatgtcataaancatgtgangnttatcnanaagaattnanaatncttgtgatgagctttacttaccataggtcatattataatgattaatgagggcatttgaaatgtatttcacctatcttgagatttgcaanatgngtatgaaacatgtcatatcatnactatgcactntaaaagag

SEQ ID NO: 2903 - DNA, 757 bp, Homo sapiens
  misc_feature (1)...(757): n = A,T,C or G
gtcttcttcaagatgnancgctttcgnccnttgcaggatcccatcgattcgaattcggcacgagaccattttattttttgggccattaccctttaccccttattgctgccaaaaccacatgggctgggggccagggctggatggacagacacctccccctacccatatccctcccgtgtgtggttggaaaacttttgttttttggggtttttttttttctgaataaaaaagattctactaaaaaaaaaaaaaaaaaaaaaaaaaaaaaaaaaaaaaaaaaaaaaaaactcgancctttaaaactntagngagtcgtattacgtaaatccagacntgataagatncattgatgagtttggacaaaccncaactagaatgcagngaaaaaaangctttatttgnnaaatttgggatgctatngcttnattngtanccattntaagctgcantaaacaagttancancancantngcnttcatttnatgtttnaggttcagggggaggtgtgggaggtttttnaattcncggccgcggngccaatgcattgggcccggtacccannttttgtncccttnagtgagggttaattgcncccttggcgtaatcatggcatagctgtttcctgngngaaattgttatccgntcacaattccacacaacatacgaacccgggagcataaagtgtaaaaccctggggtgcctaatgagtgagctaactcacattaaattgnggttgngctnactggccgctttcaa

SEQ ID NO: 2904 - DNA, 750 bp, Homo sapiens
  misc_feature (1)...(750): n = A,T,C or G
cttanacaaantcntgtgacttgctctttttgcaggatcccatcgattcgctcagattaagggtttgaaaaacaaaccgaaaaagatgggcttnataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagagtttcgctcttgttgcccaggctggagtgcaatggcgcaatctcggctcactgcaaccgatacctcctgagttcaagcgattctcctgcctcagcctctcaagtagctgggattacctgcgtatgccaccacacccagctaatttttttttttgaatttagtagagatgggatttcaccatgttaatcangctgatctagaactcctgacctcangtgatccacccgcctcggtcttccaaaaggactggggattacaggcgtgagccactggacccagccgctaaacttttaataaggatt

SEQ ID NO: 2905 - DNA, 751 bp, Homo sapiens
  misc_feature (1)...(751): n = A,T,C or G
cntnngnagancctntttgacnagcnctttttgcaggatcccatcgattcgttttgccctgctaaaatgatgcttagcctgaaaaatcggattttnacttctcaaatttatttttccaactcagtaattaaaaaaacatttacttcctgcctactgggttgtggaatattgtcaggatctctgggttccaggtgagggatgcagaatgcagggaaagacaggtcccctgccctccagaagtcggtggcgccttttcagagtaacacacactggagcagacccctggaaaaggacagtccactggtggaccatgaccttggtcaaaagagggaccaggtctggcttgctcactgttttgcacccaagaagtatttgctcagggaatgagggggttagattcctcctcattcattaccattcttactaggcagaggcctcattgggattaaaagacaggaatgtaactctctgcccactgatagggaatgtgtgtttgctctttgtatcccaggggtgtgatacctctttcctgtggtcactctgcacttaagatattttggggcctggcacggtggctcacgcctgtagttccaacactttgggacgccaangtgggcagatcacgangtcaagagatcgagaccatnctggncaacatggtgaaaccctgtctctactaaaaatccacagattanccaggcgtggtggcaagtgccctgtaatcccacttcttaggaaaactgaggcagga

SEQ ID NO: 2906 - DNA, 753 bp, Homo sapiens
  misc_feature (1)...(753): n = A,T,C or G
tttttaatccttgctcttgttctttttgcaggatccctcgattcgcagagtcaacatggagcatctcactgtgaaatgatccatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagttcagtgtttcttgtatgcttgaaaataaagtatgtactgntttgaatgtgaaaannnctatntaaananactcnagcctntagaactatagtgagtcgtattacgtagatccagacatgataagatncattgatgagtttggacaaaccacactagaatgcagtgaaaaaaatgctgtatttgcgaaatttgtgatgctatngctttatttgtaaccattataagctgcaataaacaagttaacaacaacaattgcnttcattttatgttcangttccaaggggaggtgtgggaggttttctaatnagctgtcnactatncccnttgcnntnttatnncaccnaatttttgnttcntttnaananaccctatttccnggcntngccctanncnnggttnnaantgcnttcccntnaannnatcntncttgntttggccttccnanaatgcngggan

SEQ ID NO: 2907 - DNA, 781 bp, Homo sapiens
  misc_feature (1)...(781): n = A,T,C or G
gcntnnaagacccncttggaaattccccttttgcaggatcccatcgattcgaattcggcacgagcagcggcgaggtctgcgggaggcatgntttttagctnnggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcaggttgtgctgttaacaaagatagacacttttcttgcgaagactgtaatggaaatgtcagtggaggttttgatgcttcaacatctcagatagntttgtgccagaataatatccataatcaggcccatatgaacagagtggncacacacgagcttattcatgcatttgatcattggcgtgcccatgccgactggntaccaacatcagacatttggcccngctcaaaggttcngagctngctaaccntanngggagacngnnnaacntggncaaatganatantcaangccacatttacggnncnanaacaacaccaccaaacttggngngcgaanananannccctctttnnnatncnggnnnnnnnngaacnncaancncaannaanaagcctnnanaangcncnnnganccaannnnnnnnnaaaannnnnncaancnncccnnnnnccntnnnnnaagganccc

SEQ ID NO: 2908 - DNA, 699 bp, Homo sapiens
  misc_feature (1)...(699): n = A,T,C or G
ngttaagacctgctcttgttctttntgcaggatcccatcgattcgaanaattttatggacttctatggatatttcttgatgcttagagatttgtttttttaattgcaaatgtgaattgnntatttacnaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaatagcactttgagctgtattgaaaaatatgttgtctcaaattaagtagagtctatggttttgnaaatataaatatattgccagaaaatacatcactgggggagcaaaacatgtagaccaaatataacagggattagnaacatcagtaaacatagttgggaaaagatggcactaaagaaagccaagaagaaagtgttgctcttgtnaaccaaataaaaaaaaaaaaaactcgagcctntanaactatantgagtcgattacgtagatncngacatgatnagatcattgtgagtttggacaaccacactagaatgcagtgaaaaaaatgctttattgtgaaattgtgatctatgctttattgtacc

SEQ ID NO: 2909 - DNA, 729 bp, Homo sapiens
  misc_feature (1)...(729): n = A,T,C or G
ggatccnatngcnggatcccatcgattcgaancccgcncgagtctaggcntganccattgcncccancccaggtttttaatnnaannnnaancntgctgagnntnnaangngaaaagaggccagntgtggtggctnctgnctgnggncccagctnctccggaggctggcgcatgaggatcatttnngcccaggctgcaatgcaanggcacnnatcacggctttctgcatccttnacntgctgggcnggacacggagaccctgtttatnaangatgaantgctggagtacncaatngnatatgnnanataantncaactntnntaaagnanctgtatatnnaatgagtggaagcanatntggcanactgttaatngtacatatattgaaactatagctttnacacttctttgaccacaacgggtatatgtancacttgatatgatgcacaatnngtgcaccanntatatntntgtcttntgacntgggttttgacnnagnttcactntgcgtncagncttgangntgctactnactgaagatcggngnaaaatnntcnnctncactgggnngattanaanatatactggngttatcantggaagaaangttntntacccaaannnntngaaccctcttttaaaaggattggntnnagtaaattttaccgntnggttcccctacnttntttncaggnttccnttttggnnngagttttngnnccaaacccc

SEQ ID NO: 2910 - DNA, 751 bp, Homo sapiens
  misc_feature (1)...(751): n = A,T,C or G
ganggctcttgttctttttgcaggatcccatcgattcgtaaatgttgaaattaactagacaaagtagttgaagtcctgatgaaaagattgttcagttcttcttctcctgtagctcagaacctgtttggatcatacatttaaatgtagaaatataaagcttttagaagaaaacataggtgaaaacctacaagacaaaacttggtgaagagtttctccatgtgatgcaaaaacatgatccatagaagaaagaaatctgtaaattggactttatcaaaattaaaaacatttgctttgcaaaatgccctgttaagatgatgaaaaaacaaactacatactgggaggaaatacttgaaaactgcttatctgacaaaggactcttatctaggatatataaaaactaaaaactcaatagtaaaaaggcaaacagtccaattagaaaatgggcaaaagatattcatttcgccaaaaaggttatacggatgtcagctgaacacatgaaaagatgttcagcatcactagcccgtcagaggaaattgaaaaatgacatattacccacacacctattagaacagttggaactcttgcttgaaccccangaagtttaaagacccggcctgnaacaaccaccangccaaggaaccttgtcttaaaaaaaaaattaaaaatttaaaaaaattagcggacccaattttggaaattggcntgggcaaaaggaatttttgaaagaaaaatcangaacttcttnantnac

SEQ ID NO: 2911 - DNA, 720 bp, Homo sapiens
  misc_feature (1)...(720): n = A,T,C or G
tgggnnnnnnttntnnnnntacangctacttgttctttttgcaggatcccatcgattcgaattcggcacgagaagatgtttgattcttcagataacttttgaaatgtgctataaagggcctagtttaaaaggaacttcttttgaaaagcaattaacagttgataaagggttaaataaaaattatctagtaaggaatttcttattggaatgtaaacgtggttctaattttaaatagacagtgatataaagaataaaaagtaaacagtgaaattgagttctccagggaaaaggcagacctgtttagtaaaaaaaggatgcttttttcagtgatgtctttttttgagtgcatatgtgtgtgactcttgaagaaatccatgttcagatttatcagatgattgaagtgggtgttctgaataaagaaagctgtgaggcctgaggcagtgacgtatcaggaaacatattttattggagatttggaagctatagtaaaacataatggcaataagccaacttcccagtggtaaacccacagtggtggtttagttactaacctcttgatgaccgaggaggttaataattggatattgcagagcagcaatatgtaacctgtgtgtaatctcanggccctcaggttaacagtttcagtnagaagctaagagaacactgacaaaatttagcttaccatgactagctgccagttttatgtgggcctgtgttccc

SEQ ID NO: 2912 - DNA, 715 bp, Homo sapiens
  misc_feature (1)...(715): n = A,T,C or G
gnnntnnnttttnnatnnacaggctacttgttctttttgcaggatcccatcgattcgaattcggcacgaggtcagaatggggaaagtggcaggatgcaggcaaacatgttcttaatttagagacagatgaaggctcaggactttcctaggcagataaaagaagaaagaagctgctttttgaaaagagggatcaagattaggacaaaaagggagattcagccatcagcagaacccaaatgagagcctacaaagagacactgtctactcagagtacatcttcagacatccagggtcccaagctactgtgtttactgttagcccttagccattgttaagtcttactgctttataactcttctttaagaatatattaatagtaaaattacttactcctatatatacaacgaatccttaattatcaaaaacatttatagtcatcacctcatgattcagtttgcccttctctagtccaaatgaattgaagtaggaattcataggaccgttcctagtgaagaaagattttagtgctatttaaagaaagtaaaaagtatattctcctctgatagaaattttcattctgataatattttatttgnatctttttttaatgtcatggcaagaaatgcaagttgatgggcaagggacaatggctnacacctgtaatcccacactttgggangccnanatgggctgatcacctgaggcaggagttccn

SEQ ID NO: 2913 - DNA, 705 bp, Homo sapiens
  misc_feature (1)...(705): n = A,T,C or G
gttnnnnnnttntnnntanacaggctacttgttctttttgcaggatcccatcgattcgaattcggcacgagggcatctggactaatagtgaaagagtggaatagtgtgaaactgcatgctacagttatgaatacactattcaggaaagaccccaatgttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcanggatgtggacatttggatggtgacttccctgggtggntccccatagattcaccattgcctctaatggtgtctacacccgtcatactaccagctgagatggtggtgggcataaggagaatttgtgcctatacccttagtgggtctggttttttcttttaattnttaaattgtcntaaaatctcataaaacatactgncttcaccatttttaaagtgcacagtttantaaccgttactggtaatccttcataatgctgtgtggcccgnnancgccgncatnttcataggcttctcacttggnaaaatgggaactggcccattaacaagaattccactcctccaaaaaaaaaa

SEQ ID NO: 2914 - DNA, 714 bp, Homo sapiens
  misc_feature (1)...(714): n = A,T,C or G
gttnnnnnttcnatatngacaggctacttgttctttttgcaggatcccatcgattcgaattcggcacgagaatatatcacatcatgtaataagcctctcagagatgtagcattgagcagattaaggcctcatttatagaagaattccaccctggccatgtgggcctgaaactctggagggctttaacaatgtcttgaggtcattgtcatttaaagagatgactcantggttttatttagtagaaataaatactaaataaataatctccacagattatccagaggggtaagttgaaggatgttgacagataactcagtaaattgcgtctcaaatattaataagtttattctatgccagcaccaaaaatatttcagagatgcttttaggcttctctcaagtatgtcgggaacagaaaaggattatagaaatatttatagtaggcataaacttgcacaaaagctcaaagtaccttaagcaagcttgttgcaattattcttttggagaactggattaagtaattatttcttgttgcctctgactatttaacctcctactaaactgcccattgnttaaatgtctcttatttagctctgnttttatcactccttaaatttaatattctcaaggccaaaattatagcantgatggtcangacatctttgaagacaattanattctgagaggataatttatatgtanaattaggaatattcn

SEQ ID NO: 2915 - DNA, 710 bp, Homo sapiens; identical to SEQ ID NO: 2899
  misc_feature (1)...(710): n = A,T,C or G

SEQ ID NO: 2916 - DNA, 717 bp, Homo sapiens
  misc_feature (1)...(717): n = A,T,C or G
gnggcnttntgtanangntacagctacttgttctttttgcaggatccctcgattngcagtcctctgcataaagctgagagatgcctacagctgagagtgaagcaaaagtaaaaaccaaagttcgctgggaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacanacaaggaaagccaaataaaaaggtgataaagacggngccccagttgactacacaagacctgaaaccggaaactcctgagaataaggttgattctcacaccagaaaacacatncaaagcccagccaggcgttgatcatcanaaaagtgagaaggcaantganggaagagangagactgttttanaagaagattgaanaattgntgcagccttttcantgncatgtnactngaagnaatgggcaaaggagatttanaggggaattnnnaaanancnc

SEQ ID NO: 2917 - DNA, 740 bp, Homo sapiens
  misc_feature (1)...(740): n = A,T,C or G
attttatgcttgctctgttctttntgcaggatccctcgattcggctgggctagcagaaaaacctcaggcatctgtgaggacatgagtttacacacgctgagactcacagatncaaaaatgcaacccaattccacccctgaattgaggggagtgcatagaagtgaatgtcccgtctttctgaggtctgttgattttgtaattagtaaacgaagggtgcatttctgatttttttttcttgtgtgctagaattcattgctagtaaaactcaagataatagcgatgagtaggaggtatcaaagatgaactgtagagggacagtttaagttacttaagaatcgtcagcaagatgaaatctacttttagcagaaattgggtttttttgtgtttttttgttttgttttattttctaaaagtaaagtctgcaccttgttcagcctgttagtggaggtctgagcaagtaaaagatgggttggattataaacttacaaacacaggatgttctgtttctcaaacgggagaaattaagaagagatgcttgtattcaggagacggcatagctactcaaaatccttgatatcttgctatggttagtcttgtccaactgtgctatgtgacctactatggctttatgangtaaatttagtatatgtgtcactatttgaaaatttacatatagttatacataatgnatttaagngncnanngnacngaancctnggngnnaanattngnnccntnnn

SEQ ID NO: 2918 - DNA, 710 bp, Homo sapiens
  misc_feature (1)...(710): n = A,T,C or G
cttnnaatnncagctntggctacttgttctttntgcaggatcccatcgattcggtcagatggtagaaaatgaaatanttaaatagataccatntgagttctgggagccaggtgaagaagtgtttgtttgtttttgagacggagtctcactctgttacccaggttggagtgcagtggcctgatcttggcgcactgcaacctccgccttctgggctcaagtgattctcctgctccagcctcctgagtagctggggctacagacgtgtaccaccacacctggctactttttgtatttttagcagagaggggatttcgccatgttggtcaggctggttttgaactcctgacctcaggtgatctgcccaccttggcctctcaaagtgctgggattacaagcgtgagccactgtgcccggccanaaggagtgttttgagaatggctaanagaagataggttgaatagctatgcctacatgtcactaattaacatctcagagatctctgctacaggttgncgacctcatttagtctaatatttttccaatggcatgagtataggaagataaacggggaatgttttgaagtaataaaaaaattccatccataaagaagaacaacatgtattaagctttgtgcaccaaacaacacaacaggaagacacataaggcagaaccttttanaaaaaaaannnggnnnnccaaanagcaggtnt

SEQ ID NO: 2919 - DNA, 710 bp, Homo sapiens; identical to SEQ ID NO: 2918
  misc_feature (1)...(710): n = A,T,C or G

SEQ ID NO: 2920 - DNA, 713 bp, Homo sapiens
  misc_feature (1)...(713): n = A,T,C or G
gttnntngatcagctcttgttctttttgcaggatcccatcgattngaattcggcacgaggtaccacatctagatacgaggtcagagttcagatgcctaaatattgtagcttgtgtttngtccactgttgggggaagagtgaagagatttgacataccataatgttgattagcttgtgatggtttggcggcagcttaggccagagcataaagtaaaaaggaaaagtgttcacagacaatgaaaactgggaccaagtggtgaatactcaaggcacacagaccangcaaggatcccagtggccgtggatgagtctcaggctggctctgggccantggaacacacctcagtgtgggtgaaggcctagccagggtagcanagggcagggctacagaacagcagcccangtggctgtggccgacctgacattctcctgtgaaaatcangtgcccaaccagcactaacctagatagatggcancattttntttctttaangacaggatcttgctatgttgctcaggctgactttgaactcctgnccttaaaggatcctccctcttcagcttnccaaancactggggttacagatgtgagcccttcaacgtnagtgccatngggctanaancctaaccccncattgcttgntgatcgtnacgctcgnaatcnntttnataaacggntntncaanccttgagcttttccgggttaagnaann

SEQ ID NO: 2921 - DNA, 702 bp, Homo sapiens
  misc_feature (1)...(702): n = A,T,C or G
gttactcctctnanatcagctacttgangatccctcgattngaattcngcacgaggcgatttatttnacagagttaaggggccagtacacttnatggtataaaattatctttntcaggggatgaaggcacaaggagaaaattacttgaagcttggagatcttctctggcaagcaatttacaaattctggtgttcttngatctggctcccngcccagacaaccanggagttnttnatgttctatcctcatgtgnnannactatacgcaataattngncntnngccatanaggagggatccgatanntgacatngctntccnncanatatactncncntgnaatgnnnctnataatgcatnnnntnnattcctntctaggntacncnnanttatatntnntnggnaactcatttaacancaanttcacngcattcccntggggttacatatacnctnaagactatgctganactgtgcaccatgnctacatnngggaattggatggggtgcttnacggactnccttgnatgcaagnacttaccagacgtttccanccaanctgacattgntgnaatgcattacncacntggtgntncaantttactacacctcganaggaccgttcacnggnatttaacctntcaaanatngttcnnanggttacaaggtccccaattgtnnganccttggggctttgncaacn

SEQ ID NO: 2922 - DNA, 708 bp, Homo sapiens
  misc_feature (1)...(708): n = A,T,C or G
anaccntttannctngttctttttgcaggatcccatcgattcgaattcggcacgaggtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgttgggnt

SEQ ID NO: 2923 - DNA, 715 bp, Homo sapiens
  misc_feature (1)...(715): n = A,T,C or G
gnnnnnttctaatgcnnggctnttntgcaggatcccatcgattcgctcccattcccggaaggaggagacagttactgtctatcccgcagacgtggtgctctttgaagggatcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggcccttcaaacggcagaccaatggctgtctcaacggctacaccccttcacgcaagangcangcatcggagtncagcagcaggccgcattgacccgtcttcatcggaccc

SEQ ID NO: 2924 - DNA, 724 bp, Homo sapiens
  misc_feature (1)...(724): n = A,T,C or G
gggnctttanatctataggntacaggctacttgttctttttgcaggatcccatccgatgcgcaagtaagaaaacatggcggctatccttctctcacatcgaaaaggaaattttgaacaatcatggaaaatctnggncgtgctgngaaaacanagaagagaaatgttgcaggaaagattgtttaanactaatgaaataccttttagaacagctganagaaaggtttaacngacaaaaancatctggataaatnntcttcttatcatgtgaaaactgccttctttnacntatgtncccagnaccctcaanacagtcagtgngaccanacnganctggncctntgctttganaactggatgacattcttgntnnattgcctnaggtcagatnnacttgagaattagttcatccnnncttcaatctatcctcttgcagaattntttgacatntacntcagcaatntttgctntancanagnccnatgtaggatatctatgacctnncanngtttgatgantncntgcnnctgnatnnnncgagagatntcctaacnatnncannnnntaanttctggtantgctcaacagattggaaaaaggggccaganctgtgnctnaanggttaaaancncaggannagtattttncgtaaacatgnaaangnttangactgttcatnnnttgntcctccgaaantgggcacccnttnttattnattccnctgcg

SEQ ID NO: 2925 - DNA, 748 bp, Homo sapiens
  misc_feature (1)...(748): n = A,T,C or G
ggtttantttaaatccntncncagctacttgttctttttgcaggatcccatcgattcgaattcggcacgagcggacccatcggagcgtaacctggatctccgcaggcctggcggaggccggccacctggaggggcattgcttggttcgcgtggtancagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcangtagcaatcgacctcaggaaatagaaattggagaatctggttttgctttattattcccttcaaattgaaggaataaaaatncaaccctttcattttattaaggatccaaagaatttaacattagaaagacatnaacttactgaagtaggtcttttagataccctgaacttcgtgtggtcttgnctttggttataattgctgtaaggtgggagccagtaattatctgcagcaagtagtcacncttttcagtgatatgaatatcatctttggcttggangccantngacaacctgncattactgactttttgaaaanaaccctctggatattgatgcctcgggtgtggttggactgncatttagtggaccccgaatcc

SEQ ID NO: 2926 - DNA, 815 bp, Homo sapiens
  misc_feature (1)...(815): n = A,T,C or G
tnaatanagctctngttctttntgcaggatcccatcgattcgaattcggcacgaggtcttcctgtgcagggtgctttggtagccatcagagaggaaccaagggcaacatcttttcttcccaggcgttcttctctgggtgctttattctcttctttttctttatttcgcccccacccccatcccctgcctttnttttttttttttgtatagaaacagatccatttcttggtaatcaaagcacatttgtttggtcttcctccaaccctttgcatttgatttctaaacattccttcatatgcctttaatgaaagccagcanttatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacangactcaatatagcaattnattcttgatgtatgcaatngcccattggaaattatttttaacagagcnccacttaattaatttggaataggattatataatattagaatctttggggtatgggncttttaacccttcttnccatgggggaaacttnntttcccttnccctgaatggtgngaaattgggaccatttttaaaaagcctttggtcccggtgnaaccttttggcattacccatttnaaaccgnangccnccaggntttanagaaaccntgaaatttgaagaaaaaaagggccccaatnggncnttgaaattttttaacccnatgggtggccc

SEQ ID NO: 2927 - DNA, 756 bp, Homo sapiens
  misc_feature (1)...(756): n = A,T,C or G
tggnagtgnnnnnnnnttttataaagacaggctacttgttctttttgcaggatcccatcgattcgaattcggcacgagccaggcttgaagttatctctaatttagaggttagggacagtgacacaggaaagaggctctgtgctttatatctggagatgtgggatcataaaaacgtctttttaatctgatgatcattaaaacacccggtgatgtggcacagctgctaatcggaatacatttccatttctgcggggattgagcatgtcttcggaaccctctgcaatagctttagaaacaaacgttccttttatcaggtgagaaaactaccctatggcatgcctccggatatgtagttcttcctangctacaaaatatcagaggttaacttcaggcaaaatgatnaaactagcagtagtatttcctattactatctgcagnttgcttcaaaatttcaaaaaggtttcngaaaaatcactaaatacgaagggcacacttcattcatttattccaaggaatctatttggtgccagacattgcatggaattgtatggatttttaaaatgaaatgggggctctctcttaagcagaccatggcaaggaaacttgaaaactccgacgcatccangggacgaagactnacatttacatngagatactactcgggattcacaanacacgacgtntccatgacgctcggtcaacacttgcatttttacctcatgggattcnggtcctctttcatttaaaaggcgnggc

SEQ ID NO: 2928 - DNA, 712 bp, Homo sapiens
  misc_feature (1)...(712): n = A,T,C or G
gnnggnnnnnnntttttanatcagctcttgttctttttgcaggatccctcgattcgaattcggcacgagattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcanctaatgtcatggtctatgtgggaattnccaaaggacantgtgagcaagaagaagaaagtccttaagaccattcaagatggagattctgacgaactcacataaagcgattattgaaggaaagagaacccnagcctgggcacatatttctgcaaggcacgagaaatagggatttttaaaagnntagaaacagncaaaaaccacnaccatctatntga

SEQ ID NO: 2929 - DNA, 752 bp, Homo sapiens
  misc_feature (1)...(752): n = A,T,C or G
ngnanaacagnntttnagatacagctcttgttctttttgcaggatccctcgattcgaattcggcacgaggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcgtggaggagatcgaacaggcacccacatgtctcgggcaaaaatcacatcttgaacttgctaaagttatcaatgatggcttatattattatgaacaggatctatgggtnggaagaagattgaaaccaaacccacnngccntaaaaggggcaattncttgngaaacgccctttctcgntatgaaa

SEQ ID NO: 2930 - DNA, 751 bp, Homo sapiens
  misc_feature (1)...(751): n = A,T,C or G
gagngnnntnntttcnaatnacagctacttgttctttttgcaggatcccatcgattcgttatagctgtgtcggtctagcattttctttgaagcatatggaacatgttctgctactcgagataatgaacatttccttctgcctcaaggtacaatcagtttatgatcctgggagagcaagaagcaaggagccagcaagtctggacacattccanaggccacgaggggttttatgtcctgagtcctggattccatccaagccatgaggggttttatgccctaggcttaggttgtagtgcggcggggcagccttccacccttaagcacagaacctggtgttccataggccacaagaagttttaaactctggacccaggacatgttccaaggctcttttcatattatgtcagactagcaagtcttgcctcagctttnctcccaacaattggactgatgggttgctccactgggcacaagcatcatgggttcttaaaacaaggccctgaacaagcaccaaatatgttcctgtcaccacactncactagcccttcaactataaacatgcataggagtcacctgggggccttgctaaataaaatgcaacttctgattcaataagtcttaaacaggaccagaagattctgcgtctcttggtgagttcccnagtgangcagacaatgcccagttcacaaactcacattttgagatacagnacctgggccatttnggttcccaatgtgcttgataaccctgg

SEQ ID NO: 2931 - DNA, 755 bp, Homo sapiens
  misc_feature (1)...(755): n = A,T,C or G
agntgattccnantgaaagcccttgtctttntgcaggatcccatcgattcgaattcggcacgagatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggangtcacactttctctggnaagaacccgncaccatgaactggctggangagaacgtncacganggtctgcaagcantgggatcccgggacccagccgtgggaacctgtgaagaaccggcggaag

SEQ ID NO: 2932 - DNA, 849 bp, Homo sapiens
  misc_feature (1)...(849): n = A,T,C or G
ananatcagctcttgttctttttgcaggatcccatcgattcgaattcggcacgagatgactgagtgtataccctagttaaaatgatcaggggagacttaactgaaaggggtaattgagctagatttgaaggatgaggagtagcagactagtcaaagaaagggagagaagaacatacctaaacatctgatcaccagtgactgagaaagttatcaggatcaagtggaaagagaaaggactagcagagttacaggttagagaaacaggtaaaggctactatggacggcataatagttgcatcccatgttttgtctcttaagaacagttgcaaactattgaaggttttaaagctgtgtgttgggccgggtgtggtggcttgtgcctgtaatcccagcactttgggaggccgaggcgggtggatcacgangtcaggagtttgagaccagcctggccaatatggtgaaatnccgtctctattaaaaaattaaaaagtagcccaggccgttgtggcatgccccctgtaagtcttcaactatttttgaaaangcttgaggcnagaaagaaattcgctttggaacccccggggaaagtggaaagggttgccaantggaagcccnnaaaaatcggngnccacnttgcaatttcccaaacccttggggccgaaccnnaanccnaggaaactttnggtntttaaccaaaaaannaaaaaaaaaaaggccctttttttngaaaacttttttantnggaaggtncnntantttanccgttagnattnccccggaccattggatttanggnattcccantttggattgaaaatttttngggaacccaaaancccccccaaacnt

SEQ ID NO: 2933 - DNA, 855 bp, Homo sapiens
  misc_feature (1)...(855): n = A,T,C or G
ngngtganccnnntttttatncanacaggctacttgttctttttgcaggatcccatcgattcgctcaagtaggtttttatttatttattactttattttattttattttattattatttttttttgagacagagtctcactctgtcacccaggctggagtgcagtggccggatctcggctcactacaagctctgcctcctgggttcacgccattctcctgcctcaacctcccgagtagctgggactacaggcgcctgccactgtgcccggctaattttttgtatttttagtagagacagggtttcaccatattagccaggatggtctcgatctcctgaccttgttatctgcccgcctcgacctcccaaagtgctgggattacaggcgtgagtcaccatgcccagcctcaagtaggtttttaatgaatttcttatacttttaaaatacaacattatggcantaaaagactattccactncttttctaatctggagattgnattgatttttctagtggtaattttctggctcatacctncagtaccaatgggtgaaataggtgggtttaaagtaggaaaattcttcgtncnggttttccaaaactttgcaggaatnaaaggcccccctangtccattttncacccatttaaaggcnntanttaagcctttttnngggnggtnggnaagtttttttccaattctttgggcnttcaacttgggnaanncccttnaaacccttcttttaaaagccttcnaaagtgggaatcccttncccaanccttttaaactgggccctggaaaatnaanttttgggggaacaaattaagggccattggccacccaaacccatggcccc

SEQ ID NO: 2934 - DNA, 727 bp, Homo sapiens
  misc_feature (1)...(727): n = A,T,C or G
nagttangnngntttntanntctggttctttntgcangatccctcgattcgaattcggcacgagancgattaacactnctaaagngtcaagngctngggtntttnggcttagntgtgctgccntcgnggaanncatntntggggnaatggtgtnatacacctcnattanaaatnagcacatgatggntggncaccgtggctcacgcctgtaatcccngcactttgggangctnaggngnnnggatcacctgangtccngantttganaccagcctgnccaacatgnnganacctcatcccttctnnanatatanagaantagctngncatggtggcgcacgcctgncnttnnagctactnaagacgctgnngcaggagaanctnttgaacccagtaggtgaaggttgcantgagctnncatcncaccattgcactccagcctgngccncnagancgaanctctgtcttatacatgcaaaaannaggaggttggattacttgaggtcatggatnnanatcantctgaccancatngtgaaacnctatcnctncttaaaatnttaaattagccnttcatggtgacctcacgcntgnantcccatcttctggggaggctgangcaggagaatttctagacctgggangnngagttcagcngcannacggccctggatccacctgggcacaaaacgaactntnctcaaaaagaaattnacccttaaacttn

SEQ ID NO: 2935 - DNA, 759 bp, Homo sapiens
  misc_feature (1)...(759): n = A,T,C or G
ngnnggangctnctttcagctcttgttctttntgcaggatcccatcgattcgtctgggaccaataatgttttaaaaatatattcatttgagattcagaaaacttgcacatcatttgctactcctatcatcttaacagtgaagaaaactgaggcctagagacattaagggggttgcaggtccagagacatgtctcaagaaagcattgctgttaaaatgtgcagttcgtgggttttcagtccatctcttaagaaaccaagtcaatcttcccctcaggaaaaagaaaagaagtagcaataagcaatttgttaatatcactacttcttatcaaggtaaaaaatgcctcataatcaggcatacccatgggccttgtttcacaaaggcactaagatgaggcaatgtaggtcccaaaaaacaaaaagacagttttttggagttgctgaggttgacaaccctagttttatactttggtaataccagtgaccttggaattacaagcttggggttaagaactcaagggttcattaagactccctggaacattctggaaaaccagctttagagtcttcattgaactcaaatctcagcaccacagttaaatgagtgagtcaaaaagaacataagtttaaagaaatttaaccanggaaccagatgtttctcttcacaccacactgntttaacatccagtattcgtngacctttttctttcccccaccatcctntggatttaccttaggctttccaaaggcnttaatgaaant

SEQ ID NO: 2936 - DNA, 843 bp, Homo sapiens
  misc_feature (1)...(843): n = A,T,C or G
tgnnnnaatcnctaatgcnaggctacttgttctttntgcaggatcccatcgattgggaattcggcacgaggctatttgtgttttgttgcactgttttttttgtttgtttgtttgtttatttggttggctttttggagagggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaantttattttcccctttaaaatgtattnctttagaggcattacttttttaaaantattggtcaattcctgacatacgatgtgaaggttnacaagttggatttccnagtattccaanatnaanttccttgatttttcaattaaggcaaaaacgtcaaaatcccaaaanngntnnccnataaaccaaaanttgcnnttntttaaaaanggnttangccttttaaatanngaatcanttaattcntntatnnngcntngnnnttgnnaaaattancccctntnnntannntnccctttntnttaaattttnngggtngnnctggaaaaanatnngnccccttgntanngggcctccctnggcnnttanagaaaaacccaactnntngggggcg

SEQ ID NO: 2937 - DNA, 766 bp, Homo sapiens
  misc_feature (1)...(766): n = A,T,C or G
aggtnnntaatnttctatacagctacttgctntttccgcnngatcccatcgatnggaattcnncacagagatgacctccaatgtggccagcgacgagatcgcacagcacgcgctgcagctgaggcagggggctttggagatgagccgtaaccgtattgccgaaaacctgggggatgtccanataagtgacaagatcaccatctcaaanaacttcaanganaatgtgattcaccctatcctgaaagctnacttccnganggatgagtntctgggacggatcaatgagatcgtctacttcctccccttctgccactcggagctcatccaagtatcnnacaaggaacttgaantnctgggncctnanaggcncncnnnnggncaatnnnnatcnnctcngtgncntnataaacactgattctcngtntgataantacgatanacnatatcattctgtnatacncaaagangtgncaccanccctnttctcactnttgantanctntggcngtctnttanggtnatanagtgagccctannaaantcccattnntacttgaagcatacnttttggcnnaaaaacnaggttcttgntatcaatagctcctaanagtcnaaattntncattttaaacnnnctgttanaaatttttttcaagcnnnttantgannattcctaatgtaaaaccttttnaaaaacnaancctttnaaggtaaaaannattnttnnnttcttttcaaaacnttntttnaacccaagnanncnncct

SEQ ID NO: 2938 - DNA, 749 bp, Homo sapiens
  misc_feature (1)...(749): n = A,T,C or G
ggngtgnntttnagatacagctacttgttctttttgcaggatcccatcgattcgaattcggcacgagcaaaggccgtcacaccaaggtcaggccaggagcctaggctaaaggaaacttcaccaccggggacatcagctgctgtggccagagaagagaacatgaaagcccacatcccgtgcctgcagccacccactttgctgtcacttcccagctgaagtgaggagggactgttcagaaacatcgaactgagcaaggtctctgtctacctcatggaaaacctgatctggaaatgacacttggaataaaataagattactcttccattaaaaggaaatccacccaaaagagagaaatagtggtatatttcagttttacataataatttctagagataagataacccattgcattagttgattcagttaccaatttagctaagtgtgagggagaacatgggccttgactttttttctttcagaaaatcaagtttgccatattgaaaaatgctgtcagctctgccaccggttctgtcattaatcatgggaaagagctgatcangttttgattgtttcttcagangcacttttgtcatgtaatgcatatatttcaattaaaatatgcaggagaatgcaaagntaataattnagggaaaatnatnaagtgttgccattggctattaattactaaaaaaaaanaaaaaaaaactcgagcctntaaaactatagtgagtcgtattacgtaanatccc

SEQ ID NO: 2939 - DNA, 770 bp, Homo sapiens
  misc_feature (1)...(770): n = A,T,C or G
cttattncatnnagctcttgttctttttgcaggatcccatcgattcgaattcggcacgaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatatttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccacactgattggactgccctacaccaatcagaactcagtgcccaatgggccactgttttgactcggaatcatgttgtgcactatagtcaaatgtactgtaaagtggaaanggatgtgccaaaaaattaaaaaaaaccnccaaaaaagcttccaaaaaaaaacctttaaactatagtgagtcgtntacntagatccaacatgataa

SEQ ID NO: 2940 - DNA, 904 bp, Homo sapiens
  misc_feature (1)...(904): n = A,T,C or G
ctacttgttctttttgcaggatcccatcgattgngaattcggcacgagaggtaggcacctggcatgtcagttgcctgaatttgaaagttttcacctgtatgttttggncgataaaaataaaaatgtaatttatatatctgaatcaggtctgtatgttatgatcaattgctcagcaatttcgggcagttggtttgatggttatgtagtaatgtancctgagagcagaaatacagagcctctgggctaganaaagtataaatggcatcctaggctatgtagggttcagctcttcagaaggaactttcatttttcattgtgacacatcgactacatgttgtanaagaacatagtttcannaattcttccngttagaaacatacgtttcctcaaaatatttcactttcangcattgggtanaaaaagtncccatgtnattngactangcnnatntnctttaaaaaatangccantttnctnnaacccanngatanatanccccacgtttntttaactattttcangtcattttaacantcnccctncattttctnnnnnccnnnggnttaanttctcnancctattttncnncncanaaacnntnccnttctnacctnaatcatattttcccactnnncctnaactannnnananancatntnnattcnctcatncnannnnnnttggcatannntttanactataggcatnaactcnttcatatnnatatnntnctncaatntacatnatnttngnctanatnttcatcnntctattctncnnnntcatnnnntaannnnttcccnacnttannnnntatcnnnnntanttgttcntatancncntntatcnntcnatantnnnnatntntanntatcttancntatccanaatncananacacgcc

SEQ ID NO: 2941 - DNA, 771 bp, Homo sapiens
  misc_feature (1)...(771): n = A,T,C or G
tncttcaannnntggtctcgtctttcccaggatccctcgattcgaattcggcacgaggcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtggagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgnattaactggttaaatttttaaaatatcttgtagtaactctttaaaatgtatgtaaagtaaatggctgcagaaaggttttttagagaatccctgcttccatcagtaatacagcaatattacccccaaaaaaaaaaatnaaaaaaaaaacttcgagccctntanaactatagnggagtccgtnttacgtaaaatnccaggacntgataaggantccattggatgantttgggacaanccncacttgnaatgcantggaaa

SEQ ID NO: 2942 - DNA, 755 bp, Homo sapiens
  misc_feature (1)...(755): n = A,T,C or G
ctnttaantnnctcnttngnctacccgttctttttgcaggatccctcgattcgaattcggcacgaggtactttgagtgtttgggggttcannncacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttggttttcttttgctattggtaatattcaaaattaaagtgttcattggtacctggtggccttaatgcatttattgnagacagcattgagatgatgaacaaggggttagcaatagccaactctataataattttgcctaaatacc

SEQ ID NO: 2943 - DNA, 748 bp, Homo sapiens
  misc_feature (1)...(748): n = A,T,C or G
ttnanntnatnttgctattgcntnttgcaggatcccatcgattcgaattcggcacgaggcctcatccatggatcagggaggcacgccagggagtaacccagttctgcccagcaagctacaccccactaactctgggccctgtctgtgctatttaacatttcattnanacaggagctcctgggaagaagcttggctcagtatncttggnagatcacccctcaaagnctccctcnggtatattctaagtgangacggatcccatatatacctcacttaggctttactctgctctgcaagcacaggcaagaccagctacatctttgnacgccacccctggttcttagtaggccaagaacctcagaaactggnanggcactaagagctgtattttagaaactgtgttgaaattacatttattcagctttgatctgggngggccctgtacctggcactgctacaagtgtttcaagaaggtgcgaangagatatttttacaggcaaaatagantatatttcctctncagnttcatttgactgcttgtttaaaaaaaaatatgaaagatngtacagagagtncccatatcccctcatctagttctcctntattaacatctgccattagtgnggtgtatttgtcacaattaataaacccatagtggtnaaattattgntggcaaaaatccatacttcattcaaatttcctctggtnantcctaatggccttttntgctattctanggatcttatcc

SEQ ID NO: 2944 - DNA, 784 bp, Homo sapiens
  misc_feature (1)...(784): n = A,T,C or G
gtnnnnntngtgtaatcgcttggctgcaggatccctcgatggcgaattcggcacgaggtgttgctcaangagcagacccgactccntaaggtcatcattgaatgggcatnatangtttgaanactgtccaananantangngtcaatacatcaacnnctttanntgcttgatattgnnattgaanaacacangnctcngnctagttcgcctganatgatgtttaagatactccggaaggagacanantgttntgantgcggattaganaccacngaagnnacactnaaggancancatctccacctngnaactgnattnncngaccanaaaagngaactggaccaaatgctctcaaaggtgctggcagcttaanagcgtgttangactctgcacgaagangacaggtnntntgagagcctggnnannacactctcccaaactaaactgnanctttcaacananggganccccannttggtggagaaatcaggtganctgttggcccttccacaaagangcaaattctntgagggcnagacttnancctttttgcngaaccagtncttgactgactaaatgaaagctttttaagccaggtggcccanccttaangaagcnactttttaatccancggaaccngcttgaganaaaaccntttttgacccaaaaccnggagaaccagctggcctaccaaagggaaatgggcccccatttgaacttggggttncccangaacaanccttgnccgggncaaagcccnttgttggaaaggacctcaacct

SEQ ID NO: 2945 - DNA, 765 bp, Homo sapiens
  misc_feature (1)...(765): n = A,T,C or G
ttcaatgttnntnaaactctttggaancagnctcccatcgattcgaattcggcacgagaacagatagagacttggtcttaaaaaaaaaggaaaagattttgaaacaaaaaattagctgggcctagtggtgtgtgcctgtgctcccagctacttgggaggctgaggtgggaggatggcttgagccctggaggttgaggctgcagtgagccatgattgtgccactgcgctccagcctgggtgagagagcaagactctgtctttaataataataataataataataaagtggtcaggaagggacccccagggaggagcataaacctctccagtggctgtgatttgtcagtaaggacatggggcatctggcggacaaatacccctacagcgatagcattttccgggcatttgtgggtctcaaggcgccctgcttgccctcagtggatgctttgtccagcccgcaggcattttatccagcagacaagcagaagcagcagttttgtcattcgagccggcttccctgccatggtacattacgtgagcaggcggctggctgtgctgtgctctgtggagatcacacgtgagattcgacagcactcgcttctgcangcttctctttcctgggttcttttaagatgaagagagaaccccgaanaggcggggcttgcggaaaggcnctgggaaaaagnaatggaatnatggnctttaacaatggtgccccgtgaactggaatggttctgantggcttgccagaactcttgagtcact

SEQ ID NO: 2946 - DNA, 751 bp, Homo sapiens
  misc_feature (1)...(751): n = A,T,C or G
ancgtgncttatnnacnctttggaagacctccatcgattcgaattcggcacgaggctattccgaatagccccaggtgatccnttttacaccanttttagcaatggaagtcagcacctctgctgggccaaggccatgcttccccagcctgtggctgcgcctctgctgtctctccgggtctcacctgggcgggaggctcctctggaggccaggacctgccttgtgagggtgcccttgtgggagaggcgcttgcccaaacctgctgttccccgggggctccttggtggcccccaggactggagctctctgcccagagtgcccctccccagaggttaggactcccatgaccctgtcccctgcccactgtgacctggggtttgcatggtttccttctttcctagttgtggtgaaatcatcacttgtgtgtttcgttnttcctgttctctgctgatttaccgatgtatttaatgtaaagtaaaaaaaggaaaaaaagaaaaangnnnaaaanannncnnnnnaannnanaaaaaaaaaaaaactcgagcctntanaaactatagngagtcgaattacgtaaatccagacatgataagatncattgatgantttggacaaaccncaactagaatgcanngaaaaaaanctttatttgggaaaatttgggangcctatggcttatttggaaccatttaagctgcanaaaacaagtttaccacaacaattggcattcatttnaggttcaagttcangggg

SEQ ID NO: 2947 - DNA, 750 bp, Homo sapiens
  misc_feature (1)...(750): n = A,T,C or G
ntnctttntgnnntnaaacnctttggtaagcancatcccatcgattcgaattccggcaccgaagggccttccagatcgtgctgtnccacctacctntnccgantttngncttncagatcgtgctgtcccacctacctgnacatntgccacagttggccctgggccaaccccacgaagggcctgggcctaaccccttggcctggcccacttncagagggaccctgggccgtgtgccagctcccagacactacctgggtagctcangggaggaggtgggggtccaggagggggatccctctcccttggggctgcccctgtggagggggatcccgcctctagaactatagtgagtcgtattacgtagatccagacatgataagatacattgatgagtttggacaaaccacaactagaatgcactgaaaaaaatgctttatttgtgaaatttgtgatgctattgctntatttgtaaccattataagctgcaataaacaagttaacaacaacaattgcattcattttatgtttcangttcacggggaggtgtgggaggttttttaattcgnggccgcngcgccnatgcattgggcccggtacccaacttttggtccctttagtganggttaattgcncgctggcgtantcatggncatagctggtnctgtgngaaaanggtatncgntcacaatnncacacaacatacgacccgggagcataaatgtaaacctggggtgctnatgagtgactacc

SEQ ID NO: 2948 - DNA, 757 bp, Homo sapiens
  misc_feature (1)...(757): n = A,T,C or G
ctatagacagctacntgctttttgcaggatcccatcgattcgaattcggcacgagagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgnaaaacagatactataatatttccttttattttagtgttatttagctttattacagatttctatttttgtcaaaacttcatggttcctttcaagatcttttttgccaaaacattttgatactatagcattgncatttgaaagtaagtgttctanactataaaaccaatgaacttctacatgagccctacagacaggcatgtgtagaaggcaatttatcaaacctattgcactggcatgaaaagtgtgtataataattttgctagccccaaagcaagctagttttctttgcttgcttccttttctttcnttttttccttgctnttnaagnnttgaancttttttaaacatggttgaggaattctctaggnnggattccttttgggcgtnatntaaacccccttctttttgggtttctggaanacccgg

SEQ ID NO: 2949 - DNA, 710 bp, Homo sapiens
  misc_feature (1)...(710): n = A,T,C or G
ncgctnctaacnnntggcgctatgcttggcgctnganccctnngtnngnantcggcncgagggtnaagcttcattcantgtccattcacccantactggtttgattctanggcctangaaaataggactgagcaaagcccttgtccagatggaacttatgtnttanangggaaaacacaccatatncaggtnnacagngtacnatcacgaaangntaaatgtctatgaagaacattgtgcagacggcgatngngntanatagggnaaggttnnnnangacagcatagcttgatgtacnagcnagananacanatagngaaanncctntccatactaagggaatgggaaataangctnnnttttgccttgntgaccttcaaacatgagaattgctanagctctgtgccaaggntnaagagtggaanacaatntaagcttcagctacatcacttacggcctataggccacactgaactgtgcnngnaaaactcannntgagccangctcncnncttaacatatttaaaggttctntnctgtgcgcngcaagaagacnacaggacaggtncagctntgtnnccacnngannttgatnttgacttcannngtacatattntgggctnantntnngantnaaaatgcgctatcncccataagtntggantcntgancatantgtngggcntctgncacaatgngtattatntcaa

SEQ ID NO: 2950 - DNA, 749 bp, Homo sapiens
  misc_feature (1)...(749): n = A,T,C or G
ggntatgnggctntaaatatacagctctcgtngctctttttgcaggatcccatcgattcgaattcggcacgaggttaaaagaataaaaaaggaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaatnaagcaatccacanaggaataagggaaagtaattaaatggtcctgtacnggaaaaccaccaaaccaaaattggaannanancttnggaaaaaaactcggcctttaaa

SEQ ID NO: 2951 - DNA, 748 bp, Homo sapiens
  misc_feature (1)...(748): n = A,T,C or G
gnnnggnnnnnnnnnntttnatanatacaggctacttgttctttttgcagggatcccatcgattcgccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgnagtgaactttctaggtaattgttttgaaaacaatttttgtatctgtgaaagtctttgctttntctttccaccttctagaaaagtctgctaccagtttccttactgaatacagccatactcagcccctctcgcatccagcccgtcagggtcanggtcanggtcangcttcctnaagactagcaccgcattgtctgccctcttttgcgtaggatttttctctnaacccangggacattgccttggactttctctacaaatgcccttagatgttagaacacaaatgattctgnttgtggaactctggctttttgcctatttncttttn

SEQ ID NO: 2952 - DNA, 749 bp, Homo sapiens
  misc_feature (1)...(749): n = A,T,C or G
gnnntggnnnnnnnnnttttatanatacaggctacttgttctttttgcaggatcccatcgattcggccaagctcagtttttcgccttgaatatgaagatgctagaaagagctctgcatttaagcagagccttgtgcaattcccggaccaaatgctgaaactgcaagagtgccctttaaaagaccttcttaggcatgtgacttgttctctaccagaacctttgggcaacatgaaggaagtcaaaggcatttactggcttgctgttgctgcctgcacagcacctgaccctcaaccagcgtgtttgctcctgcttcagtcaactttatatgctttggtcctgtcagataatctcggctcaatgagcatttttcatgctctacctctctctggtctacaggagattcagattggctttggtggacagagtgttcgattcctgagctctgcagagggtcttctgctcactgtattcagttacaacaaatacctctctcaacagctgtgtcgtgacctcctgtgtgtcctgatgccanacctgatgcccgctgcctgcgctaatcatcccttgctccacaagatctggttcactttctcttgattggaaaacagaaatccctgatttantttttgccaaatgggagttcangtgtcatccaaattccanactacccttgggtgacatgattactttnttcatggaaatatggaagtcaatgtcccttccctggcaaaagttcanntactggtntn

SEQ ID NO: 2953 - DNA, 762 bp, Homo sapiens
  misc_feature (1)...(762): n = A,T,C or G
ttaatanacagctcttgttctttttgcaggatcccatcgattcggagaactagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcanggaagaggaagcggaggcactcggaagttgaaacagattctaagaagaaaaagatgaagctcccagagcatcctgagggcggagaaccagaagacgatgaggctctgcaaaaggtaaattcaactggaagggaactattaaagcaattctgaaacaggccccagacaatgaaattaccatcaaaaagcttaaggaaaaaggtttttagctcagtacttccccagtgaccagattgagccattaccagattcccgaaaganggaacttcctgggtccattnttttaccanggaaaaattcngccaaggaacccttaaccntttaagtttntttaaanggcn

SEQ ID NO: 2954 - DNA, 761 bp, Homo sapiens
  misc_feature (1)...(761): n = A,T,C or G
ngnnggnnnnnnnntttnnaatntcangctacttgttctttttgcaggatcccatcgattngaattcggcacgagatcaccttggagctccttgagtgagttctgatcaagccattacactcttttcatgtagacctgcctgtaagtgtagacatgcacactcagctgaccttactgttcaaaagctggagaaaaagaaacagctttcatacagtgcaaactgtctacgtctatgtaaaagaatttgagaaacatggcagtagccattgctaattaatctgggtatgtgtaaatagtttaacttgatttttgactctggtgtttggatctattttaagatcgatggagttaattgcttcatgacagttcttatgaaacatgcttttttatatccttgtgccaatgttttgtttacagatctttcaaaatgaattcactctgagaaataatgaaatgacaattgtgtggcacatgttaggcgttagataaattgggagttctcttcttttgtaagattagctttaaatccacaattaatttcagttaggagagaataagcatccataccctatctctttaaccctgattacaactagatacccccggacagaagacaaagcaaccacccaaagacttctgaaaaggtagatagtagccaggcagactggggaagaagaaattnaaaaccctgaacaccaattttggcantgaggtttacctgggtttaatatatttctncccaaaacttggctcaanaancg

SEQ ID NO: 2955 - DNA, 854 bp, Homo sapiens
  misc_feature (1)...(854): n = A,T,C or G
ggtgnngggaaaacnggcttttatacatacaggctacttgttctttttgcaggnatcccatcgattnggcctcagagtctctgatcaagcagattccacgaatcctcggcccaggtttaaataaggcaggaaagttccgttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcaccaggccactgggggaggaaggacangccnatctgctatttgnncaccaacctgacttgatcctctcttccctctcccangngttatgtcttggntgtaactgatggncacgcnaagatgacagacnatnancttgtgtttaacnatnnanacntggctggtaacttcttgggnntcattgtttaantanacnanttggnnnnnaangttccnggnntttatnttattnaantnaaccctnattgttccnataccccnaanngncnntttttattannnnngnnccnttntnnnattaaaatnnnntttttatcnnnattannnnnnanntannnnnnnnaatannnnctntngnaagnnatnnttngaacnnnttnnnnnnanttnnnnnnnntaannnnnnnntaatctcnnnanatttgnnnntnngtannnncnttttgtnnnnacnttnnngnntnnnnannncnnnngtannnnnnnatccc

SEQ ID NO: 2956 - DNA, 751 bp, Homo sapiens
  misc_feature (1)...(751): n = A,T,C or G
tttnncngacnctnttnaactccctgcaggatccctcgattcgaattcggcacgagcacaagaaaatgaaattaaaaaataaatcaagctttcatatgctcaactncattggaccactgcaatcctggtgacatattgcgggctgaagaaacccattgnntatagtcctcctgtcactggagatatgtgtggtgagaaagagaaatggccacnttgcaatancagtgggaagcaaatgcagaaagcacccagnaaaggggaagatctaggtgacagaggccatctactcttntggattcatntggttctggcacacagagaatggagcttttgnggcaataatttctctactgatgtgagcaagnatacttctttctanaattagcaaattattgctaactatttgtaagctaaaatntaaaatnagngtttaatgtaaaatttcaaaacagaagggataatncatggntcctatacatcccataggtagtaatgcattgagctaggctgtggntactccctcagtgtgatttgtgttcacataagntcttanttggngttgnactgntattattaaatntcaagtntgacantaangccacagcangactttagagctcnaagacattngtnacacaancttnntggcaacttttttcaaaacnttgnacactttatngggnnnnaaacttncccnttttnnnaaaccagatcnttggggcntcaanctntttgaanccgnanntgcnnt

SEQ ID NO: 2957 - DNA, 773 bp, Homo sapiens
  misc_feature (1)...(773): n = A,T,C or G
ncgaaagnccaangccggacnggacgggaacaccctcccatcgatngcgaanncggcacgaggaatcttccttaaagnccagagcctcccttantntgganttttgtcctgcccaagccttctcgcggggagggaactccttctgtctgccgcctgnnacatccctgagggagaaggtctgtgagctgagcccacatcactcgntctgctgcccangtgggcttccatcttcactgaggaaaagncattnngaactccccggcgactgcaaattaagtaatcaaggacagatgggactgggtngaccattccaaggagtacagntactggaagaatctggaagcaataccgagcacatctgntggcatnaatccattggagcaataatgctggacgtagaaagnatgtcgcntttttaaaaaaacatcatcannnctgagcatacgnagcaagngaactctaacttggaacggangataaattcntctaaaaaacaagagaaaaaaccctncagacaaaattatgcancgagagctttaaaaaatatanatcccacagcatnagggaaaacactttgnctggcnatgcccacngnactccanccctgggccgacagaaccgaggactcccggncccaaaaaaaaaannannaagaaagacnngcattaaagggagaaaccagncnggnccngggcnagaaaaaacnanaananggcaaagaaggcannnnttnaaaannantnnaaagaccaaagcagncanagganaaaacc

SEQ ID NO: 2958 - DNA, 639 bp, Homo sapiens
  misc_feature (1)...(639): n = A,T,C or G
gannttcnactaatngcttggntctcgttctntatgcaggatccctcgattcgaattcngcacgagaaggcctgtgccngaggggttggccagttgggagccngngtcntcctcatcagcntatccccatgtcctctatgcccctaatntgcttnctcatnttggagggnttggggagaagttggnngtgccacccccacatccctgnggaggtgttcacccagtctgaganccgnnagcactnaggcagggcctgatactggacctgtntgagctnananctcnntgntngnaanganctgagacngcngancantgctcacttgcatngagagcccaccananagctgacacctgcggctnngttncgnatcatctncnacntagaantctacatatngctgacttacnncnnnagcccaagggaatcagattccanctatcaaactnctgattangccnaancctctattgtnaacaggttntggcgcacntgttcatcacnactnatgcntcgaanagatgtgaaatgnaaaatgcnatntctatgtntctttactcatttgataatntttnnnatgtctgcattcnaaatgcgtganctttgnccaaagcnnntagctacctnttnttcgccnt

SEQ ID NO: 2959 - DNA, 761 bp, Homo sapiens
  misc_feature (1)...(761): n = A,T,C or G
nntttncnaatncnaggctacttgttctttntgcaggatcccatcgattcgaattcggcacgagaaatcagttnttaaactttatgtatatattntagccagagcttaatgttttatgaagataaaggacatgaagnttaacaatggacaacngntanntcagctaattgtgaggtcaagnaattgnaagacatacgggaaggctttgttccacaatattatatggaccactgaacaagaatgacagccctttgttatcacttggcatatgaaaagtgtngtgtgcataggttgngtnaatttntnatgtgcntaaaaatgngatnttaanttatatgctctgaangataatncagggtatagttaaaaatgtacaatgtgccanntcannntatntnaccctagccctcaaattattctgattaaggttaaaatgtgctggcttacngtgcttnancctgaggccttctgatnggntcttggnnacaganttttaaagtaaggtgtganttnngcaactcntgtgctntatntataaagatatnaantaatnncatgtnctgatatttgaaaagaatttncccacaaatgtgttattttaaaancnatcaaagctagctacangctnaanaggctcagttcttcntacataatcggnntaaanattntaaggnattataanaattgtaaattactgcccaattgggtaaaaaangggggtatacatgcaannaataanactcnagccctttataactttn

SEQ ID NO: 2960 - DNA, 857 bp, Homo sapiens
  misc_feature (1)...(857): n = A,T,C or G
nttcntnactnaagcnctttgcaacttcctctttntgcaggatcccatcgattcgaattcggcacgaggatagctatctgacttctcaactatgttttaagcagatgttgtaaatcctatgctgtagttcatgaatctatatgacatgtggggtcgggaacatagtaccctaccataagtcaggttattcctactattctgcaacatgtaaataacactttgaacagagcaagtggtaaagattgcttaatttttgcatgactattatgataaatatgttgagaaggaccagctcaaaggaaaacctcttggtaactnggcatangttaaatgtttcccaagaaagtgcactcttcccaaataaagcttnctccttgaaaaanaaacgnccaggtagccannntnaanngatgnaaangcaaaaaacnananacacaangctngctncaggnanngnnnctgngctgactnttgnngagccnccangnctacggntaacctgncngcttacnttgaatgnnactgtgncccttgannnnggaacngaaaccccntcncaatcctgaaagngtcntgnaaggtnnacccntgnaaaaatgnaactnccnnnccaaannnttccngcnnaaannanggntttgnccccnnnncnntantngnccngnnnnccaatntcctannnncntanggtntnacnccccnntnaaanagattttgnnnaagggnttccccatnaacnccnngnccccaannccnggnanannnaaanccttnnccngaatnnnnnggcctntatcggccccctttaaaattnncgggnnnaaaaaacaannccctngnnnnnnnntaaaantagg

SEQ ID NO: 2961 - DNA, 857 bp, Homo sapiens; identical to SEQ ID NO: 2960
  misc_feature (1)...(857): n = A,T,C or G

SEQ ID NO: 2962 - DNA, 746 bp, Homo sapiens
  misc_feature (1)...(746): n = A,T,C or G
gnnnnttnnaatnnnagctcttgttctttntgcaggatcccatcgattcgaattcggcacgaggccctgtgttaatccaggtgagaacaggtagtacccaaattagggcatggtagcagggatgcagaggaaagaagaggagtangaactatttgggaggtagtattactaggattttagctttgaagggttgagagaaatgtcaagcctaactacaagcaaggtttctagtatcagnaacttcatatcatttgaaatacaaanattancaatcaatgtaaaaaacgtcctgggctaagcatagcatgaagtctgacttcagtgtagcattgaggagggtcctggcctcanatactgcaccagntgttngntcagctntgggcnanaacattagncagatcattaggnatttttgtcccttnntgcattgtccttcgtcatatatttattaaacacctactgtatcctaggcagtatttnccagggatgcaaagatnaattagatctggtngcttttcttcanagtctgaagttaagtgtcangtttgtggggaangttattctngccttgtgtatttagtcccaacttaagctntaattttngaatntgtaaaaccttatctgattataaaaaaannaacncagtctnaaananaggatggntgaatgcataaatttaatcttgaaaatttaancgactggttcttcaaaatgncacttttcatccccggttggcttntggctga

SEQ ID NO: 2963 - DNA, 753 bp, Homo sapiens
  misc_feature (1)...(753): n = A,T,C or G
gnnnnttctaatgctaggctacttgttctttttgcaggatcccatcgattcgaattcggcacgaggaaatgggtaggaacaagcattagcctggtctgggttcctccagctcttaggacaagttggaacanatttgctgttctgatgattcatctttctgatcacagggatagcataactcagctttgaagaaaggcatctgcagagatcatggcagttccattttgcgttctgagtttgctcctttaggtaagggaactagaatgcagatacagttagaatcagtctctctctctctgtttgtctgtctgtctgtcactctctntctccttattgcactganggccgggcgcggtggttcacacctgtaatcccagcactttgggaggctgaggcatgtggatcacgaggtcangagatcgagaccatcctggccaacatggtgaaaccccgtttctactaaaaatacaaaaattagccggcgtggtggtggacgcctgtnatcccaactactcangaagctgangcaggagaattgcttgaaacccgggangcggangttgcggtganccnaaattgcgccactgctctccaacctgggtnacanancaagactctgncttaaaaaaaaaanacaanaaactcgagcctntaaactatagngagtcgtattacgnagatccaaacatgataagatncattggtgagtttggacaaaccncantngaatgccanggaaaaaaatgctttant

SEQ ID NO: 2964 - DNA, 748 bp, Homo sapiens
  misc_feature (1)...(748): n = A,T,C or G
tancttnatagacagctacttgttctttttgcaggatcccatcgattcgaattcggcacgaggggaccactggcctgcctgacctcaccccactaatattttttattttttgcagagacaggatatggggaaaagaaatcagattgttactgtgtctatgtagaaaaggaagccataagaaactccattttgatctgtattaagaaaaattgttctgctttgagatgctgttaatctgtaactttagccccaaccctgtgctcacagaaacgtactgtattgaatcaaggtttaatggatttagggctgtgcagcatgtgccttgttaacaatatgtttgcaggcagtatgcttggtaaaagtcatcgccattctccattctctattaaccagggacacaatgcactgcggaaagctgcagggacctctgcctgagaaagcctgggtattgtccaaggtttcccccactgagacagcctgagatatggcctcatgggaaaggaaagaccttacatcccccagccggacacccttaaagggtctgtgctgangaggaggagtgaaagagggaggcctctttgcagttgagataagagtaangcttctgtctnctgctcattcctgggaatggaatgtcatggtgtaaagccaccattcccattcgttggattctgaaataggagaaaactccctgtggctnanaaccgagatatgctggcancaatactgntctgntgctctttgctnn

SEQ ID NO: 2965 - DNA, 753 bp, Homo sapiens
  misc_feature (1)...(753): n = A,T,C or G
gnnnttctaatagcnagntgctacttgttctttttgcaggatcccatcgattcgaattcggcacgagaaaggcttagatcattgacttcagattttttgtcttttctaacaagtgttcaagactataatataaatttccctctaagcattgtttagccacatttcacaaatttggaaatgtttattcattttcatcttcattcagttgaaaatattttctaatttcccttttaatttcttcttttactcacttattatttggaaatgtgttatttcatttccaaatatttggggattttcaaatatctcctgttaacaatttctaaattagttgtagtcagagaacatattctgtgatttcaatgctgaggcttgtctgaagccccagaatatggtgcattctgtggaatgtttcatgcacatgtaataagaatgtggctgggtgcagtggctcctgcctgtaatctcaacactttgggaggctgaggtgggtggattacttgaggtcaggagttcgagaccagcctggccaacataagtgaaaccctgtctctacgaaacatacaaaaattagctgggtgtggtggtgggtgcctgtaatctcgattgcacccctgcactttagtctgggtgacaaagcaagactacatcttcaaaagaaananannnnnnnnaaaangntnnnnnnnnnnnaannnnnnnnnnnnnnnnnnnannnnnntngnnnnnnnnnggnnntnnnnnnaanncccc

SEQ ID NO: 2966 - DNA, 745 bp, Homo sapiens
  misc_feature (1)...(745): n = A,T,C or G
ggnnnnnnttgaaangnttnttgtcttttgcggatcccatcgattcgaattcggcacgaggttacaaacagtggaaaacagacattttcagatgtttgcacaccatgcaccatgcaaaatacanaccagctgaatcataanaacaaatgactagttactgggagggttttctctctttctcattatttttacttctaccaaagtaatgtgcacatactggtnattttattcnattttaattttcaccaagctagctaattacctttctttgttttttgtggaggtgggctgtcggtcttttgtcgaggctgatctccaactcctgtcctcaagcagtccttccacttgggcctaccagagtgctgggataacaggcgtgaaccactgcncctgacctatanctataatnntaagaagnaaaatggngcaaaaaccnnacangagcaacctgacntnctactntcanaaacaatcacttttaactctttgaactgnatctctgntatttgcctacttatttctaagtaatatgcttactctncatgttatctaaatggggtattaaagctttttnacaagcatctcttctnactatcaacattcacattcattacaaanggacttacaatatctttntcaaaaaaaaaaannnnnnnnaaaaaaaaaaagcctttanaactntanngagtcgattacgtgatcccganntgataaggancanttggtgagtttggacaaccccaac

SEQ ID NO: 2967 - DNA, 747 bp, Homo sapiens
  misc_feature (1)...(747): n = A,T,C or G
ggntntnaatttgcagctcttgnngntctttttgcaggatcccatcgattcgaattcggcacgagcggtgctggtgcggcgggggactgcggggccngcctcaggtagcagcagcagcagcagcagcagcagcagcagcagcagcagcagcagcaatgtttcacttcttcagaaagcctccggaatctaaaaagccctcagtaccagagacagaagcagatggattcgtccttttagaagcatctcagaggctctccagtgacgtgctgttaaaagtgctgaccctgggtcagaccctttgggttggcttcgtggctccacgacttactctctacccttggcagtggcgtgatctcggctcactgcaacctccgcctcctgggttcaaacgattctcctgcctcagcctcctgagtagctgggactacaggggcctgccaccacgcccagctaatttttttttgtattttcagtagagacggggtttcaccatgttggccaggatggtcttgatctcttgacatcatgatccgccgctcggcctccaaagtcctgggattacaggcgtgagccaccgtgcccggcctatatgttntattttataaagttatatgtnntattatttactttttggtatgtaattggttatgtcataaaattataatataataattccttaaccaaattatattccataaattataacntatgaattcaatatgcntttattaaataaagattctagan

SEQ ID NO: 2968 - DNA, 762 bp, Homo sapiens
  misc_feature (1)...(762): n = A,T,C or G
gctatnttnatatancagctgctcttgttctttttgcaggatcccatcgattcgaattcggcacgaggggggacacgttggctgcgttttcggcgggcttcccgggtacaaaaatggctgtggctagcgatttctacctgcgctactacgtagggcacaagggcaagtttgggcacgagtttctggagttcgaatttcggccggacggtgtttacgtgtaattgttcaccataggacgcatgaagagtaccaagcaagaggggagaggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaagcctaatttcactctgtaaaaagaaagtttggtttctgaattgggtcttttcaactcttggagaaattccttcaacaacccctggaaaggaagaaacatttaatttcacttttgnatatccctgangaatgtcctttgnatcaccttctttgaatagaagaaaatgtggagaaatctaacacatgcttgcactcttgtaggaatnacttaagtcttctgcttaaagaaacccttntttagaaaaaccaaaggaactttgaaattgtnaattggagatgagcncnnt

SEQ ID NO: 2969 - DNA, 791 bp, Homo sapiens
  misc_feature (1)...(791): n = A,T,C or G
nnnnnnnnnnttnancagctcttgttttgcaggatccctcgattcgaaatattttcattggttatacaactgctgtgtcttttctgagaaactcagccccaatgtgtaacaccctggattccacggggcagcaaattccacacactgcacccatgttgtgagcggagattttcgggctgaccaaaacttgaggcgaactgagtctccatcttaacactcaaacacacttcatggcggcctggaaacaaggcaatcattatgaagcttcagcccagttcttctgaaaccaacgtattgggcctgcttcattgtctctctaggggctaatcacaaacatgtgggaagggaagctaaggaatgcctgtctagaaagggaggttgtataatgtagtgggaagaacctatctgtggggtaaactttttttgcatcatgtagaaagcaaatctgggtaattaaatgtttgtgtgtgtgtgtgtgtgtgtgtgtgtatttangtttnnnntanggnnnnnnntncnntnnncnnngcccngtntangnnnnnnnnnggcanngnnnnttcnctccnnnnncananganctnnngncnngtnnctgtncnnncttannnntngaangntnnnttnngaaaacctnnnntnnnccntttnnnnantggnnnnnnnncntnnnnnnnnnnnnnnnnnnnnnnnacntnnnngnnnnangnccnnnnnnnntnnnnnnnnncnnnnnnnnnnaannnnngnnnnnnnnnnatttnnnnnnnnnnnnnntnnnnnnnnnngcg

SEQ ID NO: 2970 - DNA, 788 bp, Homo sapiens
  misc_feature (1)...(788): n = A,T,C or G
gntgtntnnttacnactgctgttcttttgnaggtcccatcgattcgaattcggcacgagtaaacatccagatgtgttttgatagcctggggtaattaaggttgaggacaagtgtaccagatcaaggagaggaacccgtcccatgcctgccgtgtgttcaggtggctagacttgttgttgcatctgttagttccactcttagtacatcattgtgctgtgaggtgtcattagccgccgtttaatttttcttttgtttttagagacagtgtcttgctctcaccccggcttaagtacagtgacatgatcatagctgactgcaacctcaaactcctgtactcaagtgatcctnctgtcttantgtcccaagaagctaggactgcaggcacacaccaccatgcctggctaatttttaatttttttgtaaagatggggtctcctatgttgctcanctggtctcaaactcctgtcctnaagcagtcccccacctttggccttccaaagcactggggattagnatncttatnntcnnnnatannccttantnnncnngttttnctaaatgggtatttnaacnttttncaaanntttnnnnntnnntttnnanaatncnntttnttncnnaaggnnntttnccanntnttntnnnaannnnaaannnnnnnnnnnnnntnnnnnnnnaaaanccctntttnnnaacnnnttttnnnnnnnnnntntttnnnnnnnnnnnnnnnntnnnntnnnnnnnnnnnntnnnnnatttnnnnnnnnactcnnnnnntttnnnnn

SEQ ID NO: 2971 - DNA, 746 bp, Homo sapiens
  misc_feature (1)...(746): n = A,T,C or G
tatntttcnagcngctcttgttctttttgcaggatccctcgattcggtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagaacactgaaagaaaagactttgctttccgaagatactcagaaacttgacaatttcctaggagaaatcagagacaaatgagatgatggccgatatgtccaccagatgaccagtgcctgccccggan

SEQ ID NO: 2972 - DNA, 762 bp, Homo sapiens
  misc_feature (1)...(762): n = A,T,C or G
gntnnncnaatgcttggctctcgntcttnttgntgcaggatcccatcgattcgctaatatccagaatctacaatgaactcaaacaaatttacaagaaaaaaacaaacaaccccatcaaaaagtgggcgaaggacacgaacagacacttctcaaaagaagacatttatgcagccaaaaaacacatgaaaaaatgctcatcatcactggccatcagagaaatgcaaatcaaaaccacaatgagataccatctcacaccagttagaatggcaatcatagagcttttcatttatctgagtgttttcctctgcttgtcgggacttgtgctttcacgagctcctgctctcatatcaggggagtgaataattgaatttggatagttttttggtttttagttggaacactccttttcctgtggaacgtctatagaaaaaatgagtcaaacagagaatatgcaggggaggcaactctgaatgcttccatggctacatacatacctgttttctttgatttgctaaaccctaagttaaaaggaaagtactgtctaaaatagggagaaattccctatatttataccatcatttggagtatttacaatgggagtgttttgnattataaatgtcaaaaangttgagacaggactcacttaaattaagangggaaacttttttttaatgatggaaatangggcttaataaacttacatctncttaacttctttaataattggnaataaactatgactggtcaagaattggacnntcc

SEQ ID NO: 2973 - DNA, 760 bp, Homo sapiens
  misc_feature (1)...(760): n = A,T,C or G
gnnntnnnctantncnaggctacttgttctttntgcaggatcccatcgattcgaattcggcacgaggtgatatgaaaagcgaatgcaccatttcttggtgatgattcaggtcagcgttgggacccaggaatctcctgttaatcagtaccctggtgattttgatccaggtcatcaagaccatggcttccatcgtaggcagtcacactctttctctcttggatcatttgctgtggggaagcaaactgtcatatgagaggacactcaaacagcctctggagtctcatttgctaaggaactgaggactccagcctgagaactcangcaagtaactgaggcctgccaacaaccatggagaaagcctggaagtggatcctccctcagccttcagtcgagacaacagctgcaatgacagccaagccagcgccacccagcttagccacccccagagaactaactctcagaaaccatgtaagataatacatgttngttgtnttaagctgctaagttttggggtnattnattatacaatagatnattaaaacacatagcatataaataaaatcaataaaaccagtatgggtcagtaatgagttaattagataattagacaaattttgcatttctgnttctatggtnatnattttcttcagaaaaaattctctccgggtaaaaaatgtttaaaagtggttcccaaccggacatttttaaaattaattaatcagtttngggaaggccaaagccggtttggattgcttttaan

SEQ ID NO: 2974 - DNA, 795 bp, Homo sapiens
  misc_feature (1)...(795): n = A,T,C or G
gcnanagcngnctnatagctcggttggctcttgttctttttgcaggatcccatcgattcgaattcggcacgaggaagagaactatctaaatgagtaatggtcaagaaattttaaagcataatgacatgaaacaaacaaccggtccaggaagctcagagaatacaattcatgacaaacaacaaaaatacagcaccagacatagcatttcctatatgtagaataaaagaaaataaaataaatcaataaatagacaaagagaaaatcttgacagaatctggaatgaaaactacattccttgtagagaaaaaagagcaaggatttcagcccacttccagtaagaaaccaggcaagaaagaagagagttgcgggaaatgttaaggaataaatgcaccaacttagaattctacatctagcaaaattatacttcaaaagcagaggggaaatcagaatttaccagacaataaaacactaacggaatatattgccagaaaactttcctgcaaatgtgttaaaagangttattcatggaggagaagagtgatatagatcagaacctgtatttacaataagaaagcaagtatgttgaaaaaggaaaaaaaatgttttatttttcttattgnaaggtctttttaaactacatggtttggttaaaggtaattattaagtaaaatggttttggggccaanttncccaaaaaaaaaannannnnnnnnnnnnnnnnnnnnnnnnnnnnnnnnnnnnnnnaaaaaaaaaaccttngggnccttttaaaaactttttngggggngnnnnttt

SEQ ID NO: 2975 - DNA, 785 bp, Homo sapiens
  misc_feature (1)...(785): n = A,T,C or G
cagggnntctaatnncagctcttgttctttttgcaggatcccatcgattgggcaaatattaaatattcaatgaatgatagctgcctctacttctccttttgttgtttttattttccatttatgggngtcatttatttattttaatgtcttcgaaagtattgactttaacaagtactttgtgatgcatttattatttcatttgttattatttatgtatttgatttatttctttgtgaggtaggatanaatctcantcagatttttgctgttaggataccacagactggataactacaaagaagggaagtctgtttaactcncaattctagaggctggcgcatctaagagcatgacactggcaactggcnaggatcatctcatggtggaaggtngaagggagtacatganatanagagaancaccatgggctngactccgctntgtacaaccaaaccttnanntnactaacccgntcntgcaataatnacattaatcccctcatgaaggttccacccctcatgactgattnacatntaattaggccccacnctcctaanattattcacttgggagntcaaagntctaacaccgtnaaccttttgnngggatancattccnaaccnttnccncnattgntgnncnaaaaagnaccnttaccaatccctttaccctnnttgngcntaacnccntttannagcgtgananntnnactgtttcttttaaaatanggntncttaaantnncttggantaaattttaaaattggnantatgnncananctttc

SEQ ID NO: 2976 - DNA, 802 bp, Homo sapiens
  misc_feature (1)...(802): n = A,T,C or G
gnnnnnnnttnnaaatnnnangctacttgttctttttgcaggatcccatcgattcgaattcggcacgagcctctgcgcctggccccgggtgggtcagcccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggcccggcacaaggggccaggcctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaagtttctgcttcaggtcttcacaaagtccctttttaacttgaggaacactttctttcctggaagcttgaattcaanaaggcaagggggggccaactggctttttgggtcaangggccaacaatcaagaancnttttgtnggcaantcccgttaccanggaagccaaatnttggccaagggaacccccaggaaaacccctnaagggattgnccccaaggggct

SEQ ID NO: 2977 - DNA, 828 bp, Homo sapiens
  misc_feature (1)...(828): n = A,T,C or G
ggcnctntttctaatgcttggctactcgtcctctangcaggatcccatcgnttcgaattcngcacgaggtgaagaagantaaaagagacagaaaggangaacggctngangaaaaggaacagngatgcgaaagaactnaagatagaaaaccaccattaaaactnaaggantccnaggcctannacnctcaannagggacaggaggctgacctttangctngtgnggaggaagtccctnnngccantggctntgcntggaaaancatcatnaagnagnngcagcncaaggncttctccantgaggaataggctcaacgtgggcnctcaggtgngaggnancatgagcnctccntagttggaacatatccctaagngtatgatnatgaatntcccaggagcattctgcaggcnnttaaccatangacnatnnngctgctnctntgcgnatattnnnntngnanggancnatcnanncntattttgaaacaggtcccngncanttgaaatttccatccnnaatttcngtanncaaggttttngctcatcctacncnatnnctgancagnntnanctattcnganaaggtacttacangnccancnantancattgtagnattgcgntatnantccccttcctttnttaattnccctaangnactnaanttnnaanccnnggtngataatagcaacnntttcgatgtggatttaantaccctttgaattccaatttttgnttgnnnattnctatacctttancatgttgaatccctnnattaacaattnctttantttggaacttcttaacccaccttcaaatttttngccg

SEQ ID NO: 2978 - DNA, 753 bp, Homo sapiens
  misc_feature (1)...(753): n = A,T,C or G
gnnnnnttttcnaatgctnggctactngttctttntgcaggatcccatcgattcgtttaaaaagcattttattatgtattatgaaatatttcaaacataaaaagatgtaaagactatctaccaatgactccccccttaataaaacaaattaacctgaaggctgttttgtgcccctccttgattgtgcattcacctcccaacccctcgctccttgggcaactgttatctttgttatttgtcattgccttaacattagatttttttattactgcttttgtaattctaatgatatcaaatggaaaaaatattttgaatgcaactcctcttttaatttgctccaattggtatctgtattttttagtccatgcctgtattataagtattataaatactatctgtntatacttttgctaaagtcgagtgtattngttaaactgatgatacagcttcataagattttangtcagctaatggattgtcaatattttgngtagaatacttaccaggttataaattacaatttgaaacatagatatcctatagttngagaatttgaacatagatatggattatgttgaaatcgactgcctttntcttagctatgacagtaataaactatatnacaacaaaaaaaaaaaaactatanaaactcgagccttttagaactatatgagtcngattacgcgatccagacntgntaagatacattgatgaatttggccaaaccacaacttggaatgcaanngaaaaaaa

SEQ ID NO: 2979 - DNA, 792 bp, Homo sapiens
  misc_feature (1)...(792): n = A,T,C or G
gnnnnnntttcaaatcgctaggctacttgttctttttgcaggatcccatcgattcgaattcggcacgagagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaattcgccgctctcactcaagccattcgcaccggaactaaaacagggaagaagactttgcaagtggtagtctatgaagaagaggaagaggatggcaccctgaaacagcacatagaagccaagcgcttcgaaatcgctaggtctcaacctgaagacaccccttgaaaacacagtgaggangcaagagcagcccagcatcgaagagtacatcttccgatttcaaggaactgatgaaattagaaaaaacaccttccngaacattgggatagccttggaagcaggacccattaaacaagcttggaaaattccaattcggtggaaantgagttccccaaaagncccttanttggatacctcatggttcntttccaacaggagaattctggttgccaaggttcatttcccaccattagccccaagag

SEQ ID NO: 2980 - DNA, 757 bp, Homo sapiens
  misc_feature (1)...(757): n = A,T,C or G
gannntgctactaatgcttggctactcgttctntntgcaggatcccatcgattcgtggaaaatataaaaagtgacactttatgcaaatgtgatggcctccgagctgaaatgaaggaactggcaatctttccaaagtggcagccaaggccccactccctgtcctactcaatctctgnnnggaaaaactgtgggatangatagcagncagctggggacacacagaggaacattcaacaggaaggtcccgtctagggaaaaggccacanancccatcctnttgccgattcagggatccttggatntaagtggattaaacganagggaggaaanctntcatttcantggtcttcaaatcaagttgaaatattactgngaggtatcccacttnagcctgaaccagcagacntacganagggtcactctagagtcacnaaggaaagcangtcccncngaatgcaacacattgatcggaagtgnacgncncagacnaagaatggccnacttgataattacttangacntntatttnaccggangaacatnnaaatacttttgtaaatattcatattgntgaacctttcataatcaggaatttactatgtactatactgtnagtnataattcgcctataatttacttaatctatctccttntangacatatacnnaaatgggntnctntggaagttgcctngtgcgaaaatgtttttaaaagtttttcaatttggtttggaaaactctaactttttttnnttttn

SEQ ID NO: 2981 - DNA, 747 bp, Homo sapiens
  misc_feature (1)...(747): n = A,T,C or G
gnnnnttnnnaanaacagctcttgttctttttgcaggatcccatcgattcgaattcggcacgaggttacctctcaattttaactttttttttcttttttaattaatgttttttacccatggcaagctgtaatagcttttttgaggggaggtaggtgcttgataaagaacagtaggtgctgcttatcaacagatgaaaggagggttctttttcaggcaaccatctcatttgtgagtgaatggactttctctttaaagtgctgggattgntagtgccatttntattgtaaatatcagaattgttattcnttgtcttctacctaagaattctgtctcttaggctttctcttcccagatttcccaaagttgggaaaagctgggttgagagggcaaaaggaaananaaagaattctgtctctgacataattagatagggaaccanttgggaagctgtaagaataatgcaggtgcaaggtggtggtggttnagagccgggtgatagctgtggatgtagaaagaatctgaatatattgtgtcatagggntgacctgatttgctaatggagtagttaaggatgtggnaaagtggaatcaagcatggcttcaangtctgggcctgaaaaaccgggagaatgagtcacatnaactaagacgggaaagacaatggtagggncctgtttagggaanactnngnagaagattancncctcattnctaatgatgtaatncatanaatcttgcangagcctt

SEQ ID NO: 2982 - DNA, 745 bp, Homo sapiens
  misc_feature (1)...(745): n = A,T,C or G
nntgtngntcnaatgctaggctacttgttctttttgcaggatcccatcgattcgctagagtgcaatgttgcagtgcaatgctgcaatctgggctcactgcgacctccacctcctgaggcaggagaatggcgtgaaaccaggaggaggagcttgcagtgagccgagatcgtgccactgcactccagcctgggtgacagagcgagactccgtctcaaaaaaaaaaaatctaattatcaaatgcatcccattgtgatagtcctacattatgtgacattaacctatattcctgggtccttttaattcccaactactgctcttagaggtcttagccttttatgttaatttttataaattcaattaaataaatattattcccaaatcttagtgtttgcagattagttataaatcctatccaaggtaggttaaaggccaccgttttacagataaatagtactttttatatttttatctgaaatagtgcatttgttgagaataaaagaaggtatgtttaaaaatagaatcttttgggcctggtggtacgcccttgtagtcctagctacttgggcagctgangtggaggatctncttgagcctaggagttccagactgcactggcgtcactgnacttcagcctgggcgacagaatgagaccctgctnttaaaaaaatatnaaatngactattttatagttgaatgttagttagcaagttatcatctgagccttaagtcaaaattaaatctttaa

SEQ ID NO: 2983 - DNA, 785 bp, Homo sapiens
  misc_feature (1)...(785): n = A,T,C or G
gnntnttctaatngctnggctcttgttctttntgcaggatcccatcgattcgaattcggcacgaggctggtgttagggttctttgtttttggggtttggcanagatgtgtttaantgctgtggccanaagcggagggagggggtttggtggaaattctttgctatgatgtctntgtggaaagcggctgtgcatacattcaattgctattaaaaaaaaaaaaaaaaaancacaaaagataannctaatnaaanaaatnctcataaganacnangacctttnaacntnttcnnactggtattnngtaaatccatccttnancananncatnntnnagttcngaccaacaannnntngatnnccntgnaaaanntgnttnatnagggaaattcagcgatctattgnttnatngcganccctttntgannccaataancaggnnaaccacttccatggnnttcgtnaaatnctnaaggnctggngngaannattcngagngtctncaatactcngncntagagntattccatgncccccagnacctaaatctttggccctttaagcatagggaatttccccaccncnccttaatgctagccattntctgtttcatnccncaaatttgnacttcccataaccacttccaaganaaananttttncncggcggaactntacttggaaaaccctnncgagttccctaangaagaagnncctaaccccccattnaaaattgacgtnccgattttgntccanccgttttgancaanngggnaacccttccggac

SEQ ID NO: 2984 - DNA, 798 bp, Homo sapiens
  misc_feature (1)...(798): n = A,T,C or G
gcaatgcngtctttgaatcccgtttntaaatccctctgtttgcaggatcccatcgattcgaattccaattccacattttcaagaaataaggaggcaaaaattttcatatatgaattggaattatttgttttcttattaggccgagatgcgccgcgtgcggctgctggagatggcggacgcgatggatatgttctgccaagggttggtttgcgcattcacagttctccgcaagaattgattggctccaattcttggagtggtgaagaaagaaaaaagttgaactagatttggtctgatgcanttacagatttacaaactgtgcccccaccctcctgcagacaccttccactcctcattcttgagggattagggatggaggtcatgcttctgtatcgacttcatgctgaccagggtcactgagtcccctaaagtgagaggaatgaaactcttgggcttctgagttcaaatgagttctggggtcacctggagtagcttgaaaggctggtattggtgtaatacangctgaangtggaagtgttggaacctgaaggacaaacagctnaccatccatttaaataaataagggcccaaaagttaccanaaccagtggccacnaaggggccccagcagaaggaaanaaaccnnggtgaaggtgccggnataatnggacctcgantgcctttttaaaatctcaanngggtttggccccgggttccaaatgggctttaacgnccttggaaatttccagccnnaaagaaaaaacccccnaaggccaagggtggaatccnttaangggcc

SEQ ID NO: 2985 - DNA, 773 bp, Homo sapiens
  misc_feature (1)...(773): n = A,T,C or G
gcaatgcttggnnanatnnnaggctcttgatcncatcgnttgatcnaccccatcgnttcgaattcggcacgaggttacctgtgtatgactgaagtacatattcgttatctgcgtgagacagtacagattggtgtatagtattttacagccacttcattatatgctatttccgtgtactggcaaaaaagagaataaaacttcctaggatataagtacctactgctgttttggtgcatgtccagttaggcttttctctttttatttgtttgtgtacctgtaactccatataagcatatataatcatgttacatatgtttaaaaggcgtcattttgcaatgcagttttatcactagttttttctctgtcaagggatgtataaaaatggatcacaaatctaaatttaaaactatanaacttaggagagaatctttgtgatcttggattaaacaaagatttgttagataagatacagaaagtatgaacaacataagaaaaaagtctatagtttaaacttttttatattcagttttgcttttcaaaatatacctttaangaaatggtctgggtaaggtgggctcacacctgtnatcccagcacttttgaaaggcttgangtgggaagtttggcttgaggctaggaagttcangacccagnctgggcaccatagcaagganggtcttttacacacacacaccacnacncacacacacncacacacnanacaccgcancccaggtngcntttgaaagaactggctttttacacacccccac

SEQ ID NO: 2986 - DNA, 773 bp, Homo sapiens; identical to SEQ ID NO: 2985
  misc_feature (1)...(773): n = A,T,C or G

SEQ ID NO: 2987 - DNA, 851 bp, Homo sapiens
  misc_feature (1)...(851): n = A,T,C or G
tcaatnnntagggncnggnntncctntttnntgggccagggcantacccccnattccgcgttattccggaaaattttccgngacctaccgtagggntttcacacctgggnggttgatggaaccttggaaagcttgcnataatacctgcattatcctcgcagtnggtagtacangacaccatgatatgtgccgacatgagtcattttacagcccacttcattatatgctattgtccagcgtgctggcaaagactagacataaaacttgactcgatctnagtncctactgctncacttggtgcatantcatgncggctctgcnatcaagntaatgcatgagnacccntcactccatatnntcnnatancaacntgttgcactgcttcanaggctntntatgggctaagcacaaacatgctngaagggaatctgacgaatgactgtttanaatgggatcgcagtatntaagtattagggactgaacctnttagtgggagtaatctttgtgatgcatggatgtaaacagcnaatctgggtaataganacanaagagtgtgaaccgcattgtataaantgtntataggttaaacttttntatattcagttttgcttttcaaaatatacctttaaggaaatggtctgggtaangtggctcacacctgtaatcccacactttnaanangcttnangtgggaangttggctttgaggctaggagttcangaccagcctgggcaaccttnncaagantgggcttttacacaacacnnctccacacacacncnnactncananacacacgcngnccaggntancattancnanganttgnnttttttacccccncncncnc

SEQ ID NO: 2988 - DNA, 851 bp, Homo sapiens; identical to SEQ ID NO: 2987
  misc_feature (1)...(851): n = A,T,C or G

SEQ ID NO: 2989 - DNA, 744 bp, Homo sapiens
  misc_feature (1)...(744): n = A,T,C or G
gaanctttgatccctttctngttctttttgcaggatcccatcgattcgaattcggcacgagggcaggcactggagagccagggtggttcagnngcagctcctctgagcagggagtcaaacagggctgaaacagacaccagctctccaggaccagctgctccaggaatcaacctctaccctgaaccaggtccctgaggaccaccacgtggctgcaacacagcaggagttcacagtccagaggagaagcccgatgctgaacagagaatcacatccgtgagcaacacaaaaggtctcaatcaaaaacctctgaaagccactggcctagagttagaggaagagttagccatgagaaatggtggtgacacaggttccaaaagaagaaacaataggtatcaggctcagagatgaaagggctagaaggaggacacaccangttcaaggtctggcctttctcgagggcagtggggagccatgggaggagcctggacctgtggccttcctgcttcacctgggcctnaacccgtnacgaccacctggcctttgaggtgtatctcgtttctcatcataagagctctttcgctcgtgtngaactgggaantggccgtcattggctgcgcatacctaaacttggtcagggcagaatgattgctagtnaccacgtgaagcaggaaaccccggcattaacttgcagaatgagttggtgangcttgaaataaatggtggaaacatngtggcaatctttta

SEQ ID NO: 2990 - DNA, 747 bp, Homo sapiens
  misc_feature (1)...(747): n = A,T,C or G
gannnnttnnannaatgctnggctactngttctntntgcaggatcccatcgattcgaattcggcacgagaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatcagaaaggacaaatatccaagtgaccgtgacggggcctagctcaccaagtcctgtaaagtttctgattgacacacacaaccgcttacttcttcagacagcaaaacttgctgtggtacaccaatggcagttaatatttncgcaaatgggtttggatttgctatttggcactcaatggtggatataatgggaangcttttgggncttttaaaanacaaaa

SEQ ID NO: 2991 - DNA, 756 bp, Homo sapiens
  misc_feature (1)...(756): n = A,T,C or G
ttnnttccnaatatcangctacttgttctttttgcaggatcccatcgattcgaattcggcacgaggcatcctgtccttgggaaccctttctcattctccaagcctggtcagctgcctgcacaggcagaggtgccctcagcccaggttagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggaaagcacttttttatgatgtactaaaagccacagtatgtggcaactgcaaaaggatcaggaatttanggtatgatctcggtcacgtgtcccgggcgctgaggggaaaggaagcgggcatgattgtagacaatgagggggttctcttgatgtaatgaaatgcaattttatggtttggtgcaaaaactctattttccagtaaattaactttatttctnaagcatattttggatttgccatcaagaagcaataaagcattaaatctttaaaaaaaaaaannnnnnnnnnnnnnnnnnnnnnnaaaaaaaacttngagcctttttnaactt

SEQ ID NO: 2992 - DNA, 824 bp, Homo sapiens
  misc_feature (1)...(824): n = A,T,C or G
gcttccttccaattacctngtgggctactggtnctnggntntatctgcaggtatcccatgcgnttcgaattcggcacgaggagactccaggctgagctggctgaccgacccaatccccctacccgccctctgcccgctgacccggtggtgagaancccgaaggtaacngtggggggagagcaaaaaacacatgaaaaaatgctcatcatcactggccatcagagaaatgcaaatcaaaaccacaatgagataccatctcacaccagttagaatggcaatcatagagcttttcatttatctgagtgttttcctctgcttgtcgggacttgtgctttcacgagctcctgctctcatatcaggggagtgaataattgaatttggatagttttttggtttttagttggaacactccttttcctgtggaacgtctatagaaaaaatgagtcaaacaganaatatncaggggaggcaactctgaatgcttccatggctacatacatacctgtttctttgatttgctaaaccctaanttaaaaggaaagtactgtctaaaatangggagaaaattccctatatttatacccatcattttgagtnttttacaattgggantggtttnngtattattaaattggtcaaaaaaaggtttnaaaacaangacttncnttaaaatttaagaaaggggnaaaactttttttttttaantggattgggaaaatagggggctttaaataaaaactttnaattntccttntaactnccttttaaanatttttgnnaattanaacttttgaactgnttcnaanaantttgntncatntnct

SEQ ID NO: 2993 - DNA, 765 bp, Homo sapiens
  misc_feature (1)...(765): n = A,T,C or G
ngnttnnnnnnnnctntgaaacttnctggcacttccngtangaanccctcgattcgaattcggcacgagaagaattgtacgactcttattgatgagtgcaanttttttctatagatttgaaagtcactactaatcatgactagctgattataataattgagagtaaacttttaaaattattaaatatcctgtgaaagttggagcacagtaaccattaaccctaaatttgatactatgtccatatgaattcagatcataatagtgctctatcatgtgaaactactaaaggatgtatagagttaaatattacgtatccactttaatgaagaataggtattacacagtaatggttgtttaaaaaaattttttttatataatatcagagtttacctgatgtgcttgggcatgcatagntgtcaacaatgatttgctagttgtacagttttgtatgctgatcagaattatcanaagtttgtaaagcatcttntcttttgattcatacatgaaacaaaaacaattctgtgtattctcagtgttctggataaaaaaattttaagtgcatatactttntaggaaatatgacagatgcttgtcataatacaaaaatatnttacttttttattatgctcattnctatggggagaggaaacntancccggaaggaaggaagaatanggattggaaaacatttggctacttacctgcaactcatccntggacaacangccatgtgcacatttacacccatgccccatataccncatg

SEQ ID NO: 2994 - DNA, 766 bp, Homo sapiens
  misc_feature (1)...(766): n = A,T,C or G
ctnctntgactaatgnactgaacngcaaattcccntannaanccnngcggtgcgggnctncagactgtagaagcagaaggnnccatncccgatgnttngnttttggtgcnaaggaccgnccnnnntagncnctgtccctgatatgacgccgcaatgccngangaancncacccaanacgacangcttgtcnagataagcncgcacagggagcangcagnactgctgcagntgccgcagccgcanccaccctacaggganctgcaacaaaatggacaaaccacancanatgcngaggagaatggagcccatacnataccaaataaccatacngatatgagggaagtggatggggatgttgaaatcccncctaatanagcagccgtgtannngggccatgaatctgaaactctatcaagngcctgcancccnggtagcganctcctagcgncatggnctggngactcaacancangnatatggaancttaagcgagaacancancagnggctctacanagccgtactnaganatngtatnccacangganggcancangtnccaagcnacaangangtnanancngtanacgggaannaanaanggacacttntggccaccngggccctatgangggaanccccngaatacggactaaagaaggnaaacctcctaaccancttangggcacattaaagccctttattcncattaaaaaggnaatnccaaaggaaatttncaacccaagcncccggccgnngnnaaaat

SEQ ID NO: 2995 - DNA, 746 bp, Homo sapiens
  misc_feature (1)...(746): n = A,T,C or G
cnttttgatttcnctttggcnaccncctctttntgcaggatcccatcgattcgaattcggcacgaggagaatactttatacttctcagctttttttgtatttgactgtgacctggttataccatttgccactgtgaggcttagctgtgcatctgtgaatgggagattgttcttagagattggtcatagttgtccacctgcctcggaaactgcaggtacaaatgcagcagcaaagtatttacattcttacttcagggctgatctcctatttctatcagtccttttgaaggcanagaatgttaatttggaacaacctgcatatttattcaaatttccagagagatgaaactttcagaatgctgtgctgcagcgccccctagtgccgngctgtactgatagtccccagcgtctcctgaagccgaaagtggtgtttcccgcagttccggcgggagagctgtagccagcaggttgtgcaagtgaacattagacatcttttctccttctcgccttccttgggctgagatggaggaatgtgtctttattgctgaaggcaaggtctttgtttttcctttagcaggaacactggttttcccacttcgntaacctttgcccaaggtttctcaactcaagccccctgaggccgtagtggccttcacacacctccagaaggtaaactgaccagcttanccaacaggctatgctttaaggangaagggtcttttggttcccatcctgctgggggggggg

SEQ ID NO: 2996 - DNA, 739 bp, Homo sapiens
  misc_feature (1)...(739): n = A,T,C or G
tcttctnanttcnnttggctcttgntctttntgcaggatcccatcgattcgcggcacgagcccaggctggtcttgaactcctcagcttttactttagcttcccagtgtgttgggattacaggcatgagccacaatacctggccaagtccttttttttaatcaaatgacttattaatacacagtttctttgccagcttttgttttcatttgctatcaaaaatgttgcttagtagtgctttgatctgagttatcaataacaggtaaatgccattatggataataattcaaaaagaagcttattaattattaggcctatctgagagtgaagtaaagttagcattttctttttgtttattttacttattgtttatttgtttagagacagggtctcgctgtgttgcccaagttggagtgcagtggtgctgtcataactcattgcagtctcaggctggagtgatcctcccatctcaccctcctgagtaggtgggattagcatatgccaccatgcctggctaattcttttattttttaatttttttgtggagatggggtcttgccgtgttcangttggtttcaaactcctggnctcaacggcttggcctccaaggtgctaggattacaggtgtgagctaccatgcccagctgagcatttttaaaaaatactgggctttgacatgagtcgttactattggatctaaccttatgactgatatccctaaaaatattataaaatttaagg

SEQ ID NO: 2997 - DNA, 748 bp, Homo sapiens
  misc_feature (1)...(748): n = A,T,C or G
gaagttgtngatcagctcttgttctttttgcaggatcccatcgattcgaattcggcacgagagcaaccctagcaatagactgactctactacaaaacaatttggttatttctcttactatttctctattatatctgttgagggaatgttatcatgagcacaggtattagtcctatgcttttaatcggtttagtggtttctttgtgtctcattttattcatttgtaatttttttaaagactataaaacttccacagtttctttagatcattaagttatatgactctttttcatgggggtcagttaacaatacataagaaaacatttgttctaggataatatatgacctaacagtcttttgttagacttagagatatcaatatgctttctatgtttcaggcatattttatattcctggaaattaaacaatatattttaggaccccataccatgtgctctcagtaggacgatcacaaatcagtgatcatattctagtgttcttttataggaaatgtaaacctatgtcattacattgttagtacaactgacagtgaaatatttaaaaaatctntgtcagccaacaataatcatacttcaaataagccttatgatatgtgatatcacattggtgagtgaattttggtcaaggcagtanaatggagtcactaagaggacagtnggacaagctgtctgagtttcaatcccagctntggtactcactantggngacatctttgggccaatttactt

SEQ ID NO: 2998 - DNA, 745 bp, Homo sapiens
  misc_feature (1)...(745): n = A,T,C or G
tcttttnctaatgctnggctacttgttctttttgcaggatcccatcgattcgaattcggcacgagaccatgttgcccagtctggtctagtctgttttaacaagttgttgctgtgtaatgatatatgtgtggtgttaatttgcttgttcctaagtttaaatgaggtagagcattttatgacatgcctgttctagtcttttgcttatttttctaattgccttttctttttcttaataatttcagttcttcatatgttcagcatactagtcctttgtcaatttacatgtattgaatatatatactctcccattctgcggcttattgttccattcttcatgaacatttgtaattttaatgtcctatttagacctttcctctgtctattgttttatattttgtattaaaggagtcattcattactccaagatcatgaagattttcttgtatgtaatcatgtaatcttcttaaaagctttatggcttttgctttttttttttttttttaagagtcttgttgtgtctccaaagctggagtgcantggcacaatcacagctcactgcagcctcagcctccctggcccaagtgaccttccacctnaccttctgagctgggactatagccatgcaccaccatgcccagcaaatttttattttttgaagagcccgattcactggggttgcccangctgggttcnaatgccctgggctcaagtgatcatcctggcntgggcctccaaaggctnggga

SEQ ID NO: 2999 - DNA, 757 bp, Homo sapiens
  misc_feature (1)...(757): n = A,T,C or G
gtgtntggntnactctttgtcnnttggcnactctgctctttctgcaggtagcccatgcgattcgaattcggcacgagtctcgatctcctgacctcgtgatccgccnncctcggcctcccggggtgctgggattacaggcgtgagccaccgcgctgggcctggatcaaatctttatccatgcacattggaacacaggattactgggtngaaatcatnctagttttgtcatttagatacttgtagatgaatctattttagcacanggtataaataactcgggaggtcatctctatcttntttncttttgtgcatntggctataccacgtttaggtactaaaacagctttgcttatgttggccangggaaaacatggnattctgtgcgcaaagctaatgatcnncagccctgccttggcccctcccttgnttatggtcattgnaagatgcccgcatgttaaggctnannctgtcactgggctgggtgtaatacccgatnnattcctgcngcnancctctnacccgaaacatgaanggcactgggctctattgagatctcgatangatcatcattntnaactngtnttcnactgagggangtaaacatgatatctgggtgctggtggattgagacctcaagcatcaattcaaaagtgctggcaanaatatgcacttatntnnttntgcactctggctaagtgtangctctgatgccantttataagttggnacattctggggaaaaatggtncattttnaa

SEQ ID NO: 3000 - DNA, 860 bp, Homo sapiens
  misc_feature (1)...(860): n = A,T,C or G
ngctnctnntcnngntggcttncgtgctcctgcangagccnatcgattcnaattcgcacgaggccnacactcgnattccccggcccttngcagcnttggagctctagccggggccggagngggagcggcggggcccttggagagacggggggcgcaacccggacgacnctctgngaccggntacggggactgcgccgtgggcgcccggnnccaggacgagctaacagctttgcttcgcctgacggtgggcaccggtgggcnagaagccngancccgcggngaaccctnggggattgagccgtcgggtctgcangagccaccaggncctttcgttccggaggccgaccgggcccggatgcgggagccagaggccagggaggactacttcggaatcatgctcacatggtcccctntgcacggagccctctgccaagccagatccttttcttcatncttggaagtctgcagtggagagaaatcattctataactgaacagctcgtttgactgatgggaaaactgaagtcccanagacgatntctgggcctacctggttttctctagaaaagtattttcaagtctggttgcttgaaccacctgtgggacntggggatttttttgaancggnncaattccttacaacacntggnaaccnngannaaccnnttacccctttggcccctggtnggtnaannnnnttttttcttncccccaaacccnggnaaaaaccttnaagggcnnttcctggnaattggcccaaggggggancccaattaanctttttcnnaacttttttttttccccaanggttttnccccttttaaggggnaaanngggggntngnccttgannggttttana

SEQ ID NO: 3001 - DNA, 860 bp, Homo sapiens; identical to SEQ ID NO: 3000
  misc_feature (1)...(860): n = A,T,C or G

SEQ ID NO: 3002 - DNA, 764 bp, Homo sapiens
  misc_feature (1)...(764): n = A,T,C or G
agctnccacananagctgnattccgancttnctgcaggagnccntcgatncgaattcggcacgaggccgccactcgtatcccccggccctttncagnnttggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctnggggattgagccgncgggtctgcaggagccaccaggtcctttcgttccggaggccgcccgggcccggatgcgggagccagaggccagggaggactacttcggaatcatgctcacatggncccctctgcacggagccctctgccaagccagatccttttctccatccttggaagtctgcaatggagagaaatcattctataactgaacagctcgtttgactgatgggaaactgaagtcccagagacgatttctgggcctancctgctttctctagaaagnattttcaaagtctgcttgttgagcaccttgtggactggcaatntttgaccggtcatcctacacactgnaacaagagatcataccttggctgnggtagccttttnttcccaacagaaactaaancatntgaatgcccgggaccatatctttgaattttttcaaggttccctaaggaagngggngcctggggtnaa

SEQ ID NO: 3003 - DNA, 764 bp, Homo sapiens; identical to SEQ ID NO: 3002
  misc_feature (1)...(764): n = A,T,C or G

SEQ ID NO: 3004 - DNA, 751 bp, Homo sapiens
  misc_feature (1)...(751): n = A,T,C or G
nntncntnactnntttggctacccgttctttntgcaggatcccatcgattcgcagatacagcctagtgtccctcagttacacaatagtgtntnccccnttggtaggacagtctactactgagtcctcctggcatgagtcgagctgagattaggatagggtaatgacccttcagttttggggaagggaccagagctcggccagtgagaagcttccagctccgtctggccatatccaggctgctgagggtcctgggctctgtccttaaacctcatcactgacatgacccagcaaacctcctcaagaggaaaaagtccccttgggtcaaacacagcttgtgcagttctcggggacctcctcctgccatcctggggatgctgtggagaatggagatgcacagggggctttgtcctctcctctgccttttggagaaaatatttcactcaaggcaaacgcagcctgagggcagcacaggggaccccaaggctcactgcgcatttctagtcgcccccaaacgcgtgggttttcctcctggtctcctcgtgggtgcctttgctcattctcatcctcctgttctcatncagtctgcccagtctgaccggcttccancagcatccggccaaaagtttctnccatgacagcaggaaccacctnagacaatacatgatggacangcctgctgngttccaatagaaccccganttaattaancccgaccttccttttanctggatactggtaatgacaggggtc

SEQ ID NO: 3005 - DNA, 792 bp, Homo sapiens
  misc_feature (1)...(792): n = A,T,C or G
gnnnnnnnntntatanatacangctacttgttctttttgcaggatcccatcgattcgaattcggcacgagcctcatcagcaagccagtgagagggtgcctatccgaggatgatattccatcacctntgtcagattctgcttactagtcagnccccaggcccaggccactcgcaaggggaggacattacaggaggcgtgagtataggtggtgtgatctgtggggaccgtcgcagaggctgnccancacaaggggttaaaacctataaaacttcgaagttggatttaataattntcaattactaggaaatagataaaaacaaattttctgtccttcacanaacactaaagtatgtattggattttntatcccccctgaattttgctgtgtgngtgcttcccagttgaagcagtaattcaggttcattaatgtttacttcaaagccgaattggagncttgactnacacagttcaacgctcttttcagtaacantntcaaattcctttacggttatttnttgccacataacacactatcctaaaatgctggggcttaaagcagncaccactgtgtttgcttatcatgctgnngatcagcatttanggctgngctcgngntgggccgnttttcatgtgaattagcttcttgggcnttaacttcgtgtggggtctngcccntnggtcttgntgggcnaacttgggacaattcccagggggaccctttgggaatggnccttgngaaattnccggaaaccgtggggntttnccccaanccaaantttgnnaacccagggg

SEQ ID NO: 3006 - DNA, 728 bp, Homo sapiens
  misc_feature (1)...(728): n = A,T,C or G
cncntnaactcnnaaactttccgcccncnnngcangacccatcgatncgaattcggnacgagcctgnntccaggagatatgngcgttttntcagcagtgatnaaaatcntgggcaggtgttatngcnctgttngcntgaancacacncacctacncngcnggaaacaagcaggntgntgcttacttgcctttcccaggcagaagtggccagagnccgggcngaaaggatccaccaacanccnccnatncatgatngcanntgnncnntnntggnaangncancaaaagcncacttgctggtgaaggtgcgngangnnggnnncaaacnctttnacncgcannagaaccnaatnctttaacgggnacaaatggggctgctcacgctctggaccnntccccggaagactctgaanagnnggctccntttcgggttgtgcactggtgcttgnagctgccaaacccnacaaaactgaaaatacagaatggnttcacgtatanagncacannncacaantgccggactacagcccntgancgaatgnaancacttgcncatattacntgacnctggannacaaactntgaaaantactctctgncctgggnngccatnaattctgccacctgnagatnccccattattncttaataacngaaaacagngcttgcctccgatagttaangcgggtgccnctaagcnttaacgnttcgcaanattnntcagatta

SEQ ID NO: 3007 - DNA, 752 bp, Homo sapiens
  misc_feature (1)...(752): n = A,T,C or G
gangtgctntntctttttgaggatcccatcgattcgaattcggcacgaggagcggggaggcgagcatgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgccccttcccagactgaggagtgcctcagggagaggccaagcacctgcccgcccagagaccagggcacccctgaagtcacccacccctgcaaaggacacatggaanggcaagcnggctcgatcccagcaggagaacccagagagccagcctnaagaagaggcacgccccttaaccaaacccttcgtcgtancttgaggtcaaaggcaacgtnttcggncanccgaaacanggcaccttgnattccaacggnttnaagaacccnttncacttttccggttcttggcgtnttccttgaaggaaggttcaaan

SEQ ID NO: 3008 - DNA, 720 bp, Homo sapiens
  misc_feature (1)...(720): n = A,T,C or G
gnntcttcgatcagctcttgttctttttgcaggatcccatcgattcgtgtattcagaagaaagcaaggatagaatgagtataactctttaaaatttggaggcaaaattggctgtgagttgccatggagataggagcaatggatgtccaaggtctgaggaaatagaaactgttcgaaataattgcagagaaagcttgccaacggtgataagtaggtttgtctagcagcactgatgcgtcgtggaagttgatggtcatgaacatacagtgtgataacctatctgccctcttgaccttttctagtagtgctatgtcattttggtactaaggtaggtgaattttccaagtgttcttggaaataaggaaacatcaagaataatgtaaaagcctcatatacaataatgaataataaagaataatgtgaaggcttcattcaaggttggggtttgccagatacattgcaacaaaatgacagagcagccaaggtatttaggatagtggccaaagtattgtaatgatggcttatggagtgtcagctggataaagagtgaaaatgaataaaaactaatggattgttcagtcgaatagcagatggtacaatggtacatggccagtagaataggggcccaataaattgaagaccatcagagtggagtgataatccacaagtggatgcagggatcnagccaagtcgatgacatgcatgttgctatgtggacaga

SEQ ID NO: 3009 - DNA, 748 bp, Homo sapiens
  misc_feature (1)...(748): n = A,T,C or G
gnnnnttnnatcagctcttgttctttttgcaggatccctcgattcgaattcggcacgaggaaggaagaaaatttgggactttgttttaaaagtggaatactatcttcttaaacaacttgtgtttaaaacaagccccaatccacacttgatcttcttaagctaggaaaagtgagctcacactgagtgctggcaggatgctccatgtgcatcattattttgtttaattctcacaataactctctaaatcccttttgaggataaggagactggggctgggagaagttatttcaaggagtaaataaaaaattcagacccacttgggttttatgccaaaggctctgtttttacaaatacacaatattgttgcccagttgtgatgaaacataatttatgaatttcactgagggaatttcgcaaaaggaaagaatttacttttccctctaaagcagaggcttttcatatgcaactgttaaaagacacacgagcttgtgggtctgatgggtggtctgagctgttgctgttgggagagctgctgggacactagcaggaagacgtagtttgtgctcantggccaaggatggcgcccccgtaaggcaaccagatccggactacgcagtgttttccaggctggaggtgccctnctcaactgtcttacaaagttcccaaagcagccacccaaatctggctgctccttatgcccaaatggatttggcaggaaaaaaggccaattgggcaancagangcccaa

SEQ ID NO: 3010 - DNA, 780 bp, Homo sapiens
  misc_feature (1)...(780): n = A,T,C or G
gnttctaatgctnggctctcgttctttntgcaggatcccatcgattcgcttaggggaaggaaatgaaggtcagctttgggtatactagtgtaaggtgcccatgagacattcagataaaaaccagccaccaggcatatggagataacagggctgaacttaggagaaaagcctgggttgaaacagagattcggatatcctcagtatgaaggtgatagttgaaactggggactggatgaccgaaagagatcacccagaacaccagtacagagaggagagagctgaggatggaattttgggacataggtgcttctacagcacatggcaccaacctctaataatcacaccacttgctattacatttgatttttgaaagagtagcctgcgcagtaatgggaggaaactagattgtatatgttgatgagcaactagaaacaaagaagtgcagggccctagttgtagactaatgttttgaaacatttggctgtgggctgggcatggtggctcatgcctatagtcccagcacttggggaggccaaagtagaggatcacttgaggccaanagttcaagacccctgggcaacatagcaaagcccctgtgtctatttaaataaattaaattaaaatanaaatcagnaaaacccacaaggctcattattccttttccaaaaaaaaggaaaaaaaaaagttggcttgttgaaaaagnaaaggggaaaccnaatngggccaatnggctttggaagaatctttngnaaatggnttgnaaanactttttgttngggg

SEQ ID NO: 3011 - DNA, 754 bp, Homo sapiens
  misc_feature (1)...(754): n = A,T,C or G
gnttcaanagacagctacttgttctttntgcaggatcccatcgattcgaattcggcacgagattgtcttgtgttatggtgcttcagcattggattcagcagccagcttcctagtacgaaggcaacgattacctccacagggtcccttccattgtcctcctgcatcattttcctccaacttgaataaatgttctacccacctttctcctttattttctctaccccctgtaccccgctccctctcacaattaactctacagcagaatgtgaattctctgattttagaataactattttatggtaacttcaaatatatcctagttgtatccacattcagcttgggtaggtaccttcatagtagctcatggattaattgtccactgcacccaatcatagtcatttttggtttgggttgtcatatgctccccaatagatgaagaagagaataactcttagccgacttcatcagcaggtagggagagagtctctgatggagttatatttcattattcctcacaattgcatagtgccctcttacctcaaaaaaaacctttccaggtgttttcaaaggaattattttattcctncacaacaagcctgtgggantcggagcaaaaggcaaaagtgattacctgagacattagataactcgcaatatcaccctggttaacaactgaggggcccttgggctttgancttctgntttccgaatnanggctttttcctgncatcntggcataatncaanccatggcn

SEQ ID NO: 3012 - DNA, 753 bp, Homo sapiens
  misc_feature (1)...(753): n = A,T,C or G
gnntncnaatagcnaggctacttgttctttttgcaggatcccatcgattcgaattcggcacgaggagaaagtaaagtccctttataatggcatgtgaaccagacaatttagtagccagggttgtaaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgccttgtaagaggtagcactagtaagtaacagtgctcaaattcaactaggtctttcagctttttatacaatactgcctgttatcagaaagtatagtcttaaaatctgctatcaagcatctatcagaagcctgatgagaaatattcagatgatctaacgcagttcccaaacctgcattgtgggccgttttcattacaattacctaaggtgctttaaaaattttcttgggccctactcgttgtggttcagcagctgtgtaatggagcaaaaaggaatagtcactaaacagcgaaggaaagtggtggaattattgaaagacctagcacttacctgctgggatgagtctcttaccccacagaattgatttcaaacacaggacttattcaagataaggataataaccactatcttcttgggtnggaaaaaagtacattagactgngtttttaaaaaatttggtatgaatttc

SEQ ID NO: 3013 - DNA, 748 bp, Homo sapiens
  misc_feature (1)...(748): n = A,T,C or G
gnnnnnnnanttntcaagctacttgttctttttgcaggatcccatcgattcgaattcggcacgagatgacttcctagctttacccggggttttttctgcaggtggagaagggtggagtcctcccagatggttctttctttgctcccctaacagcctttaagatgtggctacttgtttttcccaccgtttaacaccctccaacttcatttggagcacgggttcctcaagggatcctgagagctgggtgctgggtgctggtttggagaggcaggatgatgcttctcccggctggggagagcagagcaggaaggctggttggcgccatgaggaaagagccacgaggttttagctcccgaaccgactcgtcagtagcccctcctccatgttggttttacatttttccctcctggtctggactactttagcgcaaggagcccagccagacacggcagcaggccgcattgacccgtctccatcggaccccagcccctatctccaagagacagaggaggggtcangaggcactgctcatctgtacatactgnttcctatgacattactggatttaagaaaacaccatggagatgaaatgcctttgattttttttttctttttgtactttggaaccacaaaatgaancagaacttgaccctgagcttaaataacaaaactgngccaactactactggggatgcctaatatgaatccacgtgtaaccagttntaatcctttatttttaaaaaaaaaa

SEQ ID NO: 3014 - DNA, 835 bp, Homo sapiens
  misc_feature (1)...(835): n = A,T,C or G
tntntctnctgnactntcgggaacttcctctttgtgcaggatcccatcgattcgaattcggcacgagggaagtacaaattaagatcacagtgantttncattatccacttgtcacaatggctaaaataaacaatagtggcaataccaagtcctgtgaaggatgtggagaaatggatcacttatacactgctggtgggcatgtaaaatggtacaaccagtctgaaaagcantttggcagtttnttataaaagnnaacatgtaattatatgctgaggtctgaatgtcctccaaaaattcatatgntgacacccaaaccctcaaggtganggttttaggagggtaggccctttgggagattagcttctgaggatggagccccatgaatgggattcatgcccctataaaaaagaanccccaggaaacgaccttgcccttcaccatgtnatcaagaatgtgcggnctatttacganagannccttgcncaaacactgaatctgacggtgccttganctcggggctttctgggcctctnntaaccatgaggaaanaaatctcanntgntntataaccaacctanccnaaggatanccnggtattaacaggccccacantgngctaaanatggncatattgaaccccaccagttanccacctctttgggccaattttatttnccaaggggaaaatggtnaaaattgggggnttnattacccaaaaaaacccttgtnnccnnnnnaaaangggttccantanccantnatnnnaaaancccntnnggttnanccccccaanaaacttttggggaaaacaaannttnnnaaaaanggtttttnt

SEQ ID NO: 3015 - DNA, 764 bp, Homo sapiens
  misc_feature (1)...(764): n = A,T,C or G
gnatgtgnnnancagctcttgaggatccatcgattcgaattnggcacgaggggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcnggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctnaactggagccgaaaggcccancagggcaagactggaggctgcccccagccctgtgccccagtgaagccagctccgcctcatccttgaagcacccagggtggccgtgagggccaggatccctgcacgcctcaccctggctccaactggcancaagcaccgagcatgcccttcccacccaaaggaccttcnggcaatgccttgtnccgccttatgcttggaagcttgcctngggcaccttgccttgnccatttaaagactggtcanaacctgaaaaaaaaaaaaanaaaaacttcgagaaaaggcccnaacattggagaatcaagaattntatcttggnacttgcatttgancctctttcttaaaattnn

SEQ ID NO: 3016 - DNA, 772 bp, Homo sapiens
  misc_feature (1)...(772): n = A,T,C or G
gttattctttcnaaaangntgggntactcgttctttctncaggtagccnntcgattcgtttgtaggcaatggaaagccaccagtggttttagttgagcagcaatgaaattaagcctgtgctttgcaaagattaatctancagcnacagattggaagcaacaccaccattcctggtatcagtccacgtanaatatattacagntctntactggagcaannncagtaatattanaaggagaaataaaannnaanaatattgcacaggcagaatggggaggtcccacngatggagctgatcttggcnattgangcatgggtggcattnatcatgtnaaacacaggatgaggaactgggttnggagtnatggannagttcantttacgtaattgcaaatacacnctattccctgactagctncnannacttnatcttncctatcttcttagancttcattatgaagaggtgatgatagctcttangntgagagctcttacttaccattgactaatacatgttctcntgatgnaantttgntattncaacatccatgctaaanggggttattnaaacangnnaactctngggccngatgaaggnnnancctncattaactnntcatgntgnnactnnatcnaaggggccaanttgtnnccttaaatttttgtaaaaatttngccaatgccnaaaacatatnaatnttcncttgcanatgaaaaantcncgaancccnatttnntnaaacagaanggttnntggnnggacctttttan

SEQ ID NO: 3017 - DNA, 757 bp, Homo sapiens
  misc_feature (1)...(757): n = A,T,C or G
gaagngctctgttctttttgcaggatccctcgattcgaattcggcacgaggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgncacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgccttgtgtgttgcaccaagacatgttgatcgaaatgaccttttcacctcattctatgataaagttgaaatttcngggaagaagttaaaggatttaagagcttgttgnaagangcatttcgtaccnagttatttaaacctctggtttgatggggattagaagattggatattttgt

SEQ ID NO: 3018 - DNA, 734 bp, Homo sapiens
  misc_feature (1)...(734): n = A,T,C or G
nctatnactgantnccnttcnngctgcaggatccctcgattcgaattcngcacgaggggacactggattctcattctactcaaactcccactaggactgttggcttgttcgcttctcaagtgtttgtatttttctgagttaatatttttgggtgtaatttacatgtaggaaaatgtacacatttttagtgtacagttcaccaagctttggcaagcatgtatagcctggtaacccacaagccaatggagacctagaacattcccgtgaccccagatgctgggttctgtgtgccttcccagggcttgtggctgggcacatcaggcatggcgggtaccatgcctgacagctctgaaccagttgggcgacctgggtctgggaggtgctgagggacccagcaccctgcaggcgtttccttttgtctcatgtagcagtgcagatgtttggaaagtcacacgtaaatcttgaaaaactggaaacaggccangcgtggtggctcatgtctgtaatcccagcactttgggaggccaaggtangaggactgcttgaggccaggagtttgagaccagcctttggcagcatagaaagaccttgnctctacagaaaattttaaaactagccaggtgtgggggggttgcatgcctgtagtcccagcaacttggaaggctnaagttggaaggattgcttgagcctaggaatccaaggctncaatgagcccatgatcaccaattgactgc

SEQ ID NO: 3019 - DNA, 795 bp, Homo sapiens
  misc_feature (1)...(795): n = A,T,C or G
gtctatctcactnnagccctntgttagcnctggttctntttgnatnnaattcggcacgaggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaggccactgtaggaggatcaattgagcctagaagttcaagaccagcctgggcaaagtagggagaccccttctctacaaatagtaataaaatgaaccggggcatagtagcatgtgcctgcggtccccagctgctctgataagaagangctcactttgaccccaggaaggttgangctgcagtgagccataaccgtgcccggttaccacttccaagcccttgattgaccaggaaccgaanaccacttggncttcnaaaaaaaaattnaaaaaaaanttcannaattggcttggaaaaaaaanaaatnnntnnnnnnanaaaaaactttggggcccttttttnaaacctnnttgggggaggtccgattttaccntaanantc

SEQ ID NO: 3020 - DNA, 764 bp, Homo sapiens
  misc_feature (1)...(764): n = A,T,C or G
aanccctttgaaaatcccctttttgcaggatcccatcgattcgaattcggcacgaggganntnaggccanganacaaagcagcntttgccagnangagacactcattggnaggnctaatgtcnccctgtgctgatacaagcatgaactntntggaatnttctgctantctgaaattacancnantngnctggggtnnggnngacgcntggcaatggttgtnttnacacacnganttacnctgaaccncaacntggacngcacatnacacacatcanactttcacngngcatctcgaactcngggttcacccgatncngaaaccntatgctaccaagaagtgcgtgncctctaggcacacctcactattgcccggcaaattnntgtganttcggagcttttgcagaancnngannnctgcatgaacnccaagctggactcatannaccnganntcatctgatccgcctgcnngagctcccaaagggctgngatnatatggnnaagccacnctgcttatccaaggtcaatntgaaantnngaccaacncnggntngatngcccnnaaaggctnaacgggnacatgccnntaatgccaaaaacggtaaanctctctcancccgggaacccggaactggnaaacttgngccgctttacccaataatgnntccgaataacgttnnancccaaaaanngggccccagccntagggngaancntggacaagcccacaanttggnaatggccntnnnaaaaaaaatgnttnn

SEQ ID NO: 3021 - DNA, 810 bp, Homo sapiens
  misc_feature (1)...(810): n = A,T,C or G
ngtctntnacttcgtggctcctttngaaaatccccttttgcnggatcccatcgattcgaattacaggcttgagccactgcaccaggccctaagagctctttnctttcttatcacacagtgaattaaaatattttggatcttaactatcccatattaagcgatcctttcctcaaatgaaagaaaatacttaattagaacatatatgtttaaactgatacagtaagttgtttgtaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgntccctttantgagggttaattgcgcgcttggcgtaatcatggncatagctggttcctgngtgaaaatgntatcccggtcacaattncacacaaacattaccgagccggggagcnttaaaagtggtaaaagccctgggggtggccttaaaggaggtggagcttaacctcaccaattaaattggcggttggngccttcaaattggccccgcttttccaantccggggnaaaaccctgnncntggccaaanttggaatttaaaggnaaatngggcccaaangcccccggggggaanaaggct

SEQ ID NO: 3022 - DNA, 765 bp, Homo sapiens
  misc_feature (1)...(765): n = A,T,C or G
gntnnttctaatgcttgggtacttgttgttctttctgcaggatcccatcgattcgctgaaatgtcaaacacggccacctaggcagcatttacaagcaagagttcactgcttttttgatgtatatnttaagcgcccccagtgaatgaacagcatataactccacataaaaatcattaaatgtaattgacttccanagcangcagttctgntgtatgcctctggagaaggctggctgaattgnaattggtctgtaccttctgtctatcatgtacatgaggtttttgggcaaagagaactttccacaaaataagtccaaaaattatacgatcatcagacaaccaatancatattgatganatatctccaagatctanaatnntnctgngtgtcaaggaantctttgnggtttttacaaatattgataatgcactttntataaaatgcactttttataaaaatgcatgctcagttnagacaacttggnaacaccctgaaaaggnncnngcgtantgngtnacgcctgnaatccnagcnctctgngaggccgagacgggtggatcacnatgtcaggaaaatgngaccatnctggntaacatggngaaaacnccgtctctncttaaaatncgganaattngcaggatntggtgccggccncctatngtnccatttactcannaaggcttgagtnaggaaaatggtgtgaancccttgaaanangannttttcaatnaccggggatnccnaccnttgaatttnatctgggga

SEQ ID NO: 3023 - DNA, 757 bp, Homo sapiens
  misc_feature (1)...(757): n = A,T,C or G
gnttntncatantgaaagcncttgttctttttgcaggatcccatcgattcgaattcggcacgagcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagntatttaaacaagaaactctcagaatgtgtttggaagangagaaaggagaaccactgattttatctggatgctactacttactacaggacagatngaatttcttggaaccgatgcttcaaangcttggttcccactgnatcatggacctgccttntnatctttataggggccnccaatttatacagtcctgtggctgacctgncatttcatancctgcagttct

SEQ ID NO: 3024 - DNA, 752 bp, Homo sapiens
  misc_feature (1)...(752): n = A,T,C or G
ntaatccaanaaccttgttgaagcctttgnannnccnatcggcaggacccatcgattcgaattcggcacgaggacccaggtagaccagctcaagagttcatgttctttgtcatcctcctgtgagctctctgtaagtctctttcttgcccatcaccacatccctagtactgggtatcagtctggccacttggctttctggtttgccccaatgtggtctattcttgatgcagctaccaaagtaatgttttaaaaccattataccaagttactatccttgtcaaaacccccagtaactgccaatctcacttagaataaaatccggactcctgtgaagcacagcataaactggccactgcctatgcagcaacctcatctttaccgtttcctgccttgctcactcccttccagcgccgttattcttcctgatgcccctagtacacaacaactncttcctgctccaagagtaggaaaattactgntctctctgccagtgagattcctcttctggtattacctttgcttcattgctgaatcttctccaatatcatcttctaaaaagagccttttaaaatcaccttttctattatgccctactcaatttccagtccctgaatgcccattccccacttcatagcacttattgctatctgaaattcactaaatgncaccttcatganggtaggcaatttaatgncttggcactggtatgtctanagacaagcactggctatagtaggcactcaacaaatatt

SEQ ID NO: 3025 - DNA, 763 bp, Homo sapiens
  misc_feature (1)...(763): n = A,T,C or G
nctctactcagattgcttggcgntctntntgcaggatcccatcgattcgaattcggcacgagccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaaagtcagaaatctgacccaattcaccccctgcctctagcacctcttctgtcctgtcattcccacacacgttcctgttcacctcgagagagagagagagagagcacctttctttcgtctgntcacttttgcgggctntggaatnccagctcttctctntcagaagaagccttctcttcctctgccttgtaggtgtnccaaaagt

SEQ ID NO: 3026 - DNA, 933 bp, Homo sapiens
  misc_feature (1)...(933): n = A,T,C or G
ntatcnttatacgtctctaaaancnttggctactngttctttntgcaggatcccatcgattcgaattcggcacgaggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcagnnttggcttgctgggccctcagagcccagtgggtggctctgactcggctccctactccctgcacccagctgggcgcaccttggggcctgcggtctgaatgtatccctcccctnagttttaacctgagctgccgaacgcacagtgggcncgggggcnaagctgtgnggaaaccggggcccaattacggatcccnggaagttacaggtgccnacgtgatgtcnctttntcttggtgcccaacttaccttacttggtcttgaanacttagcttcttnggggggtaggcccgngggccccnccaaaaaanncntggnnnncccggntttccaacccnttggccccggtggccttgntttganttattgangcccctggntttggnccaaataaanccccccttgggttntgggggggaaaggnaatttttngggccccaacccnccntttggaaaaaaancccccgggaangggnaaaaaaccggggnccnntttnttgccccttgggggtttttttnccngggaaaaaaaacccccnnttttaattggggntttttggggtccccgtttccaanaaaacaccctttggttttnaaaaggggggggaattggngccnttnaaacccgggcccaaanccnntaagnaatttcccnaacccgctttnaannn

SEQ ID NO: 3027 - DNA, 773 bp, Homo sapiens
  misc_feature (1)...(773): n = A,T,C or G
nttnagcntannagccgttgtantgaagcccntttgctacttgctctttttgcaggatcccatcgattcgaattcggcacgaggacccaggtagaccagctcaagagttcatgttctttgtcatcctcctgtgagctctctgtaagtctctntcttgcccatcaccacatccctagtactgggtatcagtctggccacttggctttctggtttgccccaatgtggtctattcttgatgcagctaccaaagtaatgttntaaaaccattataccaagttactatccttgtcaaaacccccagtaactgccaatctcacttagaataaaatccggactcctgtgaagcacagnataaactggcactgcctatgcagcaacctcatctttaccgtttctgccttgctcactcccttcagcgccggtattcttcctgatgcccctagtacacaacaactccttcctgctccaagagtaggaaaatnactgtctctctgccagtgagattcctcttctggtattacctntgcttcattgctgaatcttctgcaatatcatcttctaaaaagagcctttnaaaatcaccttttctattatgccctactcantttccagtccctgaatggccattccccactttcatagccacttaattgctatctgaaattacacttaaaatggtcaccttcatgatgggaaggcaattaattgcctttgtcactggtatgtctagagaacaagcagnttggctcatagtaggcactcaacaaaaattt

SEQ ID NO: 3028 - DNA, 773 bp, Homo sapiens; identical to SEQ ID NO: 3027
  misc_feature (1)...(773): n = A,T,C or G

SEQ ID NO: 3029 - DNA, 773 bp, Homo sapiens; identical to SEQ ID NO: 3027
  misc_feature (1)...(773): n = A,T,C or G

SEQ ID NO: 3030 - DNA, 751 bp, Homo sapiens
  misc_feature (1)...(751): n = A,T,C or G
ngttnnnnttgtnctntntctctgaaancgtttggctacttgttctttttgcaggatcccatcgattcgaattcggcacgaggtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttnaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttggatacagcaggatcttgctctgtcgcccagcctggaatgcaatggctgattaaggtcactgnagcctcaatctcccacttttcagcgatcatccaccttancctcttggatagctgggaccgcagcacanctacatgcctgnttaattattttgtaaaaccgggtttnctgtgccn

SEQ ID NO: 3031 - DNA, 752 bp, Homo sapiens; identical to SEQ ID NO: 3024
  misc_feature (1)...(752): n = A,T,C or G

SEQ ID NO: 3032 - DNA, 768 bp, Homo sapiens
  misc_feature (1)...(768): n = A,T,C or G
tnngttnnnnttgttatncnctnngaaaccnttggctactngntctttctgcaggatcccatcgattcgaattcggcacgagacctgagctagggttgcagcagaaaattgagttgcagcttgcccttgtccagacctattttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcantggaaactggttaagccagttgttcatcttcgtttccaaatntaaaggatagctggttaggatattttggtcatatttgtaaatttttgaaatgcttagtaatgtgttttcaccacaagtatttgttgcaaacttaatgncatttccttaanaagggtacagctatgtaat

SEQ ID NO: 3033 - DNA, 823 bp, Homo sapiens
  misc_feature (1)...(823): n = A,T,C or G
cacngaatcgatntnacctttgttcangccttttngaaggaccccatcgatacgagcccatgcgattcgaatncggcacgaggacnnaggnagaccanctcaaggagttcntgttctgtgtcatcctcctgtgagctctctgtaagtctntntcttgcccatcaccacatccctagtactgggtatcagtctggccacttggcttnctggattgccccaatgtggtctatncttgatgcagctgccaaagtaatgttntaaaaccattataccaagtnnctatnctngtcanaacccccagtaactgccaatctcacttnnaatnaaatccgnactccngtgaagcacagcataaactggccactggctatgcagcaacctnatntntaccgtttactgcctngctcactccctttcanngccnttgattcttcctgatgccnctagtcacaacaactnctttgctgctncaagagtangaaaatnactgatcnctntgacatgagatcgcatntttatggtattacctttgcgtcattgctgaatcttcnccaatatcatnttctanaatagagccttttaaaatacccntacnntattatgccnttnctcaattttcaantccctgaantgccccatntcnccacttttcagtagncactttaattgcttatcctggaaaatttancacctanaattggtcacccattgaaagaatagggnnatggcaaanttattgggcctttngtcnaactgtnctgnncttanangaaccaagncaacttnggcttnanaagtaaggcnccntcaaccaaaatnttct

SEQ ID NO: 3034 - DNA, 823 bp, Homo sapiens; identical to SEQ ID NO: 3033
  misc_feature (1)...(823): n = A,T,C or G

SEQ ID NO: 3035 - DNA, 823 bp, Homo sapiens; identical to SEQ ID NO: 3033
  misc_feature (1)...(823): n = A,T,C or G

SEQ ID NO: 3036 - DNA, 760 bp, Homo sapiens
  misc_feature (1)...(760): n = A,T,C or G
ncgttgnnnnttctntgattccttgtntgangctctttctgcaggatcccatcgattcgaattcggcacgagggcagctagagtcaggaaaatgaccctcatatgcttttaatctttgtttcagttgtctgtcagggttgaattaagaagctactggtttattcccaattgttgatgcctttaggtatgttggaatctttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatcacaatttgtctcctctttcaaacctgacatcttcgggctgttttattagtctaaatgatgcatttacttttgtcattttatgctaattctttcatagtaaataatcaggctatataaggtaatatttccccananggtaattttaatgggacnanggttggtgggatgatgtcatatcatacatggggattgcc

SEQ ID NO: 3037 - DNA, 764 bp, Homo sapiens
  misc_feature (1)...(764): n = A,T,C or G
tnnnctantnttatacctttantactngctctttttgcaggatcccatcgattcgaattcggcacgaggtgatctgcctgccttggtctcccaaagtgctgggaatacaggcatgagccaccgcactcggccaggagctagttttatcagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggagctgccctgtggtgcacacaggcctgccatggggcgtgggagcccatcccgctgcctgaccggagctggctgctgtggtggactcaggaaccacttttaatactgcaactgctcccttttgcccagtcagggaaagctgactgtaagtcccacctncccctncgtccacccttctagtggtttctctgagaggtttctctgcttcagctgtgcttgaagtggcatgcctnctctgctgcanggctcccccaacccccacacggncttaaagatgttaatttccttatagactggattaaagtcagccattctttttcctcaaaaaaaaaaaaaaaaaacttgagcctntanaactatatgagtcgtattacgtagatccagacntgataagatncattgtgagtttggacnt

SEQ ID NO: 3038 - DNA, 787 bp, Homo sapiens
  misc_feature (1)...(787): n = A,T,C or G
tgggnnnnnnnnnttnnntntactaannttatgcctcgttagtacnngctctttttgcaggatcccatcgattcgaattcggcacgagattggggactgacatcttaagctctcacctggctgcagtangaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgngctgctacattatactggaaattaacaggggaaaagggaagagcttcttggctcccttgaggtctgctantgggtgttagggagtggttacaactgaacttttantaaccatttaaccgtatgtaaacttggtttctaattaaaaaaaattcctttttccaaaaaaaaanaanntnaccccnntttttantcnnnnnnanctnanannt

SEQ ID NO: 3039 - DNA, 752 bp, Homo sapiens; identical to SEQ ID NO: 3024
  misc_feature (1)...(752): n = A,T,C or G

SEQ ID NO: 3040 - DNA, 811 bp, Homo sapiens
  misc_feature (1)...(811): n = A,T,C or G
tnnnaatcncnnnaagcctttgttnaacccctttgctactngcnctttttgcaggatcccatcgcttcnaattcggcacgaggttatnccagtatctgncancagaatggcattgtgcccatcgtggagcctgagatcctccctgatggggaccatgacttgaagcgctgncagtatgtgaccgataaaggtgctggctgctgtctacanggctctgagtgaccaccacatctacctgnaaggcaccttgctgaagcccaacatggtnaccccaggccatgcttgcactcanaagttttctcatgangagattgccatggcgaccgtcacancgctgcnccgcacagngccccccgctgtcactgggatcaccttcctgtctggaggccanactgacgaggangcttacatcaacctaaatgccattaacaagtgcccnntgctgaanccntgnnccctgaccttcttctactgncgagcnctgcangcctctgcnctgaacgcctgnggcggnaataaggagaacctgaagctgctcacgaagaatntgtcaagcgaaccctgncnaacagccntgcctggcaaggaaagtncacttncgagccggttaggctagggcttgctgcaaccgaagtcccctctttggtnttctaaccatcgccttttttaanncggaagggtgtttccccaaggattgccccccaanaacttnnaagncctttggccccaatttccnantttttgaaanaaggnaggnccgccntnctttanngggcttccaaaccttgggcttagancccnggcttttttt

SEQ ID NO: 3041 - DNA, 757 bp, Homo sapiens
  misc_feature (1)...(757): n = A,T,C or G
nggnttcnntctaactnaaacngttnggnaactcncctctntctgtngatcccatcgattcgctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgangttggagttcgaaaagaagaagcaagcgctggcctgccttgaaagaacccgaaagtctttcccattcacttctctagaaagctgccaagacagangcagaaaggaaatggatgatagttctgtcaagcacacttctgntctcntagaacttagaaatggttctaagagaacagaagttatngagaacagttcntgtggaattcaacatcttgggtgggacncattggcttt

SEQ ID NO: 3042 - DNA, 788 bp, Homo sapiens
  misc_feature (1)...(788): n = A,T,C or G
gnnacantgaacggaaagtcccnatcnntgnaggatcccatcgatnngaattcngcacgagccccactcggggtatgtgaatgcccnttttgantaaggaagtgcccatcttcacaaagnagcgcattgacttcaccccttccgagcgcattaccagtcttgncgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggangtcctctacgggaacccacttgagaaggctgcctcctaggctctgctcagtcatcttgcaattgccacactgtgaccacgntgacgggagtagagtagcgctgtnggccangaggtgtcaagtgtgagtgaattctgccagcttctcatgctgnnttcananctgcagttatgccagaccatcagcctgcctncagnagaggcccttcacctggagaagtcagaaatctgacccaatttccaccccctggnctcnagcacctcttctgnccctggcattcccccacncacgnncctggttnaccctcgagaagagaagananaagagaagcaccctnnctttccgactggtaaanntctggcgggccttttggaaancccanctcctnttntctcagaaggaagccnntnttcttccctcctggnctgaaaggtgtnccaaaaaanc

SEQ ID NO: 3043 - DNA, 788 bp, Homo sapiens; identical to SEQ ID NO: 3042
  misc_feature (1)...(788): n = A,T,C or G

SEQ ID NO: 3044 - DNA, 804 bp, Homo sapiens
  misc_feature (1)...(804): n = A,T,C or G
gngacctanngntngaaacgcnctctctgcaggatcccatcgattcgaattcggcacgaggtttcatttaagaagaatgagctagataaatgtgctcttctggttaccccaccctgacngagtgcatttttacacggntagcaggggttgagactgcagcctggcctgccagccattggaggtgtttaaggaagggcagataatgtgactctttgcggggtgccatctgcttacccattancgagcagagggggtntntgcgggtgaccccnagcatatntctaggttacttatgggcagatttgtaagtgacaatactccagctgatgctgggaatggggagagggcccttgagggactttgtgntncngtgcttctggtttcctggccaacccccagggtcaacttngtcttggatgcccaancttgggcactaatgtctgncacctgactatgtnaaantgtntaaatgattcctctantttnggnatgagatcttccaatccanaggaancccnnctttggacttgccttgggttaaatcttgcatancntaaagtggttngatgaagttcatctgaagaaatttanggcccaacntncnaanccttnccccattcntgcttcccttttgaaacttggcttctggggaaactcnngccagaagtncttgnggacaccanncctntttngggggntctcaaggncgttcccnttnggnctgtnncccaaagncnnaanngantcnngtngcntnnattnggaaggaattnctggntncctangttgnntnnattncnaaac

SEQ ID NO: 3045 - DNA, 774 bp, Homo sapiens
  misc_feature (1)...(774): n = A,T,C or G
cngtctaaaccnttggctacttgctctttntgcaggatcccatcgattcgaattcggcacgaggcaggagaatcacttgaaccctgnaggtggcggttgcagtgagcncagatcatgccactgcactccagcctgggcaacaaaacgagacttcgtctcaaaaaaaaaaaacntagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgtcaggaccacattttacaaaatgccttgtttccttcattgnttctggaaaaggaaagttctattaatattgntttactttgaatatagaatagtttttttaattagggcttattttgaaaaatctgagtttaattcaaatgtttgccaataccttccaaagtaaggtaatattcagagacagttgttgtgaacaagatggcttaaaagaaattcttggaatattcacattcnaaagattccttattaatgaatgtctttgccttaaaatctaaccaaaaaactgcacatttatcctttgggcatttttcattatatagnggtaacaagctttagntgccaaccaaattaaaatccttaagctttttaaaaaaaaaaaaaaaaaaactcgngccctttt

SEQ ID NO: 3046 - DNA, 779 bp, Homo sapiens
  misc_feature (1)...(779): n = A,T,C or G
cttnnnttgtnctntntctttcaaatcgctnggctacttgttctttttgcaggatcccatcgattcgggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctcttgagctacctcgactttggacagagtaatgactccccagaaaacgtcatataagaantttaccaacccctgaangaccaagaaggagccattcctttgaccttcatttaacttgggctcactttttctttaaaactttgggtagaaaatgcagagccccagaattgcttttccttcccgncttttgacatgaaggccttaagtaaaagaacttccngaacattaaaaaaa

SEQ ID NO: 3047 - DNA, 767 bp, Homo sapiens
  misc_feature (1)...(767): n = A,T,C or G
tnctttgatgccattgctcttgttctttntgcaggatcccatcgattcggcttgcctttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggccggatcacctgaggtcangagttcgagaccagcctaccaacatggtgaaaccccgtcttntactaaaattatnaaaaattagcccggtgtagtgggtccacgcctgtagtcccagttactttgggaagcttaagcattaagaattgctttgaacccaggaagttggangttggangtgaacccnaaatgtgccctgnacttcancctggaacagantgagacacttgtncncaaaaaaaaaaat

SEQ ID NO: 3048 - DNA, 770 bp, Homo sapiens
  misc_feature (1)...(770): n = A,T,C or G
ttngncgactnnanctntacannaatcctttggttacttgccngcaggatcccatcgattcgaattcggcacgaggcagggagttgcttgggtggccgctaacnccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttanatgtcacggaaaaagctagttctgtggtcaggcggcaccaatgagaaaggaatgcagacccttcagatgtatccttgggaaaagcagtaaaccaactaatatttattgaaggacctactttgtccttacatagggnancttctgtcagggaatcntgggttcttnccaagaaacactgattttctttcanggagacttcatggggtcatttatttccccacagcagaatttaagaaattattatatggaatattggatatctataaagagc

SEQ ID NO: 3049 - DNA, 765 bp, Homo sapiens
  misc_feature (1)...(765): n = A,T,C or G
gcngnctacngaaacccttggctactngntctttntgcaggatcccatcgattcgaattcggcacgagggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggaagggtttgctctccaaaaagaattgtaatatagagtagaattgggatagagtattgaagacactgggtttagacattggatattttaatgattgngtgttctaattcatgtgctgccactgagttatctagtgatatgacctcactgcttgaccaaaagcccggaatagaaggcaggattcctggaatctatcttaaaaatttgcaatggaanaaccttttccctaaattatcccattatggtaan

SEQ ID NO: 3050 - DNA, 815 bp, Homo sapiens
  misc_feature (1)...(815): n = A,T,C or G
gnnnnnnntttnaaacccttggctactngttctttttgcaggatcccatcgattcgaattcggcacgaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgnctcctatcagtccgtatgcttcagaaagctgtggaacgctacctcttnctttgagaccttgtggagaagggtctgaaatggtaggcaaagagaatagttccccagagaataaaaactggttgttggccatggcagccaaacngaangctgagaatccatctccacgaagtccgtcatcccagacacccaattccaggagacagagcggaaagacattgncaagcccggcaccatcacgcccagcttcatgaggaaaatctgcacatacttccatanaaagtcccaggangactttctgtggtcctgaacactcaaccagaattatangattctaatctgagttgagttactgagcttttggtcccacttaaaacaaagcttgaagcttntggtnccacttaaaaaccanggaatgaaaananttcccaagaagtnggacttcttnttaactncttgggncntttttangaaaangcttgcccntttttcaaattttttangccaaaaantcnttttttcaaacccctttgaaaatngccc

SEQ ID NO: 3051 - DNA, 716 bp, Homo sapiens
  misc_feature (1)...(716): n = A,T,C or G
gaanccctttggctactcgctctttntgcaggatcccatcgattcgcaaagatcagaagtcctggcaagaatcacanatggaaaaacnacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcngtctttcagggtcagagagtgagccagaagaaactcccatcaagactgaagcagacgttttggcngaaaaccangttcttgatagcagtgctcctaanagtccaagtcaagatgttaaagcaactgttagaaatttttcagaagccaagagtgagaaccgaaagaaaagctttgaaaaacaaaccctangaggaaanaagatttcacaactatcaaacgttattcgaaccangaacacaccatccatatctcttggaaatgcttctagcttccggacattcgacatgaaaagaaatgtgatttgcantgtggccggtncctcatcaaaaaagactttttggctggatctattctgcgaaagtaagatgttagctctggggttacttctactgaanntgtgaacattctcctntttgtngaggaa

SEQ ID NO: 3052 - DNA, 785 bp, Homo sapiens
  misc_feature (1)...(785): n = A,T,C or G
ggnnnnnnnnnnttgnngttnannncttttttncntncnnntttgaaaccctttggctacttgntctttttgcaggatcccatcgattcggccgccggggcgcaatgcgagcggctggngtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctganaaggtactgctgcatgcatttgatggtccggncatctgtagccatggaaggagtnagaanctgggtacttcttctcaatttccccttctatcataagaaatggacagcangaaacttgtgaaacaattgnctttacttctatatgcttagaaacagatcacctgactaggacnanaaaacaggtcc

SEQ ID NO: 3053 - DNA, 790 bp, Homo sapiens
  misc_feature (1)...(790): n = A,T,C or G
gtnnnnncantnattccccnnanaaaacctttggctacttgctctttttgcaggatcccatcgattcgaattcggcacgaggtttcacatttgctgccatgagcaaagangaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttctcaggactcagttaggtgtgcccagacgcactgacaaaatgacatgacttcagggaagcctggacacccgangcacctggaccaactatgggtaagttcttgtgggtggaacancattctgtgtaagaacccacttganggcnttttgcaaaccggaattgacaggnaaccccagaanattaaggcaccacaaaagtgcccccttgcatgaaaacaccttgtgaaccatttcnaantcttgaaatgccgggggggggaagtttcaattttttaagggaaagaaccaaaagcccctttnt

SEQ ID NO: 3054 - DNA, 770 bp, Homo sapiens
  misc_feature (1)...(770): n = A,T,C or G
gnntgntttnnnntctttgatcccttctttcaaatcntttggctacttgttctttttgcaggatcccatcgattcgaattcggcacgaggggtgttggagcagattntagttgatccacagcaaagagcatcaccaaagccattccaggaggaactagatccaccacttcctctgctgggcatgctccaaaaatggttgtggcttccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatcccccttccttaagggaataactagtgcaagctgactccaagcacatncaggaatgcacttactgataaagatattgangcaagttgtaccagcagctcctggggacgtgctcantggatggtnccaagcccctgcatttatctctttgngatagtntaaacccctgcacctggaactgtgatttttctgtactatctctgtaccctnaattttttttactttn

SEQ ID NO: 3055 - DNA, 784 bp, Homo sapiens
  misc_feature (1)...(784): n = A,T,C or G
tncttgaanccctttgctacttgttctttntgcaggatcccatcgattcgcgtctgtaatcccagctgcttgggaggctgaggcaggagantcacttgaaccctggaggtggcggttgcagtgagcacagatcatgccactgcactccagcctgggcaacaaaacgagacttcgtctcaaaaaaaaaaaccntagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgnttctggaaaggaaagttctattaatattgttttactttgaatatagaatagtttttttaattagggcttattttgaaaaattctgagtttaattcaaatgtatgccaataccttccaaagtaaggnaatattcagagacagttgttgtgatcagaatggcttagagaaatttctggaatattcacattcgaagattccctattaatgaaatgnctttgaccttaaaatttacccaaaaacttgcaaccattaattcntttggaccatttttcattatatagnggttaaacaagctttagttgccaaaccaaattaaaattccttaaagctaaaaaaaaaaaaaaant

SEQ ID NO: 3056 - DNA, 779 bp, Homo sapiens
  misc_feature (1)...(779): n = A,T,C or G
cgnttaaannccttcactcnntcgtttgaagncnnttggcgattcgaattcggcacgagataacacacatcacagtatgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcggtgaaataaaggcaagacgtaacaactggatgaaaaaaaaaannnnnnnaaaaaaaaaaactcgagccttttaaaactattagtgagtcgnattaccgtanatcccggacatggatangatncattgatgaagtttggaccaaacccccaacttggaatgcnntgnaaaaaaatgctttaatttggngaaatttggggatg

SEQ ID NO: 3057 - DNA, 754 bp, Homo sapiens
  misc_feature (1)...(754): n = A,T,C or G
ttancctataancgtctatgaagcctttgctattngncaatggatgcaggaaaactgagatgggatttccccacgttgcccaggctggtctcctgagctnaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctaccgcaacctccgcctcccgggttcaagtgattctcctgcctnagcctcccaggtagctgggattacaagcatgggccaccacgcctggctaatttgtatttttagtagagacggagtttctccatgttggtcaggctggtctcgaactaccgacctcaggtgatccacccacctcggcctccacagtgctgggattacaagcatgaaccaccgngcccggnctcctgttccagttttctataatctggtcatattatattctgggtatatgtgggtggtgtgattatccatgtggtcttattttcacattctttgcattaactataatgacttaatgttttaagataagtttcatttcttcaaaagatgtatgtncaatacctgggtatcaggtaacaatcttaaaaaaacttattcatttaaaaattaacctttaaaattagccattccaattnaacattaagganggttgngagga

SEQ ID NO: 3058 - DNA, 755 bp, Homo sapiens
  misc_feature (1)...(755): n = A,T,C or G
nttaanttntgatngtcnataaggcctttatcgattcgccaatggatgcaggaaaactgagatgggatttccccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctgggattacaagcatgggccaccacgcctggctaattttgtatttttagtagagacggagtttctccatgttggtcaggctggtctcgaactaccgacctcaggtgatccacccacctcggcctcccacagtgctgggattacaagcatgagccaccgcgcccggcctcctgttccagttttctataatctgttcatattatattctgggtatatgtgggtggtgtgattatccatgtggtcttattttcacattctttgcattaactataatgacttaatgtttaagataagtttcattctacaaagatgtatgtacaatacctggtatcaggtaacaatcttaaaaaaaactaattcatttaaaaataaacattaaaattagccaatccaattaaccntaaagacagtttgtganga

SEQ ID NO: 3059 - DNA, 755 bp, Homo sapiens; identical to SEQ ID NO: 3058
  misc_feature (1)...(755): n = A,T,C or G

SEQ ID NO: 3060 - DNA, 744 bp, Homo sapiens
  misc_feature (1)...(744): n = A,T,C or G
ctttnaatcccttgcactcgtcttntgnaggaccttatcgattcgaattcggcacgagataacacacatcacagtatgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaataccgtttcctgacacttggaggtttgccacaatcggtgaaataaaggcaagacgtaacactggatgaaaaaaaaaaannnnnnnaaaaaaactcgagcctntagaactatgtgatcgattcgtagatccagaatgatagatcattgtgagtttggacaaccacactngatgcagtgaaaaaatcttattgngaattgngatn

SEQ ID NO: 3061 - DNA, 744 bp, Homo sapiens; identical to SEQ ID NO: 3060
  misc_feature (1)...(744): n = A,T,C or G

SEQ ID NO: 3062 - DNA, 718 bp, Homo sapiens
  misc_feature (1)...(718): n = A,T,C or G
nttnnnnnataannttnatnagncttgcacttgctctttttgcaggatcccatcgattcgaattcggcacgagaaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcttcgggcataaggcccctgaccacacttcagaagccccatcccccctgcaccgggcgatccctgctgtnagccgaactntctgcccgctgccatgtgtcgtgtttggtgnagacctgatgtctgtntgtgtccaaacgggctcaagagcctcacaatctgggtagctgacccagtacgtgt

SEQ ID NO: 3063 - DNA, 779 bp, Homo sapiens; identical to SEQ ID NO: 3056
  misc_feature (1)...(779): n = A,T,C or G

SEQ ID NO: 3064 - DNA, 754 bp, Homo sapiens
  misc_feature (1)...(754): n = A,T,C or G
tnnnnnttnnatnttgcccttgnctntgaaggcttnctcgattcgaattcggcacgagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaaccttttttttttactgtttcattaagtgtgcttgtgcccaaaatatttacttgtataatatctgtacttgcttaaatacttcagcaaagtcagcatatttactcattcaacaaatatttgagccaggcattattttagacacagcagtgaacaaaacaaaaaggcattcttgccttcatggagcttacattcttattggtatttaaatctaaatgttataaaacaagaatttatattctagggttgatcagctagtatttaatcaaaaangccacactcccatagcagctctctaagctgtagtagctaataaaaaatattaatggtggccgggcacagtgctnacgcctattaatcccagcactttgggangccaaggtggtagatcacttgaggtcaaaagtgtgacccagcctggccaacctggtgaaccctatctctttaaaaaatccaaaaaatccaaaaaaattacttgggctg

SEQ ID NO: 3065 - DNA, 779 bp, Homo sapiens; identical to SEQ ID NO: 3056
  misc_feature (1)...(779): n = A,T,C or G

SEQ ID NO: 3066 - DNA, 748 bp, Homo sapiens
  misc_feature (1)...(748): n = A,T,C or G
gnttgaatccctnncanatcncttggntgcaggatcctatcgattcgaattcggcacgngannacacacatcacagtntgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcggtgaaataaaggcaagacgtaaccctggatgaaaaaaaaaannnnnnaanaaaaaaactcgagcctntaaactatagtgagtcgattcgtagatccagacatgatagatccttgatgagtttggacaaccacactngatgcatgnaaaaatcttattgngaattgggag

SEQ ID NO: 3067 - DNA, 748 bp, Homo sapiens; identical to SEQ ID NO: 3066
  misc_feature (1)...(748): n = A,T,C or G

SEQ ID NO: 3068 - DNA, 748 bp, Homo sapiens; identical to SEQ ID NO: 3066
  misc_feature (1)...(748): n = A,T,C or G

SEQ ID NO: 3069 - DNA, 756 bp, Homo sapiens
  misc_feature (1)...(756): n = A,T,C or G
ggnnnnnntcttttcnaatgcttggctctcgttctttntgcaggatccctcgattcgcaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatnacggaaggaagaataacggagaaggagataagagatcatatttcaaaagagactttgttctatatttgtggccaccttcaatgacagactttttctccaagcaactggaaaacaaccatgtcccaaagaacacatttgctttgagaagtggtggtaggaggcagacaaaggcagaaaaaattaagaggtgagatctactcaggagagctcaaaannaaaaaaaaaaaaactnggacctntagaactatagtgagtcgtnttccgtagatccagacatgataa

SEQ ID NO: 3070 - DNA, 788 bp, Homo sapiens
  misc_feature (1)...(788): n = A,T,C or G
gnnttnnaanttaacagctctcgtnctttttgcngatcccatnnattcgaattcggcacgagtgatgccttagtcacttggccacacagttttgtggtttacgagtcatgggaattgcttgtcttactctgactgctaaagttctgtcctattgtcttttcatgtaatagcaacatgactctgatgacaaagcccaactaattacacaacttaatttaatagtttaaagcgcaaagggcattccctgagcagtaaaatcttttgtttggaaattttaaaacaaattatattttactttatgttttatatttaccntaataagtatttacaagaacacaattttctcaagatttaaactgctcattgttccataaataggacacacatttagaaagaggatttttttttaaaggaatattttagtgattacttctggctaaaaacatgaaactcttttagtgcttgatgttactggaaacttgctctagattattttttgaatctttgctgngagggtaaaaatagaaatgttttcctcccaattattgctttgaattaaaattttgtgtctgggtgaaatttcctctggcttaatgcatgaccaggctggtagaaaatgtttcacctaaatcctcttatttttggtaaaacattcataatnccaaaccctaatagtttggnaaggcatgtgataattggtaatcccnctnctgtcctcantttataaattcccctgacaacagccctgcttaanaatatcacctacttctggttggatttcttnccgn

SEQ ID NO: 3071 - DNA, 744 bp, Homo sapiens; identical to SEQ ID NO: 3060
  misc_feature (1)...(744): n = A,T,C or G

SEQ ID NO: 3072 - DNA, 768 bp, Homo sapiens
  misc_feature (1)...(768): n = A,T,C or G
cactganctnctatccttcttcnttgcaggatccnatcgattcgaattcggcacgagatcctgtcggtattccttggtatctgantnaaataccaaatagtaccatacatgagttatttctaagtttgaaaagtaaaaagaaattgcatcacactaattacaaaatacaagttctggaaaaaatatttttcttcattttaaaacttttttaactaataatggctttgaaagaagaggcttaatttgggggtggtaactaaaatcaaaagaaatgattgacttgagggtctctgtttggtaagaatacatcattagcttaannntncngacaanngcntntgtaatgntgtaactgctgttaatattnantgctntngtntgagcnacctnantntgaacagatgngtcagcctgcatgctggacatgcctcanaaccatgaatagcccgnactagatcttgngaacatggatcttagagtcactttggaataagtncttatntnaatacccncagccttttgagaacggggcttgttaaaggacncgtatgtagggcccgtacctactgncagttgggttcangnaaatgggattgactttggncttaagntccttggtcataattttttaaaatatgggantnggaaaacccccaaagaatggaatggactcttnaaaacantgaaaagacccttatcggttgncccttggaatgtagaatttggnnttnggnttncttaattctgcttggtnaaaggggncagttn

SEQ ID NO: 3073 - DNA, 760 bp, Homo sapiens
  misc_feature (1)...(760): n = A,T,C or G
tcnctcctnaaatcgttggcgctctcttgcaggatccctcgattcgaattcggcacgagctctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagccttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacacccatgtccatcttttcattttctgctgaaagattttcagtggttcccacttgaatnccaaataaagttcgaatcccttanaatggcattcacagccttntacttctggncccacttttatnt

SEQ ID NO: 3074 - DNA, 771 bp, Homo sapiens
  misc_feature (1)...(771): n = A,T,C or G
ntttataantntnatnccttnctcttgntctttttgcaggatccctcgattcgaattcggcacgaggaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattacccttccacccacatggtggtgcagggatggcgaattccacttcccagcaacagaaatgtagagagtcctgttcgagttcattcaccgntggctcttccttaacgacaaggaaaatttgatccaccancagtgccttgcnacanggccanttnatgcgtatttcanaatgt

SEQ ID NO: 3075 - DNA, 751 bp, Homo sapiens
  misc_feature (1)...(751): n = A,T,C or G
atnngaaggaaacaatnntccttcgtgctctncntgcaggatcccatcgattcgggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgnttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagntaaaattaaatgtagttggaatagctagcattgcagctacagtagggaactgtagtctanttccctaccgaaaacccaaggagtaagggacaggattttgcctaggcaaaaatctaagactcgtgcccttctggtacatggggnttaagactgaatgtgtaataggagactgctttgccaatcaaatgatgacaggtactgaaatngcaatccatt

SEQ ID NO: 3076 - DNA, 793 bp, Homo sapiens
  misc_feature (1)...(793): n = A,T,C or G
ntnnnnngtctaataattcnnnttctttgcnctctccatgcaggatcccatcgattcgaattcggcacgaggagaggttcacagccaccaagaaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcaagttcaatcgcagttttatactaggaccttttaggatggtncataaaatgtgtggactgtttgnccttganttaaaagtgccacttttggccctggggcatggnnggcttcatgcctattaatcccagcacttttgggaaggnccaaggccggttggcttcactttgangctaaggaaattc

SEQ ID NO: 3077 - DNA, 763 bp, Homo sapiens
  misc_feature (1)...(763): n = A,T,C or G
nctcnantanctatngcttggttnctcgntctntctgcaggatcccatcgattcgttcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttaatatgtggaaagtcttctcttcccattcttttctcctaaaatcatatatactgnaatatatgctctctnactctattaccttcttacatctaccctttccanttangtttgctttttgcccaaaagataccaattccangtttggaagttg

SEQ ID NO: 3078 - DNA, 774 bp, Homo sapiens
  misc_feature (1)...(774): n = A,T,C or G
ntnnnnngtttgnctannaagnctttgctcttgntctttntgcaggatcccatcgattcgaattcggcacgagagagactagtctcgagttnntttnttttttttttcacaaataaaccaactttaatagatnttatttngtatttatatagtgccttcttcaagaaccttaaatgctttacagacattatctctaattaatccccacaacaaccctgtgaggtaggtattactcccattttacaagacaggganactgaagcacagagaggttaagtgacttgcccaaggtcacacagttaaattcactgaagagccaggacatgagcgctttagcntcccanntcccagccnaatacctcatgatagaatctttaataaaaagtgtttntaaagaaagtatcacgagtagttatgttatgaaaatgaggtctttntactgccatcaaggaaagaaaaaaccctatactgatggttagaggccccaagacccacataatacaacatttncctctttccctgttccnaagcntcctggttcctgtcttaaataatcttttaaaggtnaaatttccaagacagaagccatgtgacttaagaagtgggacttaattttagaatatttactttagttacataaatttataggaaatttttattcccatttncaaaatatgggacagccattccaacatcatgtcatagttacacggnaatcaagtccccanttacaacttacaccanccccgnattttaatcacagtcaaccaacnt

SEQ ID NO: 3079 - DNA, 754 bp, Homo sapiens; identical to SEQ ID NO: 3057
  misc_feature (1)...(754): n = A,T,C or G

SEQ ID NO: 3080 - DNA, 785 bp, Homo sapiens
  misc_feature (1)...(785): n = A,T,C or G
cnacnaattnacanntcacttnctnctngcnctnntngcatncgattcgaattcggcacgaggtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccancccttcatcgacttgcggcaaaggatcatggtcatcaaagccaaagggatggagcctatagaggtgcctcttgaggaaaatagtgaacggactcanattcgccaaagcacggtctgtgctgacagagtaagtacttatgattgtggagaaaaaatttcaagctggttgtcaacattttttgcccgtccttgtcatttgatcaaacaaagttcaaactctnaaaggaatgcaaagaagaaacatgggaaagatcaactttccttggtacaatgggccacccttttctctgtgaatgaangccncngtatctgnttgatcaacacattccagtatttttggaacttcaccgggnaacttnaaacacccattgatganaatgggaaanganggaattatttttacttgaaaggatcttnaccttgcgttttcgtgcccaatatttattancan

SEQ ID NO: 3081 - DNA, 812 bp, Homo sapiens
  misc_feature (1)...(812): n = A,T,C or G
cttatnnantactccgtctctaaagcctttntcngattcgaattcggcacgagggaaacagctgactgccactgaaagaatnagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaacaccagtctgaagcagtgcctcaggatctcagatgatttaggaagtgtgctgtaatgtcaaaaaaaaaaaagtattgtctttagtatatctatgtatagtctcgtgggaaaagcattggttgtggtatcaacagatattctgggttccagatgtcttgnaagttaacctgcctcccatttccctttctgtaaagccaaaataattggttttaccaccctaaatctggcctctcaagggattnccattntttaantnaaaaaattatggtcctantnaaagtgccaaaaaaaaaaannnnnnnaaaaaaaccttnggagnccctntttanaacctttttngtggaggtccgnatttacccttnnnaatncccggaacnttggattaaggt

SEQ ID NO: 3082 - DNA, 768 bp, Homo sapiens; identical to SEQ ID NO: 3072
  misc_feature (1)...(768): n = A,T,C or G

SEQ ID NO: 3083 - DNA, 781 bp, Homo sapiens
  misc_feature (1)...(781): n = A,T,C or G
tnnngnttaancccttctcttgccttttgcggatccctcgattcgaattcggcacgagccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtaggatattagacaaatatatttcgattgaattccacaactaaanaaaaaaaaaacttnnagcctnttagaacttttagggaggtcgnattacggtagatncanaccatggataaggatacattggatgaattttggacaaaccccaacnttggaatgccntggnaaaaaaatgctttttt

SEQ ID NO: 3084 - DNA, 787 bp, Homo sapiens
  misc_feature (1)...(787): n = A,T,C or G
gtntaannccnangccttgccatcttgcaggatcccatcgattcgaattcggcacgagagaacgttctcaggttgaccagctgctgtntatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccaggtttggcatagaaatggtaccccttgttcaaaatgaacaagaagccttagatttggatggggaacctgatctgtccagtctanaaggattccantgggaaggtgtttccatttcctcgtcccctggcttggcaagaaagcgaagcctttctgagagcagcgtgatcatggacagagctccttctgtgtatagcttcttcagtgaggaaggtacaggcaaanaaaatgagccccagcagatggttcacctagtaactcattgagggcttggacagagccagaaagcaacccattgcacctttaaaacaagaagtgacacctnggggcttgccctnccttcccgaacangtggaaaaggggcttgaaaatggtgcttccccaaanggcgacntagtncaccaattatcctctgancatattaatacctttgatngcattttggccaaaaagacttgaccagncaaggaanagggctattccccccc

SEQ ID NO: 3085 - DNA, 750 bp, Homo sapiens
  misc_feature (1)...(750): n = A,T,C or G
ngttaantanatccttgcactggcggatccctcgattcgaattcggcacgagatttaaagtattagccaacctcttcaggtattagcctgaagataaattttaacaaaacatatacacttgggtatccgtcattgctcaaactctatagtgtattgctggagccaataggcagggtatattttattagctaaatttgatatttgtcttctgccttctgtatcacctccaagctataggaaatcaggattttgttggctttaagaaaacacatggtatgttcactgtatattaaatatacctgtatttaatgttttctcttaggacagaaaagtagacacacacacacacacacacacacatgttgtgttcagctttctgttttatattatttgccattgagattagaatagaacaggctctattcatgcaaactatatgaaatgaaaaacttttaagactcttcattaattggagcttctgggcaacatcgtgtgtgtgtgtgtgtgtgtgtgtgtgtgtgtgtatacagacattttttttttaacttgntgattcanatgtcttggtccctgaatagtcctagattacttattttgagaattcattggtaaaattacagggaattaaaataattgccttttttttaganggtaaganatgggtagaagantatgcctntgnaaatttattagntattcttgtggagaatnccagaaaatgggtatttgcccatgctaaatatganatan

SEQ ID NO: 3086 - DNA, 954 bp, Homo sapiens
  misc_feature (1)...(954): n = A,T,C or G
tnnnnnnnccggnttctnnctcacgantntngcatgcatttganagcattnatcgattcgaattcggcacgagctgcgctatcagcgcaaagaacctcccgttagtgccactgaccccacctncccccagccccacagctgggtctggctgggcactgaccaggaggaactgagccgccagctggaccggcagtcccctggcccgcccaagggggaggggagctgcccctgtgagagtgggggangaggggaggcccctaccctggcccctggccctcctgggggcaccaccagctnctcaagcacnctggcccgaaaggaggctnntngggcggctnaagcgagtanagtttgtgacatttgcnccagccccttcagcccagnnacctgaggagcctgtaggggccccttgctgtgcagtaccatncttgtggcaggcgacgaggacatccgntgngtgtgtnaaggacatggngcttgaaggaccctgangaagcttcnnaaactacatngagaggatcccngggcaactttcttgacnctgcaananacaaccttggtcaagcccacncaacttggngcaaacgannnggtgngaagggtttcccaacttggagccctttttccgtccttgcccctcggnccantttcgtttttnggtagccttggtttggaattcccaagntcccccttggccttngngtnncntcncnnancaaanggggacntttaccnatttncnaagggcncncccnntntttgggcccnttggcccccnntttgggcccattggggaaaccaaatggggttcnnntnnaaangngnaaaaggggcctttcaattggccnccccntttaaaaatttnaaatggggggaaaacnccctttttatcntatttntcttaaacccngnaanatttaaaaacccnnnatnnaaaggggaaaaaaaaccccg

SEQ ID NO: 3087 - DNA, 789 bp, Homo sapiens
  misc_feature (1)...(789): n = A,T,C or G
tnncgnctaannttnatgccttngttnntncntccnttttgcaggatcccatcgattcgttagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacanaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaagggtatcccaggtctgctttctcccagaatcctatttgctgctttactgganggaatgatggggaagatcaccgtttgtggggatgccaaacagtggaagtttgaagaaaaaaccagaagaagtccccacaaaaccgtacccacagggaagaaaccctaaagganggacnttgcaccaaagcagggtgggaaaatcctnacgccttaagtnacccgatggagggaa

SEQ ID NO: 3088 - DNA, 767 bp, Homo sapiens
  misc_feature (1)...(767): n = A,T,C or G
tgnttnnngttnnntntnagccttgctctttgcttctgcaggatccctcgattcgaattcggcacgagggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacaganttggtatcaccttcttaaaagaagncaaaaatttaaaaaattccaatagccccgttggttggtgtcatattcaataacatttncaatgctacatataattttatagacttataaagaaggtnttgaaaaaaaaaaaannnnnnnnnnnnnnnnnngnnnn

SEQ ID NO: 3089 - DNA, 706 bp, Homo sapiens
  misc_feature (1)...(706): n = A,T,C or G
naatncttggctcttgttctttntgcaggatcccatcgattcgaattcggcacgagaatgcaaagggctgcagttctcattcaggctactttcaggatgcacagaacatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcacagtagtttctattcaaagaagatacagaaaactaactgcagtgcgtcccaagcagttatttgtatcagtcttattacagagctttaagtccaaagatatcaaatatgcacgggctgcacactaatcagtcttctatca

SEQ ID NO: 3090 - DNA, 763 bp, Homo sapiens; identical to SEQ ID NO: 3025
  misc_feature (1)...(763): n = A,T,C or G

SEQ ID NO: 3091 - DNA, 774 bp, Homo sapiens
  misc_feature (1)...(774): n = A,T,C or G
gnntttnntnccttttncttttcaaatncttggctacttnctntttctgcagggatcccatcgattcgaattcggcacgaggaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtangaagaacaangaaataagattattcagctgattgaagcaaaagcctctgcttattgtatttgccaagtcctggtttgtagaantggggatacttggtgctccagaagttanttttacatgcttntgggaaggcaagtttacccgatttncatggggaatngttctttcaantnccaccaaaggattgttgaaagccttattgaacttttgcaaggganttccttggcccacaatttganggaattattgaccttcctttg

SEQ ID NO: 3092 - DNA, 759 bp, Homo sapiens
  misc_feature (1)...(759): n = A,T,C or G
gnnnnnnnttnnntttccttttcnaatncttggctacttgnnctttctgcagggatcccatcgattcgaattcggcacgaggccatgtgaggacatagggagaaagcagccaccattggcaagccaagagagagccctcaccaggaacgattggaccagcaccttgatcttggattttctagcctccagaacttacagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatggggggatgtgaaaggaaatcaagaatcgattttgaaagtcttggaagagtgcaaaaaaatgtgtacaagagataatgcaaacaggattattaaagacaacatttgcaaccaaggaaaagccnagatttctgctttttgggaagaagantcctggatatgtcnaggntatattaccaggtatttttataaccatcagaccaaac

SEQ ID NO: 3093 - DNA, 738 bp, Homo sapiens
  misc_feature (1)...(738): n = A,T,C or G
tctaatgcttggctcttgntctttctgcaggatcccatcgattcgaattcggcacgagggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaacctgggcacccagaatgtgatatcctgaccaatggttttttgcaattctctcagccgaagaatctttcttgatgcccacagccagtattgtaatgggccataagttggatgacctttnttaacctttccagaatttcgagccctaccggaaaccggttttggat

SEQ ID NO: 3094 - DNA, 738 bp, Homo sapiens; identical to SEQ ID NO: 3093
  misc_feature (1)...(738): n = A,T,C or G

SEQ ID NO: 3095 - DNA, 787 bp, Homo sapiens
  misc_feature (1)...(787): n = A,T,C or G
ncttctaatncttggctatttctaatncttggctactttcaaatccttgggnantcgctctctctncatgatcccatcgnttcgaattcggcacgaggattgtgacatggtgtaataaaggtctacatggngtaataaaggtatacatggtgtaataaaggatgtgggagcacanatccataggaatttgacagtntaggaattgctttattattcangcccttcactctcagactaccctgctctatttgaataatgangcttgtggtggtctgtggaaaantngacanantagaatttggncagctgctgaangncacggnctctggaatgagtccacgtncccctanggacagtantnccaaattganacnnaaactttnagaaaaccaatgtnatggggccaagcaattgggnagctaggcccgacctnatnttttagngattttgaactcaatctttaanatcctgnaacagaangananaaagggtgnatattcgngnaatgacatncaagatctnactgcnctctnggctnctanngatggncgaaaaantgtgcncccaaggtttnncccctntatttaccaccttgcatccatgccatngtngaccttacanntgnncaaaaggcccttgcccnntgtganancattcccctggnanctttcccntaccngntgccctctttaantccttnattnaaaccctgggggtgaaaatcctganaaatntaanttaanaatctngntaccttttccntananaanaactaacctcnagcccn

SEQ ID NO: 3096 - DNA, 757 bp, Homo sapiens
  misc_feature (1)...(757): n = A,T,C or G
gntnnnttcnnttcctttcnaatncttggctactttcnntctctgnaggatcccatcgattcgaattcggcacgagggagatccagatattcttaggacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcanatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcanaaacgcangatatttccctttgctggctaaacagaagccctgggcacccagaatgtgatatcctgaccaatgtttttgcaattctctcagccgaaagaatctttctgatgccnacagccagtatttgtaatgggacatangttggatgaccttctttaaccctttccagaattncgagcctacnngaaaccaggtttttc

SEQ ID NO: 3097 - DNA, 794 bp, Homo sapiens
  misc_feature (1)...(794): n = A,T,C or G
gnttctaatgcttgggngntttcaaanncttggcnnntttcnaatgcttggctactngatctttntgcangatcccatcgattcgaatcggcacgaggagttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacattttcttcctataaaagagttttaaatgatggttaagttcttcaaggcagntncncaanggcctatttntnccccaaagggccccctgaacnnttngncccccatanaaactggaacccnccntttttgntantananccccntgggggaagtgnccnatttnnggggggttaaaaacccgggggggtggccaanaaaaacnacacnttntttttccnattcccanncnataangagaagg

SEQ ID NO: 3098 - DNA, 715 bp, Homo sapiens
  misc_feature (1)...(715): n = A,T,C or G
atgcttggctcttgntctttctgcaggatcccatcgattcgaattcggcacgagcttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtntgttttggtacctttgcaaatatttatgattatcacccccccacatactaaattgtttttaaaaggtttgnctttncttcagaatactaccccangc

SEQ ID NO: 3099 - DNA, 886 bp, Homo sapiens
  misc_feature (1)...(886): n = A,T,C or G
tnancttcaatgcttttccaaatncttggctctngttctttntgcaggatcccatcgattcgaattcggcacgagcagagctgtgatctgcccccaggtattctgacccccaaactggctctcaaccatgtttacatgatgaaaagaagaggtgactgttgtatcagctctaaaggcctcacttttggtgaaatgggacctaaatttgattgcatacttgattacttgctgtcaatactgaaattggcacttcataattttaatactattgaactttcaccataaccctgtcctataaagttgacttgcaaatgaagaaactctatctcttcaatattataaaatatatccaagagtcacaactagtgagaaaaggacaggatctaactaacaatgtgaggctgtgtcttcacaccaattcaacagagtatcttgtaaatgttgagaggagangtctttaggtcatggggtgtctttcaataaagtgctttagaaaacaggtgacaactggaattgggcccttggagggattgaatnggatttaagcccagggcaanttaaaattaggggaaaagcngaattccttcaaggaaccgggattttaaaaacccagcnttggagnaagaaaagttggaaaaatggagcccaagttggntaaaggaacnaattggaatancctgggncccattggggatttttttaagaaaaaagtggtttnaaaaattgggaaanttgaaatttggggnaattnaaaancctttgggaaaaagaaattggnccctgggggggnccccaaggcctttnntttngaaaaagggccnttnggggttttnggccttttaanaaattaaaaggtcccaaaaattggnccncnntttngaaccna

SEQ ID NO: 3100 - DNA, 886 bp, Homo sapiens; identical to SEQ ID NO: 3099
  misc_feature (1)...(886): n = A,T,C or G

SEQ ID NO: 3101 - DNA, 738 bp, Homo sapiens
  misc_feature (1)...(738): n = A,T,C or G
tnancttnaancctttcaattncttgctctgnnttnagccgatccctcgttcggagacatcatgtcaacagaaatggagatgtgcactggggaaactgccggccgggccgctggcccgtggacgcctgggaggtggccaaggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgtttgcctgaagagctctcaaatcgactgggaatggtgaangaatttctgagaaacatgaaggatcttagaaatgggctttacngaagatatgccagaaactngacagcctttgtcttccttcaaaaactggattcacaaggaacctgggagacaaacnt

SEQ ID NO: 3102 - DNA, 738 bp, Homo sapiens
  misc_feature (1)...(738): n = A,T,C or G
gnttctaatgcttttccaaatacntgctcttgttctttttgcaggatcccatcgattcgaattcggcacgagattttgctggacactcagacacaatttagagtatttatatataacttgaaaacagtaacatttccaaaaaccgatgaaccccaccctgtcccaaggaatgattggtatgtatgtgaagttcattttctgacaaaaataattacgttccacttaggatgcacaaccatgctgtcctgtagagaagtcacaagttttgtgagaatttttaaactgatgatgtttatttccatggtaacatgagtatacattttaccttctattgtagtgatgaatcacaattagtctttttttataggttggtggaaaagtaattgctgttttgccattgcttttaatggcaaccacaactacttttgcaccaacctaatatttattaagactttacttttttgagaccaatttctgaaattgggattcatgttgagagtctctaaggtccctgataatttgtcgcatttgttgntgntttttggagaatatttcatcactactcaaatgatggtcctctggtctggtggaagcttcgtaagctttgaaagccagataaccagggtttcagacaagtctagagccangtcaggatatcaataagacccacaggatgtagggcttgcctgctanggagacatttagcttatcttcccggcaaaaaaggcttgtnccccc

SEQ ID NO: 3103 - DNA, 737 bp, Homo sapiens
  misc_feature (1)...(737): n = A,T,C or G
gnttnaancccttttgaaatncntgctcttgntctttttgcaggatcccatcgattcgaattcggcacgagagaaaaacaacagagagaaaaagaatacctgagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaagaaaagctgttcaagttataaaatatataatctggaaagaaatactgtctcatataataattagattgtaatcattgntttaatctctgtctgggaaccaagattgaaagctgacttacttctctcttctgncttgtgaaccatacggagcctattattttaaaatatgatcagacaagtaaggcttctcttactttgctctgctctgatcagaagagctcatgtgaagtctttgagattctcttaattatcatcttctnaaactgggttttgagcttgacagtnctgaaaaagt

SEQ ID NO: 3104 - DNA, 757 bp, Homo sapiens; identical to SEQ ID NO: 3096
  misc_feature (1)...(757): n = A,T,C or G

SEQ ID NO: 3105 - DNA, 749 bp, Homo sapiens
  misc_feature (1)...(749): n = A,T,C or G
ttcaaatcncttgctactttcnaatcgcttggctactcgntctttctgcaggatcccatcgatgtcggaattcggcacgagangtgtnccnactgtgccctctgctngncnctgctccnaactntaacncanttgcntttggtgnacangtcacctgcgtgtttaaaatntccttttgtaatgtatcgngaatgtgccgagaacatatgaaantggntgncaatgganatggaangggctttattctcacttaanagagccctgggaggaataaggttttatctggatcaggtatccaattgcattggataaacgtggcctgaggcatgataaaatntnanaacacaataataagcctcctggngacatctctgnnccttttatagtccctcanctggcttgtttgcanggtgcangatgggtgaccacctgacgtgcttatgtggtcagtaagttatctgaatanggtctntctanaccccctagaatttgtggagctnggttgcatcataggaaatgcaagctgtgctggngttcacaagctaggagaggagaatgggttggatgtgcacctggctctgcaggaagcccatcttaggttannncctgaaggataaagaanctggccactggaatggttgggaaaaggctntnngancttcccatgcccaaccttggncctttttngggtatnatngtgcccngnccttgaacngcttttttaantctgacaaanatacaggganttt

SEQ ID NO: 3106 - DNA, 726 bp, Homo sapiens
  misc_feature (1)...(726): n = A,T,C or G
tgagttcaatgttggcnttgcnaatnctgnctgtnccncnnttgcgggttaaccagnctnncgattgaggantaaaggtcatngatggtcagaanctgantgacgttnggaatccaccccgttnattgtagaactgggggttcagagggcaggtgcctcagagttgaggccacacagtgaggtctggtgggtgaaaggacccaggaacgaggcgttcangaaagcaggttgtcagagctatgtggagtctgtgggtggcangggcagccgctccagcctttgaagactttgaaagccacagattcctggcgcaggcttggacttnctgggagctcctccaagtacccannggcatcananctgcctgggtgttacatggcccanngaacccatgttcanggtaggacatgcatnaccagatacccaatgtgcanagtgaanacactgggctccctgttaaacgatgaagaattcangacagtgacagcattacntnacccctggggacaagaggtcagcctaaggtgacacacggttgactactgtgcttcggaggctccctgtgtcctggnngaagaaaagcattnnagggggcagctggaccangctcccaactgcagaagttccagccctggcttgggcaagggccccggncttggnactcacnattnnctgatatgccttaagnaattcattctggtttgnacaatttntttttttaaaaan

SEQ ID NO: 3107 - DNA, 907 bp, Homo sapiens
  misc_feature (1)...(907): n = A,T,C or G
gttnaatcnttggcatttnnanatcgctngncganccgatcgattngaannnggcacgaggcagctgaaagangatctgtccagcntcatcctcctatcagaggaggacctccagatgcttgttgacgctccctgctcagacctggctcaggaactacgtcanagttgtgccaccgtccagcggctgcagnacacactncaacaggtgcttgaccaaananaggaantgcgtcagtccaagcagctcctgcagctgtacctccaggctttgganaaagagggcaatnctctngtcaaagcangaagagtccaaagctgcctttggtgaggaggnggatgcantagacacngggnatcagcatgagagacctgctaagacgttgcgcttggcngagccncatccttactgcacttgnagggagaagcaggctncanaagctgtngcttatctaatacaggnattncggagttgggttacccaaaggnannacccccaaaancacttgncttgtatggncttggaacctggggacantnaaagaatnaccgggacacctggttcanagnaangcccttgtnagtcagtttanccttnggnancttgcnnactntgccaattaaannaacnnccnataancctttggcaannttcntccctttccngntaaggncaatatttnnanaccanaggcccaaagggnnccccttcaacccaaancctttggggttggaaccncttgggcnaanaaaaatncccctttaaagtcncgatntgnccccaaggnaaccgggggaattctccccanantatttngtccnntacnnannatctnnggttaaactntgnacgccccanaaggggaaaantcttctnttttgngggctccnaanttntatgggttaannn

SEQ ID NO: 3108 - DNA, 715 bp, Homo sapiens
  misc_feature (1)...(715): n = A,T,C or G
tcttnnntnggctattngatctctntgcaggatccctcgattcggaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttggcatctgtttagaaactagcctataaaata

SEQ ID NO: 3109 - DNA, 715 bp, Homo sapiens; identical to SEQ ID NO: 3108
  misc_feature (1)...(715): n = A,T,C or G

SEQ ID NO: 3110 - DNA, 730 bp, Homo sapiens
  misc_feature (1)...(730): n = A,T,C or G
tttnaatcncttggctactcgntctttctgcaggatccctcgattcgaattcggcacgaggtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaattnctgcaactggcanaatctaatacagtgagaggaatagaaacctgtggaatactctgtggaaaactgacacataatgaatttactattacccatgtaattgtgccaaagcagtctgcgggaccagactattgtgacatgganaatgttnaggaattattcaatgttcaggatcaacatgatctcctcacttctagggatggatccatacacatcctactcaaactgcatttttatccanccgttgatctttacactcactgnnccttatcaacttatgttgccaagaagccnattggccatttnttggctcaccaaaagcntaaagacactggccttcttangcttaccaatgcttggnttgcttgn

SEQ ID NO: 3111 - DNA, 787 bp, Homo sapiens; identical to SEQ ID NO: 3095
  misc_feature (1)...(787): n = A,T,C or G

SEQ ID NO: 3112 - DNA, 746 bp, Homo sapiens
  misc_feature (1)...(746): n = A,T,C or G
nttntnnccttnnnccanactnaacnctttgcacttnctctttntgcaggatcccatcgattcgaattcggcacgagatttgtaccaactgtaccatctgcttgttnctgctccaaacttttacccacttgcttttggtaaagaggtcacctgcgtatttaaaatatccttttgtaatgnatttgggaaagtgccaagaacntntnnaaatgggtggnaattgaaattgaaagggcntttaattttcnttaanaaanaccctnggaggnganataagggttttatctggnatcagggtntccaatggcattgntatanacgtggcnctggggcagggataaaatttaaaaaacncaatantaagcctcctggtgacatctctgcccttttatagtccctnatctggcttgtttgcagggngcaagatgggtnaccacctgacgtncttatgtggtcannatgttatcaaaaggggnttttctctangaccccctanaatttgtggagctgggttgtatcataggaaaatgcaagctgtgctggtgtacacagctagagagganaatgggttggatgnncacctgctntgcangangccnatctcagttattgctgangataaaaagctngccttggaatggaanggaaaggctnnangaacttcccatgcnacctggccctttttgggtatggncggtgnccaaaacctgancttgttnttaccccngacaaaggngggnggtttt

SEQ ID NO: 3113 - DNA, 755 bp, Homo sapiens
  misc_feature (1)...(755): n = A,T,C or G
gnttnnnccttttcantncttggctctcgnctttntgcaggatccctcgattcgaattcggcacgaggtctagtataatcttgatgctcaaaccagataaggacaatacaagaaaggaagagtataggctaattctacccaataactaaatgaagtattagcaaaccagattcatcaataatcttttaaaaatcaagaattaattggatttaggaatataacactgtgtataacaagtttaagagaaatatatgagaatgataagactgcaattgaaagtagaggctttctctggagggaaaggtgaggaggatgtgatttggaagaacagcatggggaggcatcagttgtattgtaatgtttattttttaagctgaatgataggtacgtagatgttcattgtgttctttttgcctttttgtatatcttaaatatatggtagtgccatgattagcaggcttaatagccttgtgagtttaaatgtcactttcaaatgctgtatttttggtggagttgcttaaacacattccccttggnatctatacaaccagttaaaaaaaatcatgtatanaccacccattgaaaatataatggaaatgtactgnatatgccattttcatgaaatggttgtgtcaaaggggcttnttaggaaaaaaaaagatcgtttaactctttttgcatttaagtggaaaataaggtgggctttnggaaatagtttcaacccttgcttaaccagttttttttttcatgcttnn

SEQ ID NO: 3114 - DNA, 749 bp, Homo sapiens; identical to SEQ ID NO: 3105
  misc_feature (1)...(749): n = A,T,C or G

SEQ ID NO: 3115 - DNA, 744 bp, Homo sapiens
  misc_feature (1)...(744): n = A,T,C or G
ttnaancctttccccctttcaaatnncttggctactngntctttctgcaggatcccatcgattcgaattcggcacgagaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggtttgcagtgagcccgagattatgccactgtactccanccgtgggtgacagaatgagactctgtctcaaattaaaaaaaataaaaaaataattttttttttttaaaagtacccctttgntggctggggcacggcgactnacgcctgtaatnccagcacattggggaggccaaggcagggcagatcaccaaggttagggagttccanaccagccttggccaacatgggngaaacccctgcntttactggaaaann

SEQ ID NO: 3116 - DNA, 765 bp, Homo sapiens
  misc_feature (1)...(765): n = A,T,C or G
caatgcttgtnntttnaanccttgnccctttcaaatccttggctacttgttctttttgcagggatcccatcgattcgaattcggcacgagacaaggtgctggcagtgaagtgggggcagactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctacaggtgacagttgttggtgtccagttggatatgtaccatgaagggaagaagcagtcagagtgggcaccaagctttctagcctggaggactgaatggttctgtgcacatttcagatggaaagaatagaggcccacagaaagttaatgagatgcattttatacataccagttttgaattttaaggacctgtggggtagatatccaagatggctattcccagtaatttgtatttatatcttgctacatcgcagaaaggatttgaagcttgctaacacacataagatataagaattaaaataggctggaccntgggaacctcacacctgtaatnccagcatttttggggaaggccnaagccgggttggatcactttgaaggtcaagaantttccagaccaccctggccaacattggtnaaaacccccattccttattaaaaacttccaaaaattancaaaggtgtggtggtnccttncctntaatcca

SEQ ID NO: 3117 - DNA, 830 bp, Homo sapiens
  misc_feature (1)...(830): n = A,T,C or G
gcttcaatgcttttcatttcaaatncttggctctttcaaatccttggnacncgatcnctttgcaggancccancagcnnnnntgcggaacnggcttaaccagttcgggacttacagnangctaccaatggnnnntggcccnncgangatanggatctgcgccacatggaggttttgggncgggancttnaacgctacctgcnacnnatnttggntggnntccntgtnnacnannttgtncttntgccaangggcactcantnatgcctatactatnnngcnnacancataacgnnnnnctcncnnnatgncttncacattncncaatcattntgcntacagtatnatgcatgatangcaagtagtcactgcntagtgagatanggacnggatctnccntacaatgtnangctgaanntnnacacnnatgcnacanactancntggnaatgggtataggacangtnnnttagntcatgnntgactatgnannagtgcnntngngannatgngatanntgancnnnncttgaagnttnaatggatgnatccagcnnatngnaatnngnnaancctcntactacaagactganataaatgnanttttgacgataatgctnaataatgnatctaanatgnaanttaccatgttggnaaacttgggcccatgngcanaatttnanaaaaggttttggaaaattggaaatggattgngtagcaattaaagcttttntacccctangngcccnntgacctcncnngggnattganatnaantgnnttccggaatttggcctctgantattttngcttataaatccnnnttgncgacn

SEQ ID NO: 3118 - DNA, 738 bp, Homo sapiens
  misc_feature (1)...(738): n = A,T,C or G
tttcaaatngcttggctactngttctttttgcaggatcccatcgattcgaattcggcacgaggcctggaccgctcattcggactcgtcgggcagagcttttgtgctgncttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcattcagatccaacagttaaaacagatcgactgtggcaccgacaagtatactttgaggaaaatcgatgattncttcgtttatgaacgatggatcaagtctangaaaggtccttttgataggaaaatcaattaaatttcttgcccaaggtttggccatgatcagacttcccacnttcaaaaganggatnagcttggtgaaccaanttcttgcagangtcaccccaaggaatgcttgnaanacctntttcccananctttggnaaat

SEQ ID NO: 3119 - DNA, 794 bp, Homo sapiens; identical to SEQ ID NO: 3097
  misc_feature (1)...(794): n = A,T,C or G

SEQ ID NO: 3120 - DNA, 746 bp, Homo sapiens; identical to SEQ ID NO: 3112
  misc_feature (1)...(746): n = A,T,C or G

SEQ ID NO: 3121 - DNA, 773 bp, Homo sapiens
  misc_feature (1)...(773): n = A,T,C or G
gcccctttcattcaaatccttggctactcgttctttntgcaggatcccatcgattcgaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgccttcaccatccctaatatcttctaatnggtatcatataatgacccactcttcttatgntatcccaaacagttattgtggcatttaataatggaatgtncatgggaattttcccactggccttacctttctgnccttggggaagcttaaactctggaatcttctcaatctgtaaaatggggaattaaaagtatctacctaactgagttgggaatgnanntgaaaagaaaggccattttttntaaatcttggaatttagccaagcccacntccgattttatggccctttcccatngccctggantgnnn

SEQ ID NO: 3122 - DNA, 775 bp, Homo sapiens
  misc_feature (1)...(775): n = A,T,C or G
nctctttgacctcnnttggctactngttctttntgcaggatcccatcgattcggtcagatggtagaaaatgaaataattaaatagataccatttgagttctgggagccaggtgaagaagtgtttgtttgtttttgagacggagtctcactctgttacccaggttggagtgcagtggcctgatcttggcgcactgcaacctccgccttctgggctcaagtgattctcctgctccagcctcctgagtagctggggctacagacgtgtaccaccacacctggctactttttgtatttttagcagagaggggatttcgccatgttggtcaggctggttttgaactcctgacctcaggtgatctgcccaccttggcctctcaaagtgctgggattacaagcgtgagccactgtgcccggccagaaggagtgttttgagaatggctaagagaagataggttgaatagctatgcctacatgtcactaattaacatctcagagatctctgctacaggttgtccgtcctcattttgtctaatatttttccaatggcatgagtataggaagataaacggggaatgttttgaagtaataaaaaaattccattcataaagaagaacaacatgtattaagctttgtgcaccaaacaacacaaacagggaagacacataaggcaanaagcttttagnaaaaaaannntncntnnnnannntaataaaaaactnnggncctttngaactntaggngagnccgnntttaccgtanaatccaganctgaata

SEQ ID NO: 3123 - DNA, 775 bp, Homo sapiens; identical to SEQ ID NO: 3122
  misc_feature (1)...(775): n = A,T,C or G

SEQ ID NO: 3124 - DNA, 820 bp, Homo sapiens
  misc_feature (1)...(820): n = A,T,C or G
tcccnagantccatncgtttggcnactcgttctttntgcaggatcccatcgattcgaattcggcacgagtgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtncatcctggtgctattgtgtttgctatattancagcaatgtcaatacaaggttcagcaaatctgcaaacccagtggaatattgtaggggaagttcagcaatttgccccaagaagaacttatagaatggatcaaatatagtactaaaccagatgcagtgtttgcnggtgccatgcccacgatggcaagtgttaagctctctgcacttcggcccattgtgaatcatccacattatgaagacgcatgcttganagcccnaacaaaaaatangttttactnaaatgtatangtacgggaaaggcacnccganggaaagtgaaaacgaggaactngattaaagttnaaaaggtggaacttattancattncctatanaantagttcatgggtgtgntaaanaaaggatccnaagcccctggtttgcangtttgccctggaaantttgggggatgttnggaagaanacctngcccaaatggcttggggcaaaaacnttccct

SEQ ID NO: 3125 - DNA, 776 bp, Homo sapiens
  misc_feature (1)...(776): n = A,T,C or G
ntcctctnttgccttcgnttggcnacttgntctttttgcaggatcccatcgattcggttgagcaatatgaatataatgccaagtactgataaaatacggaattcatttagaatcaacataggtagacagactgtttttagtaaggttttgttttttggtgaataccatgtttgggctgtcagacttacttttcccctgagatccatattttgtacatgacataccagatatatgcaatatgaaacggaaacagtttttcaatctaatatccaggagtttgtgttaatatcttgtgaacttgtggctcttggtatctggcattgataaggctgtctactaatcctagagaaagggaagtagactccgttttaaagtctagtccagtcttattctttagttcatagaaatggtctaagttaatgatagactccgcacttatgttcagaaagcatcatcattacagctttgttgaagggacttctgagtaangattatgtttgcgtctcctgttggtggaaggcccatgaagcgtaatttcctnctcaccatgggcttctttattattgntgagtttttcatactcanggatgtgaattcaaccttgggtgttccagttcagagaaaatatttcatgaaaggatgaagtgttggttcaattctaggaccagnattgagtggcattatattccagangtccttatgggaaatgctgggatttattgagtnggtttnncaggncattttcgncccntttgccctgggactaactaanacan

SEQ ID NO: 3126 - DNA, 813 bp, Homo sapiens
  misc_feature (1)...(813): n = A,T,C or G
gcctccttctttcaaaacncttggctactngttctttttgcaggatcccatcgattcgaattcggcacgaggccacacgggccgcatcatncctgcaatctggttccgctacgacctcagccccatcacggtcaagtacacagagagacggnagcccgntgtacagattcatcaccacgatctgtgccatcattggcgggaccttnaccgncgccggcatnctggactcatgcatcttcacagcctntgaggcctggaagaagatccagctgggcaagatgcattgacgccacacccagcctaatggccgangaccctgggcatcgccagccttgcctccagtgccctgtntnctttggccctcaatctggncccaaatctggctgtgtcccaaagggtgtgtgggaagtggggggaaagtanaggatggctcgatgttttgcagctacctcttttncccgtgttnctttttagacaaattacactgcctgaagttgcanttcccctttncctggggagcccnaagaacagagtcnnggcanggggtggggagtccagggatcttgggggacccctcctaaggagaagcttgcagtctcttccntaaggggaacatcccagaatgcattatcgantcagcttnttaagcccaggctttanacaaattcttnnnagnnccccaattagggtnggacaccatttaaatgaatttgggtttacttccccctggggcaagnccaanccttgcccccanaaggctacncanaaaccttgggggcttttaagccttttggggacccaggnttggcnnnt

SEQ ID NO: 3127 - DNA, 739 bp, Homo sapiens
  misc_feature (1)...(739): n = A,T,C or G
gnnttnnnnnnttttcaantnnnggctctgntcttttgcaggatccctcgattcgaattcggcacgagcctagtcccagagtcctggagcggcatactgggggtggctgtgcagtcccagcatccccaacccagcatgtatagagagcatccatccttacatccagctgacccatgcccatgctcctccctgtggctggaggttcaacaataacataagtctcttctttgccctccagatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtacccgaggctcgctgacacagagaaaccccaacgcgaggaaaggaatggccagccacaccttcgcgaaacctgtggtggcccaccagtcctaacgggacaggacagagagacagagcagccctgcactggtttcccttcaccacagccatcctgtcccttcattggctctgggctttccactatacacagtcaccgtccaatgagaaacaagaaggagcacccttcacatngactccaactgcaagttggacagcgacattcaatcctgnactggttaactggggttactggatgactcctggttgcccaccatnctttttgactggga

SEQ ID NO: 3128 - DNA, 782 bp, Homo sapiens
  misc_feature (1)...(782): n = A,T,C or G
ntgcttcctctncnnaaccctttggnaactncctctttntgcaggatcccatcgattcgaaaatattttagtataagcaattggctgtgatgctcaaatttattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgnattttttattttccaatactgcatccatggcctggcagtgttacctcatgatgtcataatntgctgagagaagcaaattttctttcttttctgaatcccacaaagcctagcaccaaacttccttttttcttcctttaattaagatcataaataaaatgatcctgggggaaaaangcatctgtcaaaatagggaaaacattcccaaaactggagccactcttcttgtgcacctaanccatagcttggtgaccaaacaagatnggttgcttcaaggn

SEQ ID NO: 3129 - DNA, 1407 bp, Homo sapiens
  misc_feature (1)...(1407): n = A,T,C or G
acnnnacnnngnaagnnacnngaanannngnaanngacnaanngnanagngnaananaaggngggggngagaccnccagnnggngnccannaaccccntgggnaaanngccnananngcaggaacccancgnangnaaannnggnanngaggcagagnacccgcaggaancnnnaacanngannacaggcaggaaacnnacaaaaaggagganngngaaaacaaanacanacagngaggccaaagnaaaaaacatcagnanncgcnnanacagnncangnannccaaggaanaanaagggaagganaaacaagnngnnnaaaagaacaaaggagngaangccananangcnnagcnaannnaaacaaanacggggganaaggcganaancnacngnannanngcaannagaangaannanacgnnngacggcgannagnanggacagcgnagannnnannnnnnnaggannnnagnacanagnnnacgancggcacananggcggananagnnngancacangacacaanacanacacgancaggcnnngannanacacggaagcaaagnagaagngcagaaaganannagaancancnccgagaggcanagncacagnagnnanngcanagnncnannagnanagnaanagcgacagagnnncgaagcngagnaacacacaangaaancagannacgagnagacggangaaagggaagacaaagagagaggnangaaangaaagaaacagagagngcagaagacncnngagagaagagagacagnagnangagancncgcnnacngananganaagacanagaaanagagngcgnagagacnanagggagcgaacgcaganangagaanagacngaanaaagaggagcaaannnnagnnngaannncacgaggacagancncaacaagnncnnaggcanacgaaaananacaggacgaggangnnacanagcgcgannagncncanngnagcgcgaacgaggannanagagaacagcganagagannggaagggcagacanaggnaaaaggggganacacacgagangcgacacagganaanngcgaggacggacngggnggggagagaaaacgngcgancnggnaaggagaagnannaaggagaggannagacgacgcnagananangnagnanngaaagcacanngacggaacangnngcacgagcaggcanacnaaanaaganggnangaaggaanagannncaagngangaaacngaaagaggnaaagncncgangagngnaccagacgcagaannngnagcacaagagaacngagagagancganaggagaagggagnganaganaagaagaaaagcgggnaacaaaaaacangncncccnnagacaaagngggnggcgng

SEQ ID NO: 3130 - DNA, 876 bp, Homo sapiens
  misc_feature (1)...(876): n = A,T,C or G
gtcccctttcnntnaatccctttgggtctttctgcaggatccctcgattcgaattcggcacgagatacaaatactacgttggacgcaaggctatgtttgacagcgattttaagcaagatgctggttatgttgacataggaaatggagattaggacaacatttagttcagcgactgacttcatgacctacacatnccgcatggagatgacttagaagcaggggatatgcccttggacctggtgtcaaagctctcgtttaaacagcctcgtgcagtgtgtcgctaccacaagagctcctgtttaaacagcctcgcacggcgtgtcgcttgccacacctgacactattggattagtttacgttgctgangagtacctgtcatttgcctttgagcattgtcacccgtnntaggtccgaannaaccaaaatgggttggatnctnggacccttntttggctttccngtnaaaaaatggctttttggggntcanaattgcccnncttgggggggangctttncntgaaaaaaaggtttntnccctnngntgccnaantttttggccggaaantttaccccnanncccttttaaacccaangggcnaaacctnnnttgnttgntttcaaacaaaggcccctttggnaaaaaccccggnnggncntttttttaaattnccttgggnggannttttcctcantccnnggaaaaacctttaaaantnnttccccttananggaacccttttnnaaaaaaaagnggttttcctttaccngaaanccccnccgattttttttggnatnnttnatagggttccctnnaaattcnancccgntnnnntgcccnttnaantnnaatcanntttaacnttnncnnnnnaatcc

SEQ ID NO: 3131 - DNA, 1195 bp, Homo sapiens
  misc_feature (1)...(1195): n = A,T,C or G
nnnngggnnnnnnnnnnnnnnnnggggggggggggnngganngnggnngnngnnnngnngnnngnnannnnnnngnngnggcgtttccnctttnctangntgnaaaaaaaacccggtttttggggngaaaaanngccccnaggccnaggggaatncccncaanncgggnaannngcgggnaaaannncggggcnnacggagggggnganagaagnnngnnaaggggagnngggnggcngcgggnnnaggcgatagggaaaaggngaangaggngcnnggggggganngagggnnnggangaccggangnganggaggcngngcagngggannnacggagnggggcangnngancgangaaggcgnagngaggaaanaaaaccngggaganggnngctgnagnaannnggnnnaggatgggaggaaaaancatanaaaanaggngccngnaggagagaatngnccccngnggangggnngggnacggggnaangnnnangnnagngnggggnngaagcggnggaannnagngggnaagngngnnngngagggggngcgnaggagagnggnggngnggngggagganaangnncngganccngagnnggggaggaagagnggngggganngnnnggangangnggnngnngggannggggnganaggngnnnnngggngnnatcaggcnggggagagganggaagcnggcggnncgnggngangagcaggcngngaggnnncnngnagagcgagngnnnngcnancggnnnagagnggagtcnnagngngganggngcgagnnnagngcnnngaggngnangngnagagnggngnnnnnnagngngcnangnncnnnggnggnagcntgngcnngngggaaggangnngngnngaggnnaagnnaggnngnggngagngcggnagngggcggacagncggggnggnnngagnnganangnagngnggggnngangaggngcgngantgnncganggcgcngncgggggagagnaganngnnggggngaggngngcngnnnanggnnggacggaggagnnggnnnaggnggggaggnngancgangnggnnanacggcgnggngngganggnngacnngagnggagggnngaggagagnggangggggggngngcnnggnaggggnaggngcgagnagncnacanganggggagngcg

SEQ ID NO: 3132 - DNA, 1195 bp, Homo sapiens; identical to SEQ ID NO: 3131
  misc_feature (1)...(1195): n = A,T,C or G

SEQ ID NO: 3133 - DNA, 791 bp, Homo sapiens
  misc_feature (1)...(791): n = A,T,C or G
tgcctctttntgccttttgtaannnccnctttttgcaggatcccatcgattcggattagtangatttncangaaaaataaccaccgggtggggantaangngcccaaantcnngtcctaaatgcncagctttatgtnccctgtccaccatctngngcctcttctccattngcctcttccttcctatttcccttccgctaaggaaaaaaatnggggtcncattngtaaaagtaattttaatagttaatcatctctgagagtaacctgtattttaatngttgaancttaaccaaantaagatnctgtctnagctagggcttgtcatttgtgtatttagtgttaagataggaatgctagtgtctctttaattaattggaaatagatggaggctaaaaatgaaggtttttctttgaaactgaattaacttgggaatatttgttgttaaaacttctttttgcccaaaataactcattttgnattatctgaaaatatataatttctggcatgtgtatgttaaaatagaaaattttgaggaaaaatggaaatagggtggaaaagtactcggtaaacagtagtaaccaaatattttcactccagatttgngttttctcttggcaccagagtagatcttttgggaaaatatattatgaaaagtnggattaaagtttggactacccttatggttagcccccatctgggatgagaacnggttaccaaaggagtttngggcctcttaaggtggatttggtnccccagtggggtcaactttttgcnaaaattnccgnaatgggg

SEQ ID NO: 3134 - DNA, 781 bp, Homo sapiens
  misc_feature (1)...(781): n = A,T,C or G
ncctttcaaacgcttgctcttgttctttntgcaggatccctcgattcgaattcggcacgaggtgaacacccgctgatcctttaacaaggatttctggcaggaaactcacaaaanggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacnngncantcntggttggantggattcnnnatntnntnncanttnnntncnnntaattggncaaatnantttngcnntaaatantncngnntcctnnngncaaaatcnngaatcctnagggatggtccaaccccttttatggntggcctgaaaangngaagaatggggaattcctnttaaaccnttccattcaaaaaaaaaaaaaaaaaaacctnggcccttttnnaacttttnggggngcccgttttcccttanaanccgaccttggataggaaccattggatgaatttnggccaaanccccaacttggaatggcnntggaaaaaaaaggcctttaanttggggnaaatttggggaaggcn

SEQ ID NO: 3135 - DNA, 760 bp, Homo sapiens; identical to SEQ ID NO: 3073
  misc_feature (1)...(760): n = A,T,C or G

SEQ ID NO: 3136 - DNA, 813 bp, Homo sapiens; identical to SEQ ID NO: 3126
  misc_feature (1)...(813): n = A,T,C or G

SEQ ID NO: 3137 - DNA, 744 bp, Homo sapiens
  misc_feature (1)...(744): n = A,T,C or G
gntcaatacctgctactgntctttntgcggattccatcgttcgttcttcatgtttatatttcagagttcttaatagtgatacttaaatatactattttttccctgtactttcgaagatttggatatgagttttcagatttaaatgtgggaactcatttgagtataatccgtgaacagcatttgttcaacacatttttggggaggccctgctatatacaagtcattttccaagtcctactgaggtattggggttatccagattgtattatggagaagctagtggtctttaagaaataaagaaataaggctaaaactctttaacagggtagaaaggggcagttcataggggagggaaatagtatagaacattcatcctaggaatacaagtgaaatcactcaaattaccatgtagtcaatatacagattgntcagtgcctcctatgtgcccagcagtgtgctaggcccagggatacaatgaagaagaaccctgccctcaaaaaatgcagcctaaaagttttcttatggaaactggaaatcaagtttgggtctggcattagaggcttttcttaatgtattcacctggtgtgttcaggtantttctgaagatatagaaatgtttgatgaaatgaatgaagatacngaatggtangattccagtatcaagctctatctcataacagttacatttcctactaccttgcaaaccctntccntactattatttaatacccttttttcaccccn

SEQ ID NO: 3138 - DNA, 781 bp, Homo sapiens
  misc_feature (1)...(781): n = A,T,C or G
aanccccttttnnangcgnttccntncanctnaaancgnttgnaactcncnctntctgcaggatcccatcgattcgctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatantgtgtgtatataagaaaaaatagatacacacattcttttttctcagtcaacacattgattgaacactctggcaaagatgctgtggtggatgangttggagttcgaaagaagaagcaagcgctngcctgccttgaaagaaccgaagtctttcccattcacttctctagaaagctgccaagacagaagcagaaagaaatgggatgatagttctgtcaaagcacacttctggnctcttagaaccttagaagtgnttctaagagaacagaagttattaagaagaaacnagntacgtgtgggaattcaacaaccttngggtnggaacccattggcttnt

SEQ ID NO: 3139 - DNA, 881 bp, Homo sapiens
  misc_feature (1)...(881): n = A,T,C or G
ttcattccctggctntgntctttttgcaggnacccatcgattcgaattcggcacgaggttaaactgtcagtattggatcttagaagtaaatgattattaggactgtaatagtaattattaggactgtaaaaggtaaaggattattatctgcattagaatttcntanatctaaaggatttnganactngagacntttannnccaggnntcttttcctnaantcnnaaattccaaattcattngaantngggaaagtgatgggggnacaantngcntncnatccagggnntctaaantngnnncanntggcncncnnncgntaaanntactntantntnccntgagcccngntaaaaaactgngttaccccttgacgactagtggngattatcnatttttncccttnancgggccctnatttcttctaaccccccacnntgccttnntngatttaaanaaccttttgggngcaattccctncctntcctaatttangccccccngangagttttatccnccngnggnaataaattncccccaagggaattggaatccaanccccccaaanaaattnngnnccccccccttttaatnggnctgnnttgggntgggnaaaanaggnttttntttatccaaagccnggggtttnncaataaannagntnnccnggncccaataatatttttaaagngcnacccctttttnnnanaaanctttttccccccctttttttcnaggggggggggntattccanngggnnnaanccctnactgnnagggggccaatnttaaatgccnccccctttggcccttcacccccaaccccntttttntntttnttttttnnaccnaanncaaattccgntttttgggttnccccc

SEQ ID NO: 3140 - DNA, 725 bp, Homo sapiens
  misc_feature (1)...(725): n = A,T,C or G
nttcnataccttntctactngntctttttgcaggatcccatcgattcgggctcagaggggttatgattcggagggttctgccgcacggcatgggccggggcctcttgacccggagccaggcacgcgcagaggagcttttctctgggtaaagttgaggacgacagagggtattgtggttctgggttgtccccaacctccgactgtgtgtccttcaggacccgaaaccatggcccacactggcaggacagtgggtcggcttggggaagggggttagcttacctaccagagcttgtaggggctgtgcaggtgtatggctcccaaggcggcccttttcaggtggcaggtctcacatcattctccatttaagcttacagtcagactgattgataatcggtggcacagatgtgcattaagtcctgcccgtgttcaggatgctgtacttagtgctgttgcggtaaaggagtgaagagaagacgggattcagtgaatgttctggaaaatggctagagtgtacctagagagggaaaatttcaatagacagtaggccagttcaagactggatagaagccgggcgccgggcctgtaatcctagcactttgggangtcaagccggtggatcacctgagctcaaganttcgagagcacctgaccaacatggtnaaacaccgcttttctaaaaatncaaaattagctaggtgtggtggtgggctcctgtaatccaggac

SEQ ID NO: 3141 - DNA, 745 bp, Homo sapiens
  misc_feature (1)...(745): n = A,T,C or G
ctaatagctnngccnactcgctctttctgcaggattcctcgattcgagaacatgaaggtagcacagaaaaagagatgctgtcttgcagggaatgttttatttcaggaaagatatttgcaaaggtggcaatgcagtggtggatggttgtggcaaggcccaaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtgggaaagtaaaactgactcatccaactagacattctacagaaagaaaaaatgcattattgacgaactggctacagtaccatgcctnttcanccagcccggtgtgtataatatgaaagaccanatgatagaactgtactgttttctgggccagtgacccagaaattggattaangctttctttggtanggtaaatctagaagtttatacantggn

SEQ ID NO: 3142 - DNA, 926 bp, Homo sapiens
  misc_feature (1)...(926): n = A,T,C or G
tttaagccctttctactnctcttttgcaggattccatcgnttcgaattcggcacgaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagncccagtgtataaggagatcatattccaaanggttgtcagttggntgtttgcaacctggaatgtattttcctttagagaccangttatccatggtggttaggcccctagagcagctggaaaaagatgatcaaaccaataggttngctgacatcnaataatgtaataagtttgctaaaggaatctaccatcaaatntnatattgnttccagggaaggttgtnnnttaanntnccntcttngtgncatantggacnntcccntnccagtcatntncntnannnctngggcnngtntngnnttngtntntttngncnnctnancaatatttcatatcncccctngctaaaattctttnanannaanttctcantttctccctttactanaantttngtntttnntccntttantatttnnncctatntntntcgttcnnanatntcattnnntnnttntnngctnntnnatcacccttanctcnntctcanntatcntnntcntattatctctntattnntcncttntnatnatcnttccnnnttgtntanncnattatntcttgttnntntnctcncatctctntcntnttctcngctnannnnactccnnnnntcncnctcntnnnnanatncatatnctnctttngntatatannnnnntntntacntanctcnnnatnncatnncnatatnnttngt

SEQ ID NO: 3143 - DNA, 805 bp, Homo sapiens
  misc_feature (1)...(805): n = A,T,C or G
tnaagncctttctnttgctctntttgcaggattccatcgnttcgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacatttagatatttggtgtcagaattttaaaacccaaatttactggctttttggaaaccttcnaaattatattaatggtatcttnatgnattgtgcctttataattggcnattttggggnntttncnttttnaaanaaaaattcctngaaatttattttaaantccnggaataatgntnnggnaattcctgnnattccttggnnaantttttntggngttccctttgggaaaccantggccttngcctttttannaaanttaaaagncntttaaancaaacctggg

SEQ ID NO: 3144 - DNA, 851 bp, Homo sapiens
  misc_feature (1)...(851): n = A,T,C or G
gtncttngtgnctntcngnaactccctctntctgcaggatccctcgattcggagaggagcaggtgcagtgattcatacccactctatngcttttgtgatggccacccttctctttccaggacgggagtttaaaattacacatcaagagatgataaaaggaataaagaaatgtacttccggagggtattatagatatgatgatatgttagtggtacccattattgagaatncacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactattnatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaaattggaaattttttcatggatgcctnctaaatttggncacttaaatacctgcaaaaatgggcncccctggaaacctcttctgaccatttggaatggtaattnggccttaataattccttnaataaattttttaaaaatgaangggcccccagnnggaaaaattggnaaaaaatttttnaatancntccnaanggtnnnctggggntaaattttttttaaaaatcccctttaaaccagcccaaaaattatttttggnccctttaaatttccctttnnntnaaaantantaccntcttcaggaagnaaattcc

SEQ ID NO: 3145 - DNA, 758 bp, Homo sapiens
  misc_feature (1)...(758): n = A,T,C or G
gctcnatgcttngcnatcgcncctttgcggattcatccnttcgggaacttttgaagagaaaaattcgagctagagggattcttaaagccttaagttacttgaaatctatgtatttgcaaccctttgtctctggaatcatattacactaaactggaatctcaggctgaatgagaataacccagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcanttcngtggatctttataaaatactgaccttctaattagattcaggtcagtcttaattaaagggggaaaaaaagcaacgcaagcncaaccacagnaacnccatattcccaaatgaaaggaaatttggtttaaaatttcacagcattaaacattactttttaaagtaaaacnagttcatttgaagaaagtatgtattgcancnantggaacatgggcctggngcttttgcagtggccttcaacctnctgtgcctgtctggaangggcgtgttcccaagagtgaganggagaagcctggtgtncangaaacgctcctattaangaaagnttnncttggccaccgggccaacggggcnaagaatggtttggggtggntttnacctcttatcantgc

SEQ ID NO: 3146 - DNA, 880 bp, Homo sapiens
  misc_feature (1)...(880): n = A,T,C or G
cgctttttcanatcgttggctactcgttctttntgcaggatcccatcgattcgttgagaacctgcctctatcccagaatgtgctggagatttgacactcanatcantgtntngncttctgcttggcnccatancttaacctgcagtgncttcaaaatgcccaatgccttgtttcctattaccttanatngcnnnccagtctagggaagtctatgagaaagtngcatttaattaaagtttaaaaaaaaaaaggttgggcnttgnggctcatgcctgtaatcccagcactttgggaggctgacgcgggtggatcactaggtcangagttcaagaccagnctgnccaacatggtgaaaccctgtctgaactnnnaatacnaaaattagctgagcatggtggcgtgtgcctgtatctnagctactcacganctgnggcagganaatcgcttgaacccannaggcngaggctgcagtgagctgagattgtgccactgcactccaacctgggaggacaganctagactcagtctcaaaacccanaaaaaangccnttttttctggtttnaaatggtttnggaanactttttttttntttgggtcccntanccttttccctngaaacccctttttcttggaancccctnaancccaaaaatttttattagcccnttttttnannaaggggggtttaatncttaaaggggccntttanccttcaatncnaaaaaaaaaaaattgcccggcnaggnccnttttacccgagttgcaaatttaattttnaataacccaactntgggcctttaaaatttaanannnaagnttcttgggtnacccnanntntntnggggcccttttttgnaaaaccctttatangggggggng

SEQ ID NO: 3147 - DNA, 723 bp, Homo sapiens
  misc_feature (1)...(723): n = A,T,C or G
caatgcctgctngtcgtcgttgcggntcatcgttcggttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaacttaaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcatagatcatttagtccaagaacttaaaactaaattgagccataatttactt

SEQ ID NO: 3148 - DNA, 735 bp, Homo sapiens
  misc_feature (1)...(735): n = A,T,C or G
gcttcaatanctttttctaangctctttttgcaggattccatcgattcgaattcggcacgagagtacccananttgcnaggagtntnntnactgatntagccaggtggcaatnatgagtgaatggatnaanaaaggccccttagaatggcaagatnncatttacnnagaggtccnagtgncanccagtgacangaatgagtttnaagggatgggttttaactacagacccagnctctgccaatatngaccttgtgaacttccttgaagatggcancatgtctgagaccggaattatgggacatgctgtgcagactgttgaaactntgaatgaaggggaccatagagtgagggataagctgatgcattttgttcacgtctggagactgcaaagcatacagcccacaggatctggaagagagaaagaacagcctanagnaaatggctngagangaaccacattcccatcactgaacaggganacgcttcaaggactctctgtgtggctggggncctgactatngacccaccatatggtcananaaattncaccagctctnatgagantattntgtcgcgtgttcaggatcttantgaaggacatcttacantttnccaannanaagncatgaaatgtgacattctgcttgaanaagacnatattttatcctcatnaatgtttaaatgtaaaannnnananaaaanactcgagctntnaaatntngtgagttnanang

SEQ ID NO: 3149 - DNA, 798 bp, Homo sapiens
  misc_feature (1)...(798): n = A,T,C or G
gcttctaatgcttttcgantngcnntcnttgcaggatttccaaatncttggntgcatcctctgatggcnctgtaaagatctggaatatgaagaccacagaatgttcaaatacctttaaatccctgngcancaccgcanggacagatattaccgtcaacagtgtgattctacttcctaaaaaccctgnncactnngtggtgtgcaacagatcaaacacggnggtcatcatgaacatgcaggggccanattgtcagaancttcanttctggtannagaganggtngggactttgnntgctgtgccctctcttcccgtggtgaatggatctactgngtangggaggactttgngctctactgtntcngttcancnactggcaaactgganagaactttgacagtgcaacgaganggatgtgaatggtattgcacatcancctcatcannaacctgattgctacctacagtnannnatggacttctaannctctggannccatnantcaacttttcttgtataaatnagctcnaaagcntntactttaaatgaagccatnntcatggtaatgtgctttnatntgttttttgccnncntgttctaaancaaatacnattgtcnnaaattnannnccncaaataaattttttgtggaaananttnatgnttttnaaanttagcnaanctnnccccntntctctttgtgtgaanattaagcttttaaagggnagtttnggnnntantccatnctttcnaaactgggntgnccggtcaacnttaaangntcaaacaattaaanncn

SEQ ID NO: 3150 - DNA, 732 bp, Homo sapiens
  misc_feature (1)...(732): n = A,T,C or G
gnntctatnctnggctcttgncttcttgcaggatttctaatgcttggattcggcacgagatcaccctggcacgttcccctcagctgggctctgcagggcagctaagattgggcactgatgttcctggcttcagtcctacccgggttatgcagctacggcttcatacatacaccagttgcactaacttgggatgaaaattaagttaaaaccagtagaaaatttcatcctatgttttggtggtaaaagaagcaaatgaacaaatgaatagaggctgccaaacagttgtctcaccaactgttccgactagctaacaagattagctaggtcatacctagtcgtaaaagaatactataagaactcagaaattcgacatatttctactacttgcttgtcatgtagataaacagattaaaagaaccataaaaaaacaaagagaaaataatagtaggattagagagcatgttatcatctcatgggctcacttggccttagaaagaggtgtttatccatcatgaatatgaatccaggggtctgaatggatataagagaaccaaatgtaacagaaatttaatatcattttttcctctgagatgaaacattttacattttccagtttattagataaaattactaaacatgttctagaccctggagttgtagattttatgatgttggctgctgtggantggccatgactgggttttcaaatgntaatttgatttctttttaatc

SEQ ID NO: 3151 - DNA, 910 bp, Homo sapiens
  misc_feature (1)...(910): n = A,T,C or G
gtnnncttcattcaatccctttgcanntgctctttttgcaggatccctcgattcgaattcggcacgagcttgacttccaactgcccctgagatttgnnctccagtataaggggcaagcgggtgccctggancgtccantcctnattcancnancanggcttggnttttntgnaaaaacttgttggnagtcctgncanaaaagctgcggcggaaatgggcactgtggctttccccgtttcaggntggtggngattcctgtngggagtgagcaagaggaatacgccaaaaagggacagcngancctgcnggctgcaanactggtcagtgacctggatgcanactttttgactgaccctttagaccngagaaatcctaccgggccccanntttgncccantaacaaanttttcangttttgntgggttnggcccataaaanaagcaactggttngaanaaacaanttgaaacnttttcgggaaaaaaangctantttggngcaccntttgccgcaatttgggganattttccctngnnaaanangttttnnccccnttggttcgacaatttttcccnnaaatantctnncggggtctnnnaaaantntccngngngnanaaatttttttttnggnnctcntntnanannntttntnttgnngatcnaaaanaanttgntnatttgacaaatnangcncnaantataanntggnaaanccccncaaacctgttgaaaacaantgtnnccccccnaaatttttnanaaanactgnttggagaccnaaattnnttatnttcntnannaaaaaaaanttttgttngngnncccnctcaatntgngggtggnaacttttcatncnnanttnntttggntaggtaaattntnatcttctncttnaanaaaaaaattcnc

SEQ ID NO: 3152 - DNA, 755 bp, Homo sapiens; identical to SEQ ID NO: 3113
  misc_feature (1)...(755): n = A,T,C or G

SEQ ID NO: 3153 - DNA, 805 bp, Homo sapiens; identical to SEQ ID NO: 3143
  misc_feature (1)...(805): n = A,T,C or G

SEQ ID NO: 3154 - DNA, 766 bp, Homo sapiens
  misc_feature (1)...(766): n = A,T,C or G
tnnnnnnntttcaatntttnancgtcccttaggatccntcgattcgatccagatgggatacctctaaacacgaaaagaaagaagattccattantgaatttttaagtttggtttnatcaaaagccgagccacctangcaacagtccacccccttagtaaacaaagaggaanagcatgcaccagaatcatccgcaaatnagacagtcaacaaagatgtggacgcacaggctgaangagaaggganccgccatccatggacttattcatggccatctttgccagttcctcatatgaaaagtcctnatcctgcgangatgancacggtgacagtnaanatgatcaggcacgctctggngaggacaacttccaaagctggnaagacactgacttggnggaaacatcatctgtggctcacgctnttgtgccagngccctaggagccgtcaccttccttcccgatacaaangatgcagatagatnanaganaagagntcggccngnngctgcctcccgtcttatgtnccaatgctcgtcagacacttgaagttnctcanaaagagaaacattccaagaacaaagacnagcacaanggcaatanagaacacaggccngaaagaattganangaaattggaaacactngaagcacnaaacacctaangnaatccaaaanaattggcaaaccaggggaaaagtaggtncctncgngaagtttcgacagccngcggacaagccanaattgacnatgaaaccgcatacgtgtcttnc

SEQ ID NO: 3155 - DNA, 778 bp, Homo sapiens
  misc_feature (1)...(778): n = A,T,C or G
ttngaaaacnccttngcttngttncccctacngaaacccttttgaaaaccntttgcnanntcctctttntgnaggatcccatcgattcgtgaaagaggagatcggtgacctgggctccttatgtgcctgaatgagtttgagtttcctgttaactccaaatcaacagtattttcaacaagaaatgtgcaattgaaatcaagtgctgtttaagtgcagctaggantccacaggaagacacttgcagtgaacagagttatggagcagcaaaaacacagatctatttggaaaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgatttttttcatggttatgataaaagaactggattagcagaaacttttaccctgaatcaagatttaatttttctttgagctcatcttaaggatatcggaacatagggagcaaacgatggtgtggctgcctcantgcttgaattttaacngttttgaaan

SEQ ID NO: 3156 - DNA, 745 bp, Homo sapiens
  misc_feature (1)...(745): n = A,T,C or G
nanatccnncnantncttnttgttcntgtccgnangatcccatcgattcgaattcggcacgaggtttcatttaagaagaatganctagatanatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcanagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttaaagtgtataaatgattcctctatttgggagagatcttccaatccagaggagcccntcttggactgcctgggttaaatctgcatancagangtggttgatgaagttcatctgaagaaattcagccccacctncccaccctgccnttcctgctcccttttgatagtggcttctgggtactcgggcnngtncttgggacaccanccttntctgggggtctnaagccatcccgttggggctgtcggccaagcctaagttaatcgtgtgcctntattgggaggatngctnntcct

SEQ ID NO: 3157 - DNA, 762 bp, Homo sapiens
  misc_feature (1)...(762): n = A,T,C or G
ttnnnnnnctccnaatcctccngatnanatcnctttgnanctncctgcaggatcccatcgattcgaattcggcacgaggtccatacatggagctccctggagcccgtgtgntntcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggangccntngggctctgcaaggcgcanatcactgccatcatctntcagcaaggngacntatatgtnnntgacctgnagacctcagctgacnctnccttngtanggttngatntnggaagcatcccaaggngatttagngacnntggantcctnatnactgataanacncnaactatantnttttacccttggnagcccaccagcaagaatgagttggagcaatcttttcatgtgacctncttaacanatatactctgaatgaatctacgttgtatttatcaggnggacaatgggaataaagcntttntaaagcaccnantggacatgaaagcaacagacacnaggagnnaagccttgagacatgtctgnnntctgaccgcatnttgatccantgntctgtganganttnttcactgaacattttcaagaggagggtgnatacccctggcaatngcccnaanaaag

SEQ ID NO: 3158 - DNA, 755 bp, Homo sapiens
  misc_feature (1)...(755): n = A,T,C or G
tgntttcccnctnagatcctttctcacaaccttgtantgctgcangatcccatcgattcgcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaacatagaatttggatcctttggtcgggttctcccaaattcttttgaggtgtccatggtcaactgcttcagctttgtnttggcaaccccctgcccgaanncgcatntaggctgctcttcaccttgtttccaaggctgangaacagaaagtagcctntgttttgaggangtngaagttnantatacatnnattttntactgngactngntcaggaccacattttacaaaatgcctngtttccttcattgnntctggaaaggaaagttctattaatattgntttactntgaatatanaatagttttnantaattagggcttatttnnaaaaattctgagctaattcaaatgtatgccaataccttccaaagtaaggtaatattcanagacaagttgctgtnatcanatggcttanagaaaatctctggaatattcacattctaanattncttattaatngaatgtcctttgacttaaatctaccaaaaaactgcaacattantctttgncatnctcattatatagngttaanaagcttatttcanacnaataaaatctn

SEQ ID NO: 3159 - DNA, 753 bp, Homo sapiens
  misc_feature (1)...(753): n = A,T,C or G
ttncccccnttttntncctttgtctcatccttgngccttttgcaggatcccatcgattcgcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcanagacagttgttgtgatcagatggcttagagaaatttctggaatattcacattcgaagattccttattaatgaatgctttgacttaaatctaaccaaaaactgcaacattattctttgtacattttcattatatagtggtaacaagcttagttgcaaacaaatgaaatactt

SEQ ID NO: 3160 - DNA, 759 bp, Homo sapiens
  misc_feature (1)...(759): n = A,T,C or G
ggntttnnannctttctaatncttggcttnagttcttttgcaggatcccatcgattcgaattcggcacgagagtacccagagttgcgaggagttttttaactgatttagccnnntggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatnactgaacagggagacgctccaaggactctctgtgtggctggggtcctgactatagacccaccatatggtccagaaaattgcagcagctctaatgagaatattctgtcncgtgttcaaggatcttattggaaggacatcttacagcttccaatgagaagccaagaagttgtgaacatactgattgaaaaaagactttattttaatccctcattaaaanggttttaaatgttaaaaaaaaaaaaaaaaaacttcgagcttttaaactatngtgagtcgattcntataa

SEQ ID NO: 3161 - DNA, 783 bp, Homo sapiens
  misc_feature (1)...(783): n = A,T,C or G
ttctcctgaaacgcttngcacttccctcnctgcaggatcccatcgattcgaattcggcacgagacactgtcccactccatcacccaggctggagtccagtggtgtgatcatagctcgctgcatcctccagttcctgggttcaagccatccctcctgcctcagcctccccagtagctggaactacaggtgtgtgccatcacacctggctttacatttttctgtggggtcttactatgttgcccaggccggtctcaaactcctgagctcaagtgatcctctgnctcagcctccagagtatctgggattacatatgtcggctaccgtgtctggccgttcacatctttggccactattngcttgtgaaaaggtatnatgaggtggtacttatcatngttactgtgtctcatgttnngtatatttttgcttcatcaactaagatgcactgtaacatctgtgaaatctggatatattatcaaanggtttatcatagttttgttaacaatacactgtcgttttactnggtgcctaanataatggtatagttgngaggtgatcttagatttgatgaagcacagtatgcaangtaggcctaatggngggaaagaatgggnaattttcanangcnnggaagtatttgntnttttgtaaatggacttgaaaagcttgttctgnnggattggacccaacccctttccctttnaaaccccgaattctnatngactnttccaacttngaaaactttgctcnaacttaaatacctttnaaaaattaaccntgaccccg

SEQ ID NO: 3162 - DNA, 772 bp, Homo sapiens
  misc_feature (1)...(772): n = A,T,C or G
ntntttgaatctttgaaatacctttgctatngttctttntgcaggatcccatcgattcgaattcggcacgagaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccactncccgcctacctggtggccgccttcgccaagcggctggcccgcctggccctgacggctccccctgaggccctgctcatggtcctgcctttcatctgtaacctgctgcgccggcaccctgcctgccgggtccttgtgcaccgtccacacgggcctgagtttggacgccgacccctacgaccctggagaggaggacccagcccaagacccgggcctttggaaaacttccctgtgggaagctttaagnnccttcnanangccacttacccaaccttgaggggntccaaangcccgccanccggtnattaaccaaggccctggncaatgcctgaaggtcaaacaatn

SEQ ID NO: 3163 - DNA, 759 bp, Homo sapiens
  misc_feature (1)...(759): n = A,T,C or G
tcnnncncttttcgatcttttgagncttgcctttgaaccccttggntacganttcggcacgagggaaccatgananccnagagctagaattgctattggatnncgtctattctctntttgcttattgggncgngntncgtggttnctggcctcangggtnnncccgaanganggggtatctnngagcnanttntgcnntttacnggctagcttgntgggggcttaanntgccactnttanacatgctntactantcantgagannntncnntcgaccatntannacnatnctgtgnnntccngtacnctntggccgnatggagctattagcttcaanatgnntcgnantgttacatgcanncactganntnactatccannatntaagtnctcttngcttactgtgaacannngctactnncttggatattatagnaaggntcnttgatacncgatnatcntncntgtcagatcnataaatancanctataccnactgtnnaaatnccatctggnggncttncnatccanacataattgcattannncgtcnaattgngatanagtnttgaaagantctnggtttagacnttggatgttgcaatgnttgtgncttanaanttatgtgctggctactgantaanctgggggcatgacnttactggnttgacctaagnggngaantcnatggtccgattgctggnccctanccttaagntttgccatgaataggncttttgccctaaaataanaccccttt

SEQ ID NO: 3164 - DNA, 853 bp, Homo sapiens
  misc_feature (1)...(853): n = A,T,C or G
ttttgganccnttctttgannctttctaatgctgggntactcgntctctctgcaggntcccatcgattcgaattcggcncgaggatcagcccacctcggcctcncaaagtgctgggattacaggcgtgagccaccttgcccagcccacatcatacagtttgaaatgaaactttgccacaaccagcctttgctgtagcacacacatatatcactgaacctgtttgaaataaagttttttttctttntcctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattangcagtcaaaaaaaccaagcaagcataaaaggtcaataagttgtaatcttgatagtaaaggtggaaaacttattataaatggnaangaaagttttatttccttttttgtttgaatgggcaagtatgccatattatacccaaaagttcttttaaaaaaatatttcccattcaacccatttttaattnaaaattaaaaccattttgnaagggaaantttacccaanggcaanccttttttttcctccaaaaaggttnaccntgttnatccttctttttnggnaaatttanccaccaatttttttaaaggngggncaatggggnttaaaantanccctgnaagnnattttttnanccttccaggtttaaaantccccttggatngggtcttaacctgggngggtngnatanaaaaaaatanatcctntttanc

SEQ ID NO: 3165 - DNA, 767 bp, Homo sapiens
  misc_feature (1)...(767): n = A,T,C or G
gcgttctttgaaagccctnttttgaaaggcttgcttctaattacgggaaacctttgcaactgcagatcccatcgattcgaattcggcacgaggacccaggtagaccagctcaagagttcatgttctttgtnatcctcctgtgagctctctgtaagtcnntttcttgcccatcaccacatccctagtactgggtatcagtctggccacttggctttctggtttgccccaatgtggtctattcttgatgcagctaccaaagtaatgttttaaaaccattataccaagttactatccttgtcaaaacccccagtaactgccaatctcacttagaataaaatccggactcctgtgaagcacagcataaactggccactgcctatgcagcaacctcatctttaccgnttcctgccttgctcactcccttccagcgccgttattcttcctgatgcccctagtacacaacaactccttcctgctccaagagtaggaaaattactggtctctctgccagngagaancctcttctggnattacctttgcttcattgcngaatcttctncaatatcatcttctaaaaagagccttttaaaaatcacctttnctatnatgccctactcatttccagtccctgaaanggccattcccacttnantannacttattgctaacntgaaatacactaaatgnnanccttcatgaanggtanggcaanttaaatgcnttngcactggnnaggcnaagagaacaagcancntggnttcanaagn

SEQ ID NO: 3166 - DNA, 767 bp, Homo sapiens; identical to SEQ ID NO: 3165
  misc_feature (1)...(767): n = A,T,C or G

SEQ ID NO: 3167 - DNA, 767 bp, Homo sapiens; identical to SEQ ID NO: 3165
  misc_feature (1)...(767): n = A,T,C or G

SEQ ID NO: 3168 - DNA, 754 bp, Homo sapiens
  misc_feature (1)...(754): n = A,T,C or G
tttggagntctttctttctaatncttggctactngntctttntgcaggatcccatcgattcgaattcggcacgagcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcatgaaatagaaattggagaatctggttttgctttattattccctcaaattgaaggaatnaaaatacaaccctttcattttattaaggatccaaagaatttaacattagaaagacatcaacttcactgaagtaggtcttttagataacccctgaacttcgtgtggtcccttgtctttggntataaatgctgtaaggtggnagccantaattntctgcaanaagtangncagcacttttcagtgatttgaatatcatcttggcttngangccangtggacaaccttgtcataactgacttctgaaaagaaccctntngatatttgatgcctcnggtgtnggtggaactgtcatttantngganna

SEQ ID NO: 3169 - DNA, 734 bp, Homo sapiens
  misc_feature (1)...(734): n = A,T,C or G
tctgnnctntgtntccttgctcgtgttcttttgcaggatccctcgattcgaattcggcacgaggactggagaagtcagaagtagaaaagcagattgctaggagagacaggatgacagattttggtcagaaaatgggatattggagtttaaagtatcaaatacagaatagttccagatgttcagagatccagcatgggattaggtactgaaatggattagaactaaaagtcactagaatttagaaattgagaaccatgagagtggatgcaatgacttgttgcttgattgaaaaataaattaataataataaaggaccatgagactagcctgttataggggttatctccatgaacattgaattttcccaggatcatagcaggaattgggtagagaaaaagattatgagaaggtgccagagtcttcagtgaatgtcaggaaattaccaggaagtcagcatatgacagagaaaaggacagtatgttatctgcatcaaaggaaaatgtgcttttgttgaaaagtacagaaaaagccaatactacaatactgtgctaagcccctacctgtactcctctcccacagctgcattccagccctgtggtataaaaggtgtgagaatgagcttttccaccagaatcagcaggtttagttaaagcatgagcagaacaagcatnctatgaagagactgaggatgtaggtgagtggtctaaatctcatnnaaggacattgcagtngat

SEQ ID NO: 3170 - DNA, 730 bp, Homo sapiens
  misc_feature (1)...(730): n = A,T,C or G
gaantccttnnntttnaaatcnttggctacttgttctttttgcaggatcccatcgattcgaattcggcacgatctagatattgcccaatcgctgcccacagtgcacatacctttccaccagtcacatgtgagagggcagattttccaaatgctcatcaccacttggcactgtgtggactataattttggccagttaggaaatggcatctcattgttttcatcttaatttgcgtcagcctgattactcattgaaacttgtgaggttgagaaacttttcttaagcttattggccattcaagtttcctcctttatgaaatggttgttcatgtcatttgctcatttttatattagattgtttttcttttttccagctgacttgtaggaactctacatcttatcaatattaatcatttatcgaaaactatttgggtgccattatcttctcctagtcaatgttttttgtttgtgatatcttttataatatataagtttttaatgttggcagaagtaaagttaatctttttggctgtgttgtgtgtcttgtttgatgtaaagatagtttctgtaatagttttgcagtttgattggtcatctttaggtcttcaattacaacctgcacattcatccctctatcctctttcttactctggttttctccatagcacttatcatccaataatatggcatgcacttatttaatctggtttgcatatatattttngctggtacg

SEQ ID NO: 3171 - DNA, 757 bp, Homo sapiens; identical to SEQ ID NO: 3041
  misc_feature (1)...(757): n = A,T,C or G

SEQ ID NO: 3172 - DNA, 805 bp, Homo sapiens
  misc_feature (1)...(805): n = A,T,C or G
cnaatncttgctcttgncctntttcnaatncttggcnactcgctttctntgcggatccctcnnganncnatcgttcgaattcggcacgagcacaaggagaagaaagttaattaacattgaaagatgagaagacatcttggaagacttgaattgggccttggaagaagaacagccattcaaatagatagaattgtggtagcaaaggcatacngntcggaaagtatagatctccagggacagtagtcatggggttggggcactgttggaatttaaggttggaaggatatattggagccccttgaatacggtaacaaggcacaccttgggcagtggagagttatcagagtgtttgaaaaggagggttattgagtaaataaatagactggtactttaggaattttaaaatgtggatcattgtactactaataactatntattttatatttactatctactaagtaatttacatgtattttcttgtactgactgtaaaccttctgggtgtgggtgttttaagtgccattttactgataaagaaactgangcttaaatagntgaaatanntcaccctgttagtgagtggcacaatgacaagtcannatcttanggttgccnanntccaaaanncatttaaanttnnagnatnattgannnttttnccttatggcntnnnaaatttggggagccattattgaaatccnttacnacntangaattgnccaaaaaaaatactttttggggaaaactggatttattaattatccaaaataatttnantggcttgnttggcttntttccactntnc

SEQ ID NO: 3173 - DNA, 886 bp, Homo sapiens
  misc_feature (1)...(886): n = A,T,C or G
cggnnnnnnngnagcccntttggnaaangcctctaagggaaangcctttttgaaaacnanangaaaacctntgggaaaagnccncannnattttngngaaannggcnngagcnnanantnggacacngttntaannnnannagngnnngttttnngananagggnnnnnagnggnannnangngnnggagggaannaaggnanagnannnggnagnnaaggnnnnaaagaagnagnnanggaganggnnngnggnggggcatgangngggnncagaggcacgaggagcccaagaccatcacngangagnangagcagggnaccnacatnnacnnggacnacgagaagnggggccagcggaagaaggaaggnagnacctngagnaccgntaccaggaggancgggaccnacagngacanaggnccnnnncnanacggannnnanaaacgngaagcaggannnnnanggaccaagggaagggnncngnncnnggaaaganngggagggaggnncgaaggcaaagggggganncgnnannnccaggaagnanggaaggggggncgggaggnnaannganaagangaaccnngggggnncaggggggcgagggnagcanaannnnnccnnagncaanngaaggggananaagagngggaaaannaannagaaagagggaaaanaagnnaaggaaanaaaagangngnnaannnggganaaaananggngananngnngganaaangngnannanaaaanngaggaggncanngggnaaanaananggggagggnnganananagngaannagacaaggaanagngaannagngnanagnanngngnannaaaggnannggggnaanaagnannanannnnnagngaagan

SEQ ID NO: 3174 - DNA, 781 bp, Homo sapiens
  misc_feature (1)...(781): n = A,T,C or G
gcttttnannnccctnctttcnaancctcttcaaatccttggntatcgttctntctgnnggatcccatcgattcgaattcggcacgagagacaaagaaaaaggtggcaatcatagaagagttagtagtaggttatgaaacctctctaaaaagctgccggttatttaaccccaatgatgatggaaaggaggaaccaccaaccacattactttgggtccnntnctacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttataggaaatcactgatgaccagtttgactttcatacatactggatgaaggaagattacccttagatcatatgtggacttattnaaactatgaagatgtactttnacagcatncattttacttcaaggcagcaagaattgcttttagac

SEQ ID NO: 3175 - DNA, 775 bp, Homo sapiens
  misc_feature (1)...(775): n = A,T,C or G
gntttnnatncctctttctaatnncttggctactcgntctntctgnangatcccatcgattcgaattcggcacgagagattatgagcatgtagaagatgaaacttttcctcctttcccacctccagcctctccagagagacaagatggtgaaggaactgagcctgatgaagagtcaggaaatggagcacctgttcctgtacctcccgccgccgaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcanacctgtttaaaacgaattcgacttgatctccctattttacatgaagatttttgttagcaataatgatgaagttgcggagaataatgaacatgatgtcncttctactgaattagatccctttctgacaaacttatctgaaagtgagatgtttgcttcttgagttaagtagaagcctaacagaaggagccaaccacaaagaattgagagaaatnaacaactgggccttnggaaagaaangcnggccaagctgcttgagtaatagtcagancctanggaaatgatntggttaatgaattcaccccaggncacacccngttgaagagc

SEQ ID NO: 3176 - DNA, 754 bp, Homo sapiens
  misc_feature (1)...(754): n = A,T,C or G
tgnttctaatgctngctctcgttctttctgcaggatcccatctattcgaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagtttcttatcccagaaattactgccttcaccatccctaatatcttctaattggtatcatataatgacccactctttcttatgttatccaaacagttatgtggcatttagtaatgggaatgtacatgggaatttcccactgacttacctttctgtccttgggaagcttaaactctgaatcttctcatctgttnaaatgtgnattaaagtatctacctaactgagtngtgantgtantgaaagaaaggncatatnttaaacnttgaatttancaagcccacnctcgnattttatgncctttcttttgcctngggattgaanc

SEQ ID NO: 3177 - DNA, 743 bp, Homo sapiens
  misc_feature (1)...(743): n = A,T,C or G
tannnnttnctntannntttctgangcccttntgcaggatcccatcgattcgaattcggcacgaggagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccaactgcttcccccanggactgggggctcccangctganctggcccagagcaccatgtcaatgagaaagaaggaggaatctgaaccttgggtaaggatttggggcacagtaccaggaagggggcttggtgccagaccttatgaggaagaaggattttcctatgtacagagaangggaccctgtnctgttgggaagtgcttgtgcaaacctaaccaagttactaacccctctgntttctgtgctacacaaaggggataaatt

SEQ ID NO: 3178 - DNA, 786 bp, Homo sapiens
  misc_feature (1)...(786): n = A,T,C or G
gatgtttnnnannctggttctaatncttggaaanctncnnctttgttannngcnntttctgcaggatcccatcgattcgaattcggcacgagcccagctggacctggtggccctttcctagtgcctctgctgggggaggagaacctctgtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagccccatgcacgtggaggaggagctggctttcagccccagaccccacgctagcactttccacgctgcttgcccgctgttgatgtgcagttcccagtgcctgtgtgagccgacatctgctcagtcctatccctcgtcagcgtgtggagacccagctcctgcaagcccttctgcttccacgcccccagacagcttggtggagggtcctgcatctgggccaagctggggtgcacccagccaaagacaaagctgccttcacgtgcccaaaggattcaagatggtgcactggccccgggaggagtcttgaccaaaaatgggagcccgctcttgtggggaaanccccgacttcccccaccnanaaaccgntcccacggtgccggancttcccccttttcctttgtgggggcaacaanattggccttgggcnctttcaattnttncggaagctttcctgggtgtnggcttttgaccttaaaat

SEQ ID NO: 3179 - DNA, 765 bp, Homo sapiens
  misc_feature (1)...(765): n = A,T,C or G
gttgaantccttcctttcaaatngcttggctactcgntctntntgcaggatcccatcgattcgaattcggcacgagcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcatangtgacagggtgtgtctctgacagtggtaaatcgggtttccagagtttggtcaccaaaaatacaaaatacacccaatgaattggacgcagcaatctgaaatcatctctagtcttgctttccttgtgagcagttgtctttctatgatccccaaagaagtttttctaaagtnaaaaggaaaattcctagtggaattcancccccaagggaaaaaagcccacttgnccacannaggaagccnggntnccccttngttccggcttaanggccccttgttcaggaaaccacactgggggancttnttttttttn

SEQ ID NO: 3180 - DNA, 783 bp, Homo sapiens
  misc_feature (1)...(783): n = A,T,C or G
agttgaantncttgctacnnaaaacctttggcnactngctctttntgnaggatcccatcgattcgcaaagatggtcgtattactaaaggtgaataaccagcgcggnnngcacgtggagtcactggaacatttgtgcaatgctggtgggaatgtcaacccgtgcggccctctggaataagcctggcagctcctccaagagttaccgngtgacccancaattccactcctagctccacccacaggaattgaaagcaaanacgcaaacagatgcctgtncaccaaagttcacggcagcatncttcgncatagtggcagcatccgtcgtcacagcggcatcatccttcatcatagcggcagcatccgtcgtcacaagcggcagcatccttcgccacagnggcangcatctgtcgtcacancggnagcatccttcgacaaagcggcagcatncttcgtnatagcngcagcatcctttgccatanccggcaaggtggaaaccctgtccatccactgaggcgtgcatagactaaacatgggcagtccagcactggaattccaagccgtacaacggngnccacngtcaaaaangaatgaggaccctgangcacctgngcnganaacaagaacnngcgannccaanacttttnagacattattgccttaagtngaaaaacccagngcaccaacgggaaaccngaccgncntgnanccctgnttaacnttnantnngttncccgaaaatgggggcacnttnccaaaaaggggaataaaaggggagaattncct

SEQ ID NO: 3181 - DNA, 760 bp, Homo sapiens
  misc_feature (1)...(760): n = A,T,C or G
gntttgaaatnccnttnnttcaaatnctnggctacttgttctttttgcaggatcccatcgattcgaattcggcacgagnaatgcaaagggctgcagttctcattcaggctactttcaggatgcacagaacatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtccccaacaagttatttgtatacagtcttattacagangctttaaagttccaaaaggatattcaaaaatatgccaccgggcttgccacacttaattcagncattctatcnaatgccccagggc

SEQ ID NO: 3182 - DNA, 769 bp, Homo sapiens
  misc_feature (1)...(769): n = A,T,C or G
ggnnntnnnagnntttgaantccctttnnttctaatnctaggcttctngttctttttgcaggatcccatcgattcgctcagctgaggcaattaaactggaaaagaaatagattgaaaagatactacagaagaagcagtacagaagttgggggactgaaggagagggagccactgcaggtgctagctgcttaaggggataccagtccttttacagatataatagatacagcttctgaggtggagggtgataggagtgtgtagagaaattgcagttcagaactggagcatgcagttaggcaagaggcatcccatgtgaagatgtcaagcaagtactggaaaatgctgaactaaaactcagggatggatatgtagatttagagaacttcattgtagaggcagtcattgaaagctaaaagggctgataataaaattgccaaggatggaaatagtaagagggagtcagtgttattaggattagaattctgttttgttttttctttaaacagattctcgctctgtcaccctggctggagtgaagtggtgtgatctcggctcactgcggcctcgacctcccaggctcaagttatcctcccaactctcagccttccaagtagctgggaccacagccattcaaacacatgcctgccttatgtttggatttttttgtanaaaccaaggttttgccatgtttnccaggctggnctnngaacttctgggcttaagccattcccccacccttgggtctcccaaaatgctngccattatangg

SEQ ID NO: 3183 - DNA, 748 bp, Homo sapiens
  misc_feature (1)...(748): n = A,T,C or G
tgnttttaatcnttctaatncttggctcttgttctttttgcaggatccctcgattcgaattcggcacgaggtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaacagaacccaaaggaaccatcaccttggagctncttgaacacaatgaggcatatacatggacaaatccacctgctgtgtgcataatatcattgngggtaaactgtggatcgaacagtntggcaatgtggaaattntaaccncagactggggacaaatntgtgttg

SEQ ID NO: 3184 - DNA, 755 bp, Homo sapiens
  misc_feature (1)...(755): n = A,T,C or G
ntgctttcnaatctttntaaatgcctttggcttctcgntctttctgcaggatcccatcgattcgaattcggcacgagaaaaagtaaagcttttcatgagcacaaatnccttgcattgtttgatgttactgatattcgtaaaatgaatattttttgttttgttttgttttatttttttgagacaagtcttgctttgttgcccaggctggagtgcaatggcatgatcttggctcactgcaacccctgccttgcgagttcaagtgattcttctgcctcagcctcctgagtagctgggattacaggcgctcaccaccacacccagctaatttctgtatttttagtagacacagggttttaccatgttggccaggctggtctcaaactcctgacctcaaactcctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgagcantaagatcacttgagcccangaggccnatgcttncantgaactgtgattgtttccantacagnccacctgggtgacanagtaaanaaaangaaacattacataatttggctagagcataataaattgatttctgggttntgaaattnnagttgccataaaaggnntttnaatgngcnanttcant

SEQ ID NO: 3185 - DNA, 1009 bp, Homo sapiens
  misc_feature (1)...(1009): n = A,T,C or G
agcnttttttngaanttcccctttnnttnaaaaatccccttttttggcaaaaaattncccccntntntnanngtttttnngatncccacatncngnaatntncgggcncgggnnactgncnannggcncccttcgggggnccngtgntaagncnatncttgtntntanaaagntggnnntnttttncgatngngactattgncnacnctcttccntnttggcagngngtctgganggttgnggtngctcatntggntaanccnatcctggngaccaannggccgnggtgngcntgcaagctttgnccacntgggaaanccgnnagtggtngtctcanttgcntgntgggnncntgnccccatcttgnctgctgnanccttggggagcaggnnctnggtngtggtnctgcctgcttgctgctngttccccgggcatgcgtnnncannaagggncatgcntngggcaanaaggtgcgtggncancgtnngnatnnnnaggaccaccntgggtcgngaatcnntgggttncctgataggaaccntnaannnctgcngnttttattaaatgggannanangggtncanttcaaagccagtnnaatgcccttatggaanggngtgnatnacatancnnnntatgtgtcntanannangaaatcgttnnncaaatttnnacaanaatntttntaanaaagggtatttnantntnggtgaaanaacaangntttaaagtnaaatgnttntancanaattaantaaacnggtnttnatgattncttacnaaantaacnatncnnaagcatttacngcttanangtccncnngatactnncanaatatggnnnnaattntannanatngcgataatctngnananactntcatnnnnnatngtgtaatcantanntacntgatttnnntnaaatgaaaacatntgatncaagattaatncattanntatacnaaaatnttcanatantanatntacatataatggtttcnaataaacn

SEQ ID NO: 3186 - DNA, 840 bp, Homo sapiens
  misc_feature (1)...(840): n = A,T,C or G
cggatnncgtnagganngatngtagnancntcgctcnccctntgagnaagggngngcgaantcggcacgaggacccaggtagaccagctcannagnnntttttctttgtcatcctcctgtgagctctctgnaagtctctttcttgcccatcaccacatccctagtactgggtatcagtctggccacttggctttctggtttgccccaatgtggnctattcttgatgcagctaccaaagtaatgttttaaaaccatnataccaagttactatccttgcaaaacccccagtaactgccaatctcacttagaataaaatccggactcctgtgaagcacacataactgggccactgnctatgcagcaacctcatctttaccgtttcctgccttgctcactccctttcaagcgccgntattcttcctgatgccctagtacacaacaactccttctgcttcaaagagtangaaaattactggnctctctgccagtgagantccncttctggnattacccttgctncaattgctgaaacttctncaaatatcaaccttctaaaaaagagcccttttaaaaacacccttttctaatatggcccctactcaaatttccaagtcccctggnaattgggcccaatttcccccaactttcaataagcaaccttaaatgggctaatcctggaaaattnacccccctaaaaanggngcaancctttnaatggaanngggtaagggccaaanttnaattnggncctntngngnnacctggggnaaanggnccctaggaaggaaacccaagccaancttggggcttcaaaaaanntanggggcaaccttcnaaana

SEQ ID NO: 3187 - DNA, 739 bp, Homo sapiens
  misc_feature (1)...(739): n = A,T,C or G
gcgntnntattagcgtgggctcgntctcgctcnacncancnngngctggncgaattcggtacgagaatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattccctttcacctacctcagcaaaacaaactttcaagtcttgatagacttagcctagtaattttatagtgagagtttcaaactatatatcaagtgtctatagcatcaaaaacttctgggggcgtgggggaaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgancccagacagcagccataggcagataaagatttnggttcacccttggtggtgggaggcatcgtgtgtgcctttttttcctctaatatcaattttacagtccgggaan

SEQ ID NO: 3188 - DNA, 738 bp, Homo sapiens
  misc_feature (1)...(738): n = A,T,C or G
gnnngncgttcnaattncgnggnntctttctngccnannannannngcgtgngngaattcggcacgagactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagggtgtatgaaatagacatcacagatgcgagtgttgttcgctgcctgtggcatccaaagctgaaccagatcatggttggaactggaaatggattggctaaagtctattacgaccccaacaagagtcagaggggagcaaaattatgtgtggttaaaacccancggaaggcaaaacaagctgagactctactcaggactacatcatcacccctcatgccttgcctatgttcccgtgagccccgncaacggagtacaaaggaaacagctggagaaggacagactggatccctgaagtcgcattaacctgaacctcctgtancangcccangtcgtggtggccgatttggaacccacgggggcactnttttttcct

SEQ ID NO: 3189 - DNA, 757 bp, Homo sapiens
  misc_feature (1)...(757): n = A,T,C or G
tggggnntnnnttctaatgctgggatgttctaaangntgggctactcgttctttccgcaggancccntcgattcgaattcggcacgaggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgnttatgtgaaaatgcagattcactgagccagactaaggcatcagtgactgttcctctactgcctctcacatggagattgtgtattcagtgaaaggctgatcaaagaccccaaaggaatgcaccagtttatctcttatctacctatgacctgcgagctgnccaccacccccagttgttgcgcctttccagacagaaccagtgtcatcttacacgtattaattggatgtcctgngncttccttaatatgtatcaaaacaagctngccttgaacaccttgggcacn

SEQ ID NO: 3190 - DNA, 773 bp, Homo sapiens
  misc_feature (1)...(773): n = A,T,C or G
gnngnnnnnntttctaatgcttgggnnnnnngtcnatgcntaagagccangcggntcgaattcggcacgaggcgggcccggccagcggaagcccctgcgcccgcgccatgtcaaagaaaaaaaggactgagtgcagaagaaaagagaactcgcntgatggaaatattttctgaaacaaaagatgtatttcanttaaaagacttggagaagattgctcccaaagagaaaggctttactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgttgaaacggaagagcgaccaggcttagcaaaagactttcttcacttcgagaccaaangggaacagctaaaggcagaagtagaaaaaatncaaagactgtgatcccgcaagttgtnggaagaaatcgccaagcaaatnaagtagcccaaggaactgcttacagatggactgattacatattcgcaataaaatcttnggcccaaagaaaaatttngggtttgaaggaaaattaaattggttngaaccttttggaatttcccgaaagacttttgcctncntngacttaaaatatttccatggnggtgaaaggttgtccaanctt

SEQ ID NO: 3191 - DNA, 773 bp, Homo sapiens
  misc_feature (1)...(773): n = A,T,C or G
gnangnnngnttcntagtgcccgtgggagtcttagatnccctaaaaaattgntaatgctnggtcggcacgagtcaaggcctacgaaacaggtgatgcactaccccggctacggttcccccatgcctggcagctnggccatgggcccggtcacgaacaaaacgggcctggacgcctcgcccntggccgcagatacctcctactaccagggggtgtactcccggcccattatgaactcctcttaagaagacgacggcttcaggcccggctaactttggcaccccggatcgaggacaagtgagagagcaagtgggggtcgagactttggggagacggtgttgcagagacgcaagggagaagaaatccataacacccccaccccaacacccccaagacagcaatcttcttcacccgcttgcaacccgttccgtcccaaacagagggccacacagataccccacgttctatataaggaggaaaccgggaaaagaatataaagttaaaaaaaaagcctccggtttccactactgngtagacttcctgcttcttcaacacctgcagattctgatttttttgttgttggttgttctctccattgctgntggtgcanggaagtcttacttaaaaaaaaaaaaattttgngagtgactcggtgtaaaaccatgttanttttaacagaaccnanaagggttgncctattggttaaaaaaaaaaaaaaaaaaaaacttngngcctttagaactattanngagnccnatttacnttaatccannct

SEQ ID NO: 3192 - DNA, 754 bp, Homo sapiens
  misc_feature (1)...(754): n = A,T,C or G
ttggantcttctcngaaacncttngcnattgcnctntctgnaggatcccatcgattcgaattcggcacgaggttcttcaaagccaaccaagacaggcttntnagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctnaccagaggttcttcaaatcttatgcatagcaatccaaagttaaaagggtttgtgccactagctcgagaggaaatcaangaatggaaaaatgtgttgtaattggtctgcantctacaaggagaagctangaacatttagaaagctttggaaagaaggccggngggagaaattgaatgatttttggtttcaactnccaaaaggtgtgttgcnctcccttctttgaaaaaacattttct

SEQ ID NO: 3193 - DNA, 856 bp, Homo sapiens
  misc_feature (1)...(856): n = A,T,C or G
tggtgccngttcctattccgtgctntcgtnctncnccaggancnangcgtntcgaattcggcacgaggaaggaggacctaggcacacacatatggtggccacacccaggagggtagtggggagttagatttcagagtccaggccctaggttgggacccactccaaataatctcctcggtgtgggtggtggttctatagagggataaatgaataataaacattgttaaaatatacgaaaaaaaaaaaaaaaaaaaaaaaaaaaaaaaaaanaaaaaaaanaaaaaaaaaaaanaanaaaaaaaaananaaaaatnaaaaanannanaaaaaaaaaaaaaaaaanncccctncnccctaaaanattcnggggggntttttcctccannccnnntntttaatannctncttnttgnntcttngnctcaccnnttcttttggtnggcnntaananaaaatnttnnttttttttnggntanaaatncnntnncngttttttntnnttttttttcnaaaccctcctnttntanctcncgtntcnaaaaanntntttntccncnncnnttnnntnntnctntttctatttttnnttcttntncaannttccnangtgnnnngngtntnntgnggcttgtttntttttncnncctngcgtcatccnnccaataatttcttnncnccccnannccnnattttttntnncctctatntnngnngngnnatatnantcccctttattnttnatnantagtcntntnttttnttntccntngtnatannattttntntcccnntntaanttcctcannnnatttnntnnncnncgngntatatttnangntanntcnncggggttnct

SEQ ID NO: 3194 - DNA, 753 bp, Homo sapiens
  misc_feature (1)...(753): n = A,T,C or G
gtntngnnngnngttnnattatatggntcgnctnnctcnannancnangcttgngctgacaacttgattgggttctccttcaggtttgaagcgccctcnagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaataggggaaactattcagagaaaacttaagccactaagttttatggtgttttgttcttgtagccagaagcataggcatactggccaatacaaaccgaaatccttctaacgtantggacccttttcaggccagcattttttcccttgaaaacctgggagccttgtattccatcttattagcagaagatcactttcaccaatggtttgggctcttgatttggaattgatgatgtaatgagcctntattcnanatgngacttaatacctctgcgaattgactggattccn

SEQ ID NO: 3195 - DNA, 840 bp, Homo sapiens; identical to SEQ ID NO: 3186
  misc_feature (1)...(840): n = A,T,C or G

SEQ ID NO: 3196 - DNA, 840 bp, Homo sapiens; identical to SEQ ID NO: 3186
  misc_feature (1)...(840): n = A,T,C or G

SEQ ID NO: 3197 - DNA, 833 bp, Homo sapiens
  misc_feature (1)...(833): n = A,T,C or G
atccngttctntannnngtctngttctttctncacgatcnnntgcgattcgaattcggcacgaggggtcctggtgggagttccatccagcagtgagtgcattttttccccagagcagttaagggtcttattaaaagccaccactttgctgaggcctgtacaggccttgggggtttggggaagagaantaaggcaggcacttgtcccttcagggagggacttgtccntactgggaggtttggggttgaccttggctccagcagagatacccagcctggcntggaagggcaggtcttgagcttacgcttgactgcaagggcaagctgcaggcctcttctgccttcccctgcattcaccaaggacaagtaggaccaagaagtcaagggaaaagtgccaagatagatctattcccatttctttcttccacctggagaattcctgagctatgcttcaaacctcttttgggccagggaaagactgggggacattttttagtcaaggatgctttaagaaagtaaattcctgcttgggggcccaggccttctttttcaagggcttgcttgtgaatgcccaaccaaaaaaaaggggcccccaaggcccaatcccttacttcctnggtccccccaaaaagggatnccaanttggggaattgggaaaacttgggcanncacccnaancccactttggtagganttnaccaacccaaccaacccaaaaccancccacccaaattnaaaaaaaggccaaaaccaccaaccaaccnaaacccnnannnnnnnnnnannnnnnnnnnnaaaaaaactttgangccttttaaaaactntttngngnggn

SEQ ID NO: 3198 - DNA, 733 bp, Homo sapiens
  misc_feature (1)...(733): n = A,T,C or G
gtnnnnttcaatgcttggctctttccnacgnaggatcccatcgattcgccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttnctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctaaaaaaaaaaantncttnnctttanaaaaaatgctaaaaaaaaaaaactcgagcctttaaaactatagngagtcgnnttacgtaaatccagacntgataagatncattgatgagtttggcaaaccacactnnaatgcagtgaaaaaaatgctttatttgngaaatttgggatgctattgcttaatttgnaacccttttaagctgnaataaacaagttaacaacaccaatggattcatttatngttcangttcagggggaggtntngnagggtttttaattccgggccnnnggnccaaancattt

SEQ ID NO: 3199 - DNA, 870 bp, Homo sapiens
  misc_feature (1)...(870): n = A,T,C or G
nagttaanagtaggtcttgtcttttgcaagatcntancgattcgaattcggcacgagtatataacaacttttgctttcaaagttgggtgggactagancncncantggaaggntggagtcagganacctggattnttgngcccgntntggnttttacagtntgcctaantttntgcagtnacttcntgccancctgtttcnttacntncaanagggaaagacantccttggccagcctagttttnagggtgaacgaaaggtcnttntcactgcntcctctagtcatttgcttcttcgntaattaacacatcttgagcacctgcnatgttccaggaacaggagatggcancgtgcaagataaagtccctgacttctagagactgcatgttagtggcaatcggcgtntacccggccttnaataaactactgaatgaaggaaaattctacctacaccagacacaattactggggtttctaaaatggaattattcccccggccccntgcatccagcagcctgntgcagggaaactcctccnaaaggcttgtaaggcaaggaanccgggacaatggcntggctatttaagcttncaacaagatggttacccctaagtncctaattccctaacaccaagggggccctttaccaggaaaccaaaaccaggttaaaaaaccccaaagttgggnaaaaagccatttgccanccggggccnttttaaaaaaaacctttnaaaaacctttcccttttaaaactttaccttcaagntaaaantttaaggggaatgggnccaanttttttaaccanccccaaaaaaaanttnggnaattttttttcccnaaattttttnaanttccccaaatttnggaaaang

SEQ ID NO: 3200 - DNA, 733 bp, Homo sapiens
  misc_feature (1)...(733): n = A,T,C or G
nagtttaanngtatgtcttgtcttttccaagatcctatccgattcgaattcggcacgagaagtgtcagttttcctaatctcagtccaggtaggatttaaaaantntctcaagtgttgatgctntccaagcntgttggggtggaagggaattggtgcccagaaaatgggactggagtgaggaatatcttttcttttgagagtncccccagttaatttntnctgtgcttnattgctnctgtnctttattgtgaatgttgtaacattttaaaaatgttttgccntagctttttaggacttggngttaaaggagccagtggtctctctgggtgggtnctataatgagttattgtgacccacagcttgtgtgggaccacatcacttgttaataacacaacctttaaagtaacccatcttccaggggggttccttcatgttgccactcctttttaanggacaaactcaggcaaggagcatgttttttngtnatttacaaaatctancagactgtgggtatccatatttnaattgtcgggtgacacatgttcttggtaactaaactcaaatatgtctttctcatatatgtgctgatggttttaataaatgtcaaagttctcctgttaaaaaaaaaaaaaaaaaaaactcgagcctttanaactntntgagtcgtntacntagatccngacatgataagatcatgatgagtttggacaaccncactngaagcagtgaaaaa

SEQ ID NO: 3201 - DNA, 748 bp, Homo sapiens
  misc_feature (1)...(748): n = A,T,C or G
gatgccggttcctatgatgngctctcggcttcctaggagttccaanactnggctngcncgaggncttntaaatatatctnggntttantaggtgataagtnctgtcanttagtancatctgaaaaancagctttgtcctgggtgaaaaaggatgccaaaattgcctggaaaagagcagtganaggagtccgggagatgtgtgatgcntgtgaagcancattgtttancattcactgggtctgccaaaaatgtggatttgtggtctgcttagattgttncaaggcaaaggaaaggaagagttctagagataaagaactatatgcttggatgaagtgtgtgaagggacagcctcatgatcacaaacntttaatgccaacccaaattatacctggttctgttttgacagatcttctagatgccatgcacactcttagggaaaaatatggtattaaatcccattgncattgtctaacaaacagaatttacaagttggaaattttcctncatgaatggtgtatctcaagtttacagaatgtcttaatcacagtataaaattctctgngcatgcctgagtctcagcgccaaaatcctcctccgaagtctgagaaaaatggtggcagcnnccccanaaagtgatgttnggcnccagattaccaggttaacttcctccagaatnccagtcaccactgnactggntagcanatcttgccgagccaaaaagcccnaagngggaaaaaaaaaaaaaaaa

SEQ ID NO: 3202 - DNA, 748 bp, Homo sapiens
  misc_feature (1)...(748): n = A,T,C or G
ggnnnnngnnngntnncgttccctattantcaggngctcgntctntctcnannnancnnggcgtgtncgaattcggcacgaggattttcgaaactcttcagctacttgcccttttttatctgaaaccatcataccttctgaaagaaaaaagcatatcttcattgacataacagaagtgagatggcccagtcttgatacagatggtccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggaggggaagaactgccttcgcctggtacaaagcacacatgtgtatacacatgggtcaagcagtgctggtctgtggctgnctgtccagangaatggaaatatccttggctttagcacttcattttcataataaaatcagcaattntgtctaaaaaaaaaaannnanaaaaaactngagcctntanaactntagtgagtcgtattacgtagatncnnacatgataa

SEQ ID NO: 3203 - DNA, 780 bp, Homo sapiens
  misc_feature (1)...(780): n = A,T,C or G
ctaaatgctttggganagnnncccctttgaancctntnaaatcctttggcaanttgcnctcnctgtnggatcccatcgattcgaattcggcacgagagacagggagaagagaggaagagggagctgcaggtgccagaagagaacagggcggactctcaggacgaaaagagtcaaacctttttgggaaaatcagaggaagtaactggaaagcaagaagncanggtctaaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctacngggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaaatttncaaatgtttaagggattttcatatctttcttaatgctgatttccaatttggattccctacaatgattctgggattcatctgctctggac

SEQ ID NO: 3204 - DNA, 796 bp, Homo sapiens
  misc_feature (1)...(796): n = A,T,C or G
tcttttaatgctttttncaagccttgtttnaaatcctttgcaggatcccatcgattcgaattcggcacgagactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcaagagacgcaagggagaagaaatcataacacccccacccnaacaccnncaagacagcagtcttcttcacccgctgcagccgttncgttccaaacagagggccacacagaataccccacgtttttatataaggaggaaaaccggnaaaanaatttaaaagttaaaaaaatancctttcngttttacactactgntgtagactcctgntttcttcaancacctgnagattcttgatttttttgttgttgatgntctctccattgcttgtngtttgcntgggaanttttatttaaaaaaaaaaaaaattcttgtgagtngactttggnttttaaaccantgntagattttaacngnacccttaatgggttgtacntatatgntttnaaaacatgnnaanaaatatttaatgtaaaggnnctgttnntaaatntaaccacntanagaanttnnaaannnnttnanccctttagaacnattnntgng

SEQ ID NO: 3205 - DNA, 769 bp, Homo sapiens
  misc_feature (1)...(769): n = A,T,C or G
ttttaatacntttttnaatncttgcttncgntcctttgcaggatcccatcgattcgaattcggcacgagagcaattccactcctagctccacccacaggtaattgaaagcaaagacgcaaacagatgcctgtgcaccaaagttcacggcagcatccttcgccatagtggcagcatccgtcgtcacagcggnatcatccttcatcatagcggcagcatccgtcgtcacagcggcagcatccttcgccacagcggcagcatctgtcgtcacagnggcagcatccttcgccaaagcggcagcatccttcgtcatagcggcagcatcctttgccatagcggcaaggtggaaaccctgtccatccactgaggcgtgcatagactaaacatggccagtccaggcactggaatccaggccgtanaacggngcccacngtcaaaaggaatgagaccctgatgcactgggcgacacagacgggcgacacagacttggagacatcatgctaagtgaaaagccaggcacacggagcggacggggtgatcctgctcacgtgatgtgtcccgaatgggcacnttcagaggggaagaanggagatggcgcttgacngtgnccgggacnggggttgggagcgaccggttgttggtttngggtttctttctngggtgaaggaaatgtttttgatattggggccgtttgggtgatntttgcattaccctttgaatatgcttanaacccnctagaaattgnnacactttttaaatngnttggaaatt

SEQ ID NO: 3206 - DNA, 749 bp, Homo sapiens
  misc_feature (1)...(749): n = A,T,C or G
tgttctaatactaggtntactcgccttttgcaggatctnatcgattcnaattcggcacgaggggtcctggtgggagtnncatncagcagnganngcattctttccncacancagtnaacggtcttattaanagccaccactttnctgangcctgtacaggccttgnnggttnggngaacagaaatnncgcaggcacttgtaccttcaagnanggacttgtgcctnactgnnagggttggcgttgaccttggctcnacngacatacccantctgacttnnaacgngcncgtctnagcttacgctagactgcacnnccaagnttgcangcctnttntgncttccctgcattnaccaatgacagtacgaccaacagtcaangaaaagtgccaagatatatctatcccatttcttctacacctgtanattcctnactatgctcaaactatgtggngcaangaanactggnngacatttttagtcaatgatgctgacaattaattactggtgnggccaggcatatnttcacggctgcttgtgatgccaacnaagaacgggccccagcccatccttactcctngnccccaaanagatccagtgngaatgggaagctgnnannaccaacccaactnntgatttaccaccaacnccaaanatcacgcatgnnnacagcaaaacaacaacncnatgcacttaacaagnanccnaaaantnaactcgngcctctaaaactattngggantcctttanct

SEQ ID NO: 3207 - DNA, 848 bp, Homo sapiens
  misc_feature (1)...(848): n = A,T,C or G
gnatgncccgatttccttaatgatggggnnnnnnngagcganncttccgaaanttccaatannctgggngntcgcaactcnctcnanacagnaaggncgngggctttgctctctccattccaagttgntctctgttctagaaagcagatgtagtagacatctactgttgttgcctgaacagaatccctttgtcctttttttgntaaaagtactcatccctaatattcattgtnctggaaggactgaaaatacagaactcacaccatgatcggccgggacaatcagattatttcattccncagcaaacggagatcganccgaaaagtggaaanatgagcncttctttggngttggcatatggaccctgagagaaagaactntnattntttctcttggactgcaataaagtatagctgcctaaaatacgnttcctgacacttggaggnttgtccacaatcggngaaataaaggcgagaccgnacactggatgaaaaaaanaagnnnccngnngaanacccactnnnccannnnccnnnccnntncnccanngnnganccnnntanccgnnannaggccnnngcnntngcnncnnngccnnnnnnnnnngggnaaacccnnnngnnnnncnnnnnnnnnnncnnnnnannnnnnnncnncnngnnggnnctnnnnnnannnnccccnncnncccnncnccnnnnggnaannccnnnnnnnannannnngggnnnnnncnannnccnnnnnnnncannncnncncnnnnnggnnnnnnncnnnnnnnnnnnnnnncnngngnnnacnnnngngnnnnnccnnnnnnnnnncnggnnnnncnnnnnnnncccc

SEQ ID NO: 3208 - DNA, 770 bp, Homo sapiens
  misc_feature (1)...(770): n = A,T,C or G
tgggnnngnnccnaangcnggggannnggtccccgttccaanactggaanncttggcanncgaactcgctcnannagnaaggccgggngaattcggcacgaggccccgctccatgagcagtgactccccagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattggntatgtgaaaatgcagattcactgagccagactaaggcatcagtgactggtcctctacctgcctctcacatggagattgggtattcagtgaaaggctgatcaaagacccaaaggaatgcaacagtttatctcttatctacctatgacctgcganctgccaccacccccagntggngcgcctttccagacagaaccagtgtacatcttacacgtattaaatngatgtcccnggggctcccnaanangnatcaaacaagcngggcctcgaccaccttgggcacatatcccnanggacatcannctggaggctngngncactggcattggccctnaccctnggcaaaataaaccttctaaaattggnaaaaaanaaanaanaaaaacctngnnccctntnanaacnntacg

SEQ ID NO: 3209 - DNA, 727 bp, Homo sapiens
  misc_feature (1)...(727): n = A,T,C or G
gtgatctttntgagtgggggccntnctngctctannanataggttnggngggctagcgatttctacctgcgctactacgtagggcacaagggcaagtttgggcacgagtttctggagttcgaatttcggcccggacggaaagcttagatatgccaacaacagcaattacaaaaatgatgtgatgatcagaaaagagcttatgtgcacaagagtgtaatggaagaactgaagagaattattgatgacagtgaaattacaaaagaagatgatgctttgtggcctcccctgatagggttggccgacaggagcttgaaattgtaattggagatgagcacatatcttttaccacatcaaaaataggttctcttattgatgtaaatcaagtcaaaggatcctgaaggccttcgagtattttactatttggtacaagacttgaaatgtttagttttcagtcttattggattacacttcaagattaaaccaatttaaattgtatgttttcaagctggttgnatatttaattaaagggatgggaaggggttatttgtcatttacagtattggggttttatgaatgtgaagcaaccaaaaaaaattnnaatgtaaaactggaaaataggaaaattcattancagcttaatgggtatccttacttgatncnctgggtttggaagtccccacacacattaaatctgtaatgaaancncttttggttaaaatttctctat

SEQ ID NO: 3210 - DNA, 744 bp, Homo sapiens
  misc_feature (1)...(744): n = A,T,C or G
gnngctancctttcctattannttgganctntnttctntctncangtancnnntgcgntgncgaattcggcacgaggattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgcagaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagangaatggaaatatcctttgnctttagcacttcattttcataataaaatcagcaatttgtctaaaaaaaaanananaaaaaaaactcgagccctntanaactntngtgaggccnanttacgttgaatccagacntgattat

SEQ ID NO: 3211 - DNA, 753 bp, Homo sapiens; identical to SEQ ID NO: 3194
  misc_feature (1)...(753): n = A,T,C or G

SEQ ID NO: 3212 - DNA, 763 bp, Homo sapiens
  misc_feature (1)...(763): n = A,T,C or G
ngggtgnnnnnntttctaatnctggggnncnntnnncnnnntttcctaatncttaggngctcgttctttctccangcagnnnngcgtttcgcgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcangaaggggtgtgctgagttctataatataagctgccatatattttgtagacaagtatggctcctccgtatctcctcttcctaggagaggagtgtgaacaaggagcttagataagacaccccttaaacccattcccttttccaggagacctacccttcacaggcacaggtccccaaatgagaagtctgctacctcatttctcatctttttactaaactcaaangcantgacagcagtcagggacagacattcatttcttnataccttcc

SEQ ID NO: 3213 - DNA, 819 bp, Homo sapiens
  misc_feature (1)...(819): n = A,T,C or G
gnagnncggnttcttatgatcgtggctnctcntctannggttgtgtaatgctnggtcnncangannnnntgcganncgaattcggcacgaaggggggttcccaatagtagaaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatcacatgcacacacacatacacacactggcccctgtttttctgtggtgtcactgggtgccagcaactcggtatctnccaccttccactaaaacctgggccttaatttctctcccgtccccacccctaaattcctgatggatgaacctagagctgtcctgtccactccaggccggactgacgtancctatgggcccagcaggtccagggcccacgttttaatttctttttnaaaagctttaggtcttggccnggccgccggtggttcacgccttgggagttcccagcatttttngggaaggccnaaggccgggttggattcacaaaggtcaagcaagtttcaaggaaccaagccttgaaccaggccattgggtgaggaaccctgggcttnttactngggnaaattcccaaaaaaaaattggccttgggccnaagggtgggcaagggcacccttgttggggtccccaaantttacct

SEQ ID NO: 3214 - DNA, 819 bp, Homo sapiens; identical to SEQ ID NO: 3213
  misc_feature (1)...(819): n = A,T,C or G

SEQ ID NO: 3215 - DNA, 844 bp, Homo sapiens
  misc_feature (1)...(844): n = A,T,C or G
nggnnnttnnnnnnnatnccntgatcgtgtntcgttctttctncaggatnnnntcgtttcgaattcggcacgaggaaaagggagccgcgcagngcctacgggagtncggcggcagcagccggtaccggcaaccacgggcagctctcagggaatctccgtcgttgaggccanaggctccagtccccgcgagtccagatgcctgtccagcctccaagcaaagacacagaagagatggaagcagagggtgattctgctgctgagatgaatggggaggaggaagagagtgaggaggagcggancggcagccagacagagtcagaagaggagagctccgagatggatgatgaggactatgagcgacgccgcancnagtgtttcagtnagatgctggacctggagaagcagttctcggaagctaaanggagaagttgttcaagggaacgacttgantcanctgccggnttgcggcttggaaggaaantgggggggcttgaanaagaagcccctggaatnccaccggaagcccccttttgggggggggccttgcaaaccgggaanccctttnaaaggaatttcngccantttcaanggttgggccaaggggaatcntaccnaaggggccttctnggccttggnatggtgaatccanggnaaattaaggtncccaattgntgaanccttccaangggaancccaaaccagcacccttgnaanaagttgagaaaacttgcttgcntcttntgacacccctncnagggggaacttcaaggaaccggttcctnaggcttggaaggaggacccccananccctggancctaaattnttaaatgggtnggaccaccn

SEQ ID NO: 3216 - DNA, 753 bp, Homo sapiens; identical to SEQ ID NO: 3194
  misc_feature (1)...(753): n = A,T,C or G

SEQ ID NO: 3217 - DNA, 754 bp, Homo sapiens; identical to SEQ ID NO: 3192
  misc_feature (1)...(754): n = A,T,C or G

SEQ ID NO: 3218 - DNA, 761 bp, Homo sapiens
  misc_feature (1)...(761): n = A,T,C or G
tggtgccggttcttantctgngctctcgtcttccttcttatacctgggcancncttggcggccccnaggntcccangnagccnngcngngncngattcggcacgagattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtccaaactatggtgaaaagtgccagtggtagtaactgtgtaaagtttctaattcacaacnttaattcctttaaaatncacanccttctgcctctgnatttggaagttgtcagtncaactcatcaaagaaaactgcctaatntnaaaatcatattntgggaataatttccctcttttgtagtctgcccaagatccttaaagattggatttttattactatttaaaccagtggattaatn

SEQ ID NO: 3219 - DNA, 813 bp, Homo sapiens
  misc_feature (1)...(813): n = A,T,C or G
caaaancccttttgnaannnnccnnagnnntttnatnncctnnttgcaaatngcttggctactcgttctttctgcaggatcccatcgattcggaattatagtattgacgtgaatcccactgtggtatagattccataatatgcttgaatattatgatatagccatttaataacattgatttcattctgtttaatgaatttggaaatatgcactgaaagaaatgcggcccatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgtttttaaccctcttctgcaagtttgttgacctacatgggctaatatggatactaaaaatactacattgatctaagaagaaactagccttgtggagtatatagatgcttttcattatacacaccaaaaatccctganggacattttnangcatgaatattaaacattttttatttcaagtaaccttttccccctgtgtaaagttactatgggttggtggnacnaactttcattctatagnatattaagtgggaaagtngggtgaaattctacnttttatggttnggagtgggcccaatgtctatcaaggagtgnacaaattaann

SEQ ID NO: 3220 - DNA, 776 bp, Homo sapiens
  misc_feature (1)...(776): n = A,T,C or G
taatgctggttactgcccttcaaatccttgcaatcccttggnaancggnccngcngacccatcgattcgaattcggcacgaggttatattaaattattctttgntnttctttgtcttttaataaagcctgcaagttactaaattgnagttncataaattctgtagtnaagtatcatcttggcagngtgccaaaggtgaaaangntgcttnctctaacagagaaattcttagngactccagtcgtanaaaaacgtctttacaacctgaataagatngangaattgngaacataccatggcctattggatgaatcatttgccggnggctanancagactgtagggtttgtgatggatntatggagtatgtgggtatagaaatcatgaatntnccatttgnnnncagagattcaagcntanacttaatgggtagatcataaatgacagaatgaattcaaaacctagcacgtgcattgtaaatgtgtgcccagatatgtnttggaaatggcagntccttggggtcatgtntctactggcaaaatttgctatagngnnactattgnantgtaattataaaattnatcannattatncaccgattngccaagtaaactgtactgtncataggaattttgggaattgtgcanaaattggatcaattgaanttnagaacngatgtctgggcttaaaaatttatcngggaccacnnattangaaactnacatntttcggngctgaggttcattgnccaaggccangaaggtntttnccgaaaanc

SEQ ID NO: 3221 - DNA, 715 bp, Homo sapiens
  misc_feature (1)...(715): n = A,T,C or G
ctgctgtcaaggcttgaagagccggcacactcaatggcaaacacangcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttnaaaaaganagaacatgggtggtacattgaggagtatttacattttataaaatgacttaaaaatttnaaggcattttttgagcatttncaattatatggaagnagttacttttacggaatagttnttgctcatggaactcanaacagatgaagcaccactgttacagaattaatgtgctccagaatgaaaatggtctcgtttctngtgaatttcaatggaagaagcncnacatttcctnaagaattcttttgagcccagtaattcantcctggctcaaaaaaangntnnttnggcattttcctaacatctggaccaaag

SEQ ID NO: 3222 - DNA, 715 bp, Homo sapiens; identical to SEQ ID NO: 3221
  misc_feature (1)...(715): n = A,T,C or G

SEQ ID NO: 3223 - DNA, 786 bp, Homo sapiens
  misc_feature (1)...(786): n = A,T,C or G
ttgtgaancccttttganacccntttgctacttgctctttttgntggatcccatcgattcgaacgttcccccgctacatagtctttcttttgtgttatttagtttaccatttcttttttccatcttgttataacctccacgagttgtgtctcttttgttttctacattatacccaacggctagcacataacaggcacccaatatatactgaacgaactaaggaatgaatgaaggaatgaatgaataggtggcttataggaaacccctggggccagggactctgcaacatcaccatgtaactttttctttgtgctgagaagcagagagaaacaatagaagatatctcttaatctctcaaggatgctactcccaggactgcttgcaatttccgaggagataagccacaagttacagaaaggaagcagctgtgtagggcctgcaagtttcctgctgcaagtcaccctatgttcagaagttaccctggctgggccaggcatggtggctcacgcctgtaatcccacactctggggaggctgangcaagtggattgcttgagtccaggagttttgagaccagcctgggcaacatggagaaaccccatctatcaaaaaaattanctgggtgtggtggcatgaagcctgtaatacccagcttccttgggnaaggcttaangtgggnagaaatnaccctganccccangggggtcaaaggctgntnnttaagccaagatcacngccnactggaccttnaagccctngggcaaacccnnaattnaganccctntct

SEQ ID NO: 3224 - DNA, 769 bp, Homo sapiens
  misc_feature (1)...(769): n = A,T,C or G
ggatcttttatncctttgnaatcccctnnctttggcnaatcgcccgaattcggcacgagagttggagaacattatgctggagagagnttttnaagaaagggagatgttggaaacttcncaagctgctgctctgtttctgcccaaccgcatggtgcctggacctgactacaattcctacaaaagtgcctacagccccagcccagtggaaccaccaagcaaggacttctgtaattntttgcccacctgccttgatttaaccatgcagtattcagggtctgggaatatggaactaatttcttctaatgtcagcgtggccacaacttatagacagtatcccttgtcctcaagatttttaagtttggcccaagtgtggccccattagcgacaccctcctctaccagcaatgcctgctaaatgccaccacctcagttcaagccctgaagcctggggccagctgggacttgaagggagcacgagtccaggatggactcagtgcatagcaggacatgatgccatnnaaattggaaggttccctggtgctgcctcacacttcctgagatccagaccacnagaaagtgaccttcanggtcatcangctgtcccagagaggtccgcgttnttccnaccccgaccgggaatttctcttcccattgttgacaccngacttccntggcancttcaaaggggcattntcttaaccgaagattcannnaaanctaaacaccanngcacccctttggcnacttaanccattaaatccaattccncn

SEQ ID NO: 3225 - DNA, 915 bp, Homo sapiens
  misc_feature (1)...(915): n = A,T,C or G
gnggaggggngggaagnggggngcagnnnnncnaaaacnnnngcacancaancncnnangaacncnnncagnncncnncgnanacancaangngnaaccctttcaaancgcttggcaaatcgcncncgctgnaggacccacganncgcacccagccnnctcctccaacgccctnnngatccaagatngagtaagagacatnggcagatgcngagaaggncaacccaatngtnnnaacttgcagaccgagggggagatgggntncagtctgcacatgactcgagcacagnccccccaccccacccngacttanaaaatccaaaccgactacaagaccagaaacaaaccacatgccagtcgcccccttgactgtacacacatgnggagnncagagccacccatngagagaggctgctcagctcagcaccctgngcanggcttcctagaactancncagancgggggannccntancccgtattcngggnagctgacnacaggatgcacgnagtgaaacccangggttaggggagaggacccaccctggnaaaaagccacgtaaaatggnacnancnntccanggcanccanggnccnactacantcncnagcacctccgngncncaanccgnantcnngagaaanngnntannncncangagnnncccggannncngnaatggccagnnaagctgnnncccncnggaacnagnnaacgnnnnggcntatccanngtcgacncctnccnggncgccanctcccaaangncncgaacgaggcnnngncagaananctctgttaaaagaacaccgancaggcnaaggccnccacttgananncctcnaggnanccgggnnggagaaanctnanaangantatnanactnggnaacnnnnanagcctctaaaaaaaaaccg

SEQ ID NO: 3226 - DNA, 769 bp, Homo sapiens
  misc_feature (1)...(769): n = A,T,C or G
agnntnnttnnnnntataaancctntggaactncctctttnngttgatcccatcgantcgaattcggcacgaggcaaggttgtgacattgtcacttttttgttctagactcttttaaattttctgcatttgcctgaaaagcacccctgtaagaatagatttctcatggctctaaaaattattcccaagaatnccntacttggttcaaaagcagactgtttctcttcatttcatctcaaatcagacttctgggcaagatgttctttagagtaagcaaacctacaacctaaaaatctcttcaagaggcatctctggtcttgtgacaagacctcttcaaaaacccacagtaaaactcccctccctccagttggccaccagtctgccaccaaacatgaacaaattctgctgctaatcggtttcccttgtgatctggttcctgaggtcttcggatctgtgcaatgaattatttattgntttattaaaccgacagtggtgtcccagagaggaaccataaataaaatggaaatctggtgctgtgataaagtaataactagcattaatgagacctggttttcctttcagaaagtccagtatacctgtaacaaaggttaaagcaatttatatttaatttgcattctgatgttaacatttaaacagcaattctnacaaaaaatgcatcgagtctaattcttacctctatcaaaaaacaactgnntaaatttatgaccaacatttaaacnaaaaccaaaatggaaaattttctttttnnn

SEQ ID NO: 3227 - DNA, 778 bp, Homo sapiens
  misc_feature (1)...(778): n = A,T,C or G
atcnatccntttctttatagcttngttnctngttctntctgcaggatcccatcgattcgttagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcacaagatggtaaggttcgaatctttcgggtgatgggagttaagtgtgaacaggaactgggatttaagggccacacttcangggtatcccaagtctgctttctnccagaatcctatttgctgcttactgganggaatgatgggaagatcacgttgtgggatgcaaacagtgaaanttgagaaaaaaaccagaagaagtnccacaaaaaccgtaccccncaggaaggaaaaccctaaaaananggaaccttgcacccnanccngggntnggaaaatacctaacccntttnntnacct

SEQ ID NO: 3228 - DNA, 813 bp, Homo sapiens; identical to SEQ ID NO: 3219
  misc_feature (1)...(813): n = A,T,C or G

SEQ ID NO: 3229 - DNA, 818 bp, Homo sapiens
  misc_feature (1)...(818): n = A,T,C or G
gnnnnnnnttnnnnntttgcaaatnccttngnaaannnccnagnnntttnanncnttntttcnaatnctnggctactngttctttttgcaggatcccatcgattcgaattcggcacgagagnaatcaatatcttgaaaatggccatactgcccaaagtaatttgtaggttcagtgctatacccatcaaactatcattgactttcttcacagaattagaaaaaactactttaaatttcatntggaaccnaaaaaagagcccatatagccaagacaatcctaagcaaaaagaacaaattttgaggcatcatgctacctgacttcaaaatatactacaaggctacagtaatgaaaacagcatggtactggtaccaaaagagatatatagaccaatgaaacagaacagaggcctcagaaataatgccatacatctacaccatctgatctttgacaaacctgacaaaaggaatggggaaaggattccctatttaataaatggtgttgggaaaactggctagccttatgcaggaaactgaaactggaccccttccttacactttatacaaaaattaactcgattcattaaagacttaaaagtaagttctcaatgtataaaaaccctggatgaaaacctaggcagtccattcaggacatagcatgggcaaatacttcatgactaaaacacccaaagcaatgtcaaccaaaagccaaaattgacaaatgggatctaacctaaactaaaaaacttggtgtgcagttttattttgggantgtgtgtgggggtacctctgagttttcaaaaaatgaagaaagtaagtcc

SEQ ID NO: 3230 - DNA, 789 bp, Homo sapiens
  misc_feature (1)...(789): n = A,T,C or G
gnttgaanncccttngnnttcaaatngattgttactngccttntgcaggatccctcgattcgaattcggcacgaggatagcttaaagcaagtttacaagtaattaaaatggacagtttgccattaaagatttttaatagtggttttgcagtgtactggcttgaattttctggacttgagttaactgaaggagagcctcaaacnntagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaaattttgagacactggtttaaatggaaaatggatataaggnatgtataactggggggtggggtgagggtaggaaggcatttaccaactnagattttatttatttttgaaattaatcaattggnttaaatcctaatttatttacccaaataggggtcttttaaaaaaatattttttattcc

SEQ ID NO: 3231 - DNA, 789 bp, Homo sapiens; identical to SEQ ID NO: 3230
  misc_feature (1)...(789): n = A,T,C or G

SEQ ID NO: 3232 - DNA, 766 bp, Homo sapiens
  misc_feature (1)...(766): n = A,T,C or G
ggnnttnaannngctctactgaatgcctttggaaaggcccccatcgtttcgaatncggcacgagctttagttcagataaaggaaacatccaaaaatactgagattagtaaaattttattcaaagtaggttccngctttgtcttgatctcaatccattctaactcctgatgtcatttaccgtgtgagatcttanncacaatcatgaaaagaatatgagcatttatcaaaactctctgacatctgtatgtttagaaatgaacttacacagcaaaatatgatttccttgcacttatttaatttttctaacttcaatttctacctatgtgtctctgccagtttgacctgattcagacacccagaacttgaataaagaagccctcttctattttcattcttaatgaatataccttttcccatgtccacattgagcctcccttctgngtactctgtctaatgcagccacatgtctagttccccctctctgtcaccaccctcacttcttctttcccatcttcttacttctttggtgtgacctcttgtaggacaacatgccatttctgattccccacacacataccctatcattgatacctaccctcaggattagattctgtctaagtaatttgtagagccatcaggcttnantaagtattgggactgcaagtcaacacccattatctcatcaaaangggatgctgtgttggggccaganggagaaangagagagagagactnanagagagangnccnganagagagnaagacn

SEQ ID NO: 3233 - DNA, 831 bp, Homo sapiens
  misc_feature (1)...(831): n = A,T,C or G
gaancccttggntttgangccatttttaatnccttggnntgnnccctcgattcgnnccggcncnaggctcngtacagatgnntcttatcctgacntnacgaangncttaactgncnnntntatggtgacngtnnntgaggcngnatgncnnggancanannctnaanctgaaaggnacctagtgacganngctncgnnntccctntgcaaactggatacggtannggaanagggagcctctgtgataaacgagacgaggaggaactcncngacatatgagctcaccaccacactaaaggnactgtgcatgnctgctgacngggttcnatagcgctcaangaccagnatngacnnggacgatgagttaatgggnactagggcncaantgtgcgatcanagaannttcncnaagctcngcncatccttgganaacnntttgctttanaacancnnccttncgtgnctacncacancctatgcnacagactnnatnacctgaacaanggtttactcaagnnagacngnnnncctacgnncancttagnnnccagggaaccnnnntgncnttacaangtngntnnangtcctnagntgagcatacnacccagntggganctnctgacnagtttcctncanactngtcnccngagtgggaacggccaagatnaacccnnngccaaaacttnttacgacnttggncnnttcaaagatcaaggggggnatttaanaactngaancctntannccnnttcnnaanntncttttgnngacnttagnanangggntgancccgggcnatntntcaaaaatccttnttanttcaccnntgcc

SEQ ID NO: 3234 - DNA, 772 bp, Homo sapiens
  misc_feature (1)...(772): n = A,T,C or G
gnnntttnnnnnnnnnntttncaaatcgctttggctactnggntctttttgcaggatcccatcgattcgcagaggctttgctagtatccttcaaccaatttctagtaaaaatatcctatataaccataattatcaaaaccagaaaaacaacattggtaggatactataaagtactaatcttattttggatttgacgaattcctacatgtttntttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgntttattatttttttttaccaccatgtatctaaccagatgaaagttgtttatatttgagagtagtatacatatttgatgtagtagtttatccatttcacctatgagatatatttgcactggttttcctgggtttaagtgctntaaataaagatgctgtgaaatctaaaaaaanaaanaannnnnnnnttnnnnnannntngnnatatnataannnnnnnccnnn

SEQ ID NO: 3235 - DNA, 790 bp, Homo sapiens
  misc_feature (1)...(790): n = A,T,C or G
tccaaaatncccttggantnattcccccttncaatacctttccttngnacactcccngtttngntngatcccatcgattcgaattcggcacgaggnaacaaagaaggaatgtcttcctcatgtttnggtctatagaagacgttaaagaaaacttccagaaagtgggtttgaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaaagtnaatgccatcaacaatggatacagaangacctggatttggaataagggcaaaaatttattttgatggggctgaattgctctgccagggagcattttgggtattgagatgaaaatggcctctctttgagactgagctgccacctggcaaattattgnctgcttaanggttctctttatn

SEQ ID NO: 3236 - DNA, 781 bp, Homo sapiens; identical to SEQ ID NO: 3138
  misc_feature (1)...(781): n = A,T,C or G

SEQ ID NO: 3237 - DNA, 764 bp, Homo sapiens
  misc_feature (1)...(764): n = A,T,C or G
gtnttnnntttctttctaatagcttggatactcgttctttntgcaggatcccatcgattcgaattcggcacgagccaaaatggggtggggccgcagtggctcacgcctgtaatcccagcactttgggaggccgaggtgggcggatcacgaggtagggagatcaagaccatcctggctaacacggtgaaaccccgtctctactaaaaatacaaaaaaaaaacaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagacttcgtctcaaaaaaaaaaagaaaataggcacaataagtaatacatttctgcccaagtaagagccttcccttttgtggatgtaatgaaaatatcttcaagcactttataaatnaattatatgtctgatactagccttccattgcctggatcacatctgattgtcctggtaatttnagaaaagggtagccccttggtatggatagtagcttgatgacatggaattcagggaaaagactatgatggtgtcacttgtaactgcttttgtgctgtaaaattgtcatngattaaagaanaanaattngcttggntgcngtggcttacacctntaatcctancacttttnggaagccaaataanggacttgnttgganccangantttcangaacaacctg

SEQ ID NO: 3238 - DNA, 764 bp, Homo sapiens; identical to SEQ ID NO: 3237
  misc_feature (1)...(764): n = A,T,C or G

SEQ ID NO: 3239 - DNA, 768 bp, Homo sapiens
  misc_feature (1)...(768): n = A,T,C or G
atggctttggnnagntccnnntctttcaaatncttggctactcgntctttntgcaggacccatcgattcgaattgtaacttattccaggataaatgtcatatgcatatgattttcatatgactttgatgagtatcttcagggaaaattcctaaaaatgaaattgctggattaaggggtaaatgcatgtatagttttgttagacagggccacatacccttccttagaggtagtacccttttgtattcctgccagtaatatatgagagtccacagagtatgtggttaagctttagaatgcttgtccatctgatagggaagaaatcgtgttgccttaatttgcccttcttttattatgaatcagattttaatcttttgcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcangttcacggggaggtgtgggaggttnttttaattcncggccgcggcgccaatgcattggggcccggtcccancttttgttccctttatgaggggttaattgcgcgcttggcgtaatcatggtcataactgattcctgggtgaaattgtatcccgctcacaattccccaccaacatccanncccgggagcataaaa

SEQ ID NO: 3240 - DNA, 957 bp, Homo sapiens
  misc_feature (1)...(957): n = A,T,C or G
annggagacnnnngngnanngngggggnnnacnnngaaanncnnanananacacannannnannnnngaggggcaacaaacncnnattttcgaaaancccttttgggngtgaccccnttcnaacacttgcttntcgccctntgcaggatcccancgnanncgaaggnggcncgaaagcacggngtcccnannngatgngnaaanatgaccgataaacttcngggncngataatgaanggcactatnggncatactgatgctgnctcatgggcnctaccanagacgngaactggaaaaggctctgcagngtctgggatacgctcagtgctgcangggagggcaggngtgaggggaatggccccgganggtgatggggcnngngcatccgatgcagcnntatagctctgnaattaccacttncaaacttntnattacgaaaaatgtcaaggacccnggaatnacaagngaggnaggcaggataatggcccccaanatgcccntgttgagacccccanaccttgagagtgcctcacatggggaagactgtcctacgtcancntgcacgcccanggcagccccangggcccttaaagcttgagagccttncctgctgagacngaganatgccagaagcaaggagaggcnagaacccgaggagggcccgcancctgcccngnatggcccttagaaggaagggcccnaannagcgtggtggccccnctaaagcaanctgngngaccnggggggaccctnangtacccaangcccctgcaaagcaaaacccngaaatttccnggccaaaccanacacccccaanggaatgngaanggaaanngngaaaaggnacncccctngaccnntgggccaaaaaccccttggaacccccctgaaaccttcnaccnaaaatngngtnaaancncccgcganngngacttnagtgngcaagcacacancccc

SEQ ID NO: 3241 - DNA, 789 bp, Homo sapiens
  misc_feature (1)...(789): n = A,T,C or G
ntgtaanccttttcaaatcccttggctacttgntctttctgcaggatcccatcgattcgaattcggcacgaggccggacngtgactctggnnacgcttgcgnccntnacgtagntngnngaccntgcanganggaanaanggctggccnncngntgtacnctnaccgtcctaaccccgcgaggtccaggnccgctcctttcggngnggattctcgcggaanatccctccggcagctctttgcaaagctgnttagaaacttctcccaaactcggcntggatacgactgctatagggctcgctgctgcttttgtggagctcttgctcctctatccttggcctctcctgggatacggcccaaggccaagtnttcacgcangttggtacgcttatttcgttctggactctgggggctntgaannttcaccacgtggactgctggggancgggntnccgancactngnntaccttacnccanaatctgacaacttttctggacaacctacccancttcaattggctngngagcncntcngntgctggggnntncngtgcaaatggagncncaattggtgggcaaatngttgatggncaaaacgggaaaaagcaacnnncaangcttttggctnaaagccgatangacncaaattanttnctttggaccttganaatttcctcaannnttttnagnanncncttttttncttgganaaanacttaaaagtgaacgattnttgggaaanaaacaaactataataactnaaagcttttntaaaaaaaaannaatnnt

SEQ ID NO: 3242 - DNA, 804 bp, Homo sapiens
  misc_feature (1)...(804): n = A,T,C or G
tcnaaatcccttttgnnagnttcncnctttgtttccctttnctnggctncttgttctttttgcaggaatcccatcgattcgaattcggcacgaggtccttttgaaccaccccaaagaactcaacatggcaaagcaaatggtaaaagcttcccgactgttctactttgggtccgcgcgaagcccactcacgtgtgatctgtgttgcccctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgntatccttcccactgtttttatcactgatttattttgtgaaaagttgtacactaatgttctatgtcaaaatcaaaaagtatttaatgaaatactagttctatttaatgtgggntatggaaccancttggaaacacaaaacaaacaggggattgtacaagcangcttggggcccaagnaaggtcaaggttcatttggttaccatatgccnataaaacctcancgaanttttaaaaaaaaaannnnnnnnaaaaaancttggngggct

SEQ ID NO: 3243 - DNA, 784 bp, Homo sapiens
  misc_feature (1)...(784): n = A,T,C or G
ttcnaatngcttgttcacgccctttctgcaggatcccatcgattcgaattcggcacgagcttctgttgattggtttgtttaaagtacctaagtactacnctttgactccctaccaaaagttcttttgttttttaaacaacttttatttgtgacttactttcttgagaagtgttcttaatgaattgcannacccantggtagcagcttatttcttaagtactttattatttgtgctttaccatttcaggttcttatctttaacccttatttactcagttttccatctgaatgatcctatctctaaattaaggatttaataaatgctgcaaattgtccactttgcaaattgtccaaaagctttagttttggaaccttgtgaactttttttttaataacacattatttgggccggtcgtggtggctcaagcctgtaatcgcagcactttggaatgcctaggcagacagatcacttaaggcctgnagttcgagaccagcctggccaatgtggngagacctncgtnctatttactaaaaatactaaaaaattagcaaggcatggtggtgcacgcctgtaatctnagctactttgagaggcanagttcaggagaattgcttngaaaccttgggaggcannagattgagcccaagaattggaccantgganttccacccctgggtgaccagagtgaagaaatcttnnctcaaaaaaaccataaaaaccctntnctntaaaatnaaaaaaaactntgagcctttttataacttnagntggagtcaggaatnc

SEQ ID NO: 3244 - DNA, 790 bp, Homo sapiens; identical to SEQ ID NO: 3235
  misc_feature (1)...(790): n = A,T,C or G

SEQ ID NO: 3245 - DNA, 784 bp, Homo sapiens
  misc_feature (1)...(784): n = A,T,C or G
gnnttttctaaatcccntttgcnttactccctctttcaaatcgcttggctacttgcnctnntngntttgcaggcatcccatcgattcgaattcggcacgaggaacaaagaaggaatgtcttcctcatgtttgggtctatagaagacgttaaagaaaacttccagaaagtgggtttgaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtccgtttatgcttttcactgttgtggtaggggctttggaagtaaatgccatcaacaatggatacagaagacctggatttggaataanggcaaaatttatttgatggggctgaattgctctgncaggancatttggtatgagatgaaatggcctctcttgagactgaactgccaacctggcaattattggctgctaanggttctctttt

SEQ ID NO: 3246 - DNA, 784 bp, Homo sapiens; identical to SEQ ID NO: 3245
  misc_feature (1)...(784): n = A,T,C or G

SEQ ID NO: 3247 - DNA, 776 bp, Homo sapiens
  misc_feature (1)...(776): n = A,T,C or G
gtttcnaatancttgctttnnnnnnntcttcaaatngttggaccccctgcaggatcccatcgattcgaattcggcacgaggtgtgcttgtgaaatgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccatangagggaagttttggaaacacagaatgattccaaggtgctctcgttcctgagggggactggtttgtaacccatgacatctgtgggcgagagaggcagctgggagcangacacttggagggtcaccccacgggggtggcacctgcactctgagtgccccccactgtcatcagctgcctcttaccgtggacacagttntggttttggggactanggggcccnactcctggtggtaccgtttggacttactagggcagtgggacatatangcccggggctagtgngataacggggagttacncctgatgactnttttgatggaatcctgcattagatagcttngtgggaccccccccctcanaatttggggaactgangagaattccnngaaggtgncnttcanggagagcacctttnaaggggccccctaacttcctgagcctggaaattagaataancattaaaggggcatacacaccttttcccaaaaaacccctntccatttggttttt

SEQ ID NO: 3248 - DNA, 777 bp, Homo sapiens
  misc_feature (1)...(777): n = A,T,C or G
gttctaatgcntngnntcatcctttcttcaaatgctgtngttcttttgcngatccctcgattcgaattcggcacgagaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagaccaataaattgtattcctacagatattcacctaccacttcccatgttggggcatgaaaagtgaacaataatttgactatagagattatttctgtaaatgaaattggtaagagaaccatgaaattncatangatgcngatgcagaaagcaacctttttgaaagtttatataatggtttnacccttcataaccagcttaacctttcactttttcttattttggatttataaataagaa

SEQ ID NO: 3249 - DNA, 770 bp, Homo sapiens
  misc_feature (1)...(770): n = A,T,C or G
gntcctnnntttcttatncttggctactcgttctntctgcaggatcccatcgattcgtagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggangaggtccaagactaactgtgaaagccctgtgtaaggaatgtgtagtagaacgttgtcgcatattgcgtctgaagaaccaacttaatgaagattatnaaactgttaataatctgcttgaaagcagcnagtaaaaggccnatggattttggggtgggggaantcccttccttgcngantttggccccanctancntctttgaacancttgntnaancaanangggnggatgcann

SEQ ID NO: 3250 - DNA, 800 bp, Homo sapiens
  misc_feature (1)...(800): n = A,T,C or G
ggnncnntttnccccccttttgaaaaccccttttgggngaancccncttctttnaaatcncttggctactcgctctttntgcaggatcccatcgattcgaattcggcacgagtatataacaacttttgctttcaaagttgggtgggactagaacacacaatggaaggatggagtcaggagacctggattcttgtgcccgctctggcttttacagtctgcctaactctatgcagtcacttcctgccagcctgtttccttacctacaagagggagagacactccctggccagcctagttctcagggtgaacgaaaggtcattatcactgcatcctctagtcatttgcttcttcgctaattaacacatcttgagcacctgcgatgttccaggaacaggagatggcagcgtgcaagataaaagtccctgacttctagagactgcatgttagtggcaatcggcgtctacccggccttcaataaactactgaatgaaggaaaattctacctagcaccagacacaattactgggtttctaaaatggaattattcccccggccccctgcatccagcagcctgctgcagggaagctcctccgaagctgtaggcaggagcgggacaaatgcttgctatcagcttcacagaatgttacctaagtactattcctacacagcgccttacagaacaaacagtaaaaaccaaatggnaagcatgcacnggcttaaaaactcaaacttcctaactactcagtaattanganggtcattttaccccaaaatagaattttcnatttatccaataanaa

SEQ ID NO: 3251 - DNA, 1144 bp, Homo sapiens
  misc_feature (1)...(1144): n = A,T,C or G
gnnnnnnnnnnnnntttnnnnnnnnntttttttgnaaaaaaatccccccnttttgggccnaaaaattnggnccctcctttttnntgggcaagggggaatccccccaaattttttnnaaaaccggaccantttttcgggggcnaaccggaaggaaaccaatttaaaggccncctctcncaaaccccccctttgggaanggggggaaattggnaaaggaaaccaaggccttttcccccctttgggccaaaggggccnaagggggccntgggttggcccccccnaaagtttccaaanttnttttnaaaaagggcccccnttaaccaaaagncctttgggggggcccttnggcccttnggggnccttggccnaanggggggttncctttggggaaaaggggggcccgggggttggggggggggaaaagggggtttggggccaaangnaacaaagaaaagtttannccaaaangnaaccccccccnaacttttncncntngggccctncntttnaacaagaaccttgccgttcaatggcccgggggccttggggaaccggcaagcaaaggcccctggcttctttctggcccnggccatgaaacaccgncatgttgggagcacccgatcacaagcgcaacaaggtagaccagctcaanggccttttggctatgtcgagatcccctgtgtggccaagaactggtgtgcngagatgaaagtctcggggccatggctgaagtggggaccatcgtggacaaagtgaaaagaaagtcctctttcancacaagtggctttcaacagaagttgacctgggatttctgtcatgggtgtccctctggactcaaaaatgggttcaaggcccaagtcggtgaanatggatgttggcaaaaataggaaggataccctcattttgctgnaatngggggaanctgctcttnaccttgcccaaggggccaaggcctggttcaggttnaaacttgggaccggaaaggcccaagtcttaatttcttttcaaaccnaggaaaaggnccgnttgccttaaaaaccccttcccaactttttcctgggatgggntgaaggcaaanccangaaaanccaagcaatggttgttcntcaacnggaaggaagggacttgaaccnaactggggaaa

SEQ ID NO: 3252 - DNA, 818 bp, Homo sapiens
  misc_feature (1)...(818): n = A,T,C or G
ntttctanncnngntttcaaatcccttgcattngcncctttgtttgatcccatngattcgaattcggcacgagagaagattggggatgaggagtgaggagantgctggagaccagttagaggctaccgtagcagcgtanagaggctgaaaatctaactagggtggaagcagccaggcaggctggtcctaatgttgggagttgttcagatctgaccnnanaggtcattacttatagagttattaatttataccccaccttaattgcaaagagattcaaagcagtaagccatcactttagaatttaatgttctgttttcctttttatttactcattcagcagctatttcaatgcctgctgtgtgccaggtgctattcttagngctttacttgttgtatgtgtnatctaatgctgtgtaacaaattactcctgaacttaccaactcacaacaacatttattagctcacagtttctgtggagcatnggatctagatgtggcttagttggggttgctggcctggggtcttctnctaaggctncaacgaaaagtngaggcccgggctgcagtnatctgaaggctctantggggcaagatcccacttcaagctcactnaatgngcngttgncntangnttagttnncttgcaatnctattnggatttggngccctaagttcctgggcatatagcccnnnnctnntatggncaaggttcacncnttgngngcanttttacacccttnnaagtcntgnanntangntgngnagnaanngaaactaaacnaatttannannanntatataaanctcnnnnncccttcc

SEQ ID NO: 3253 - DNA, 797 bp, Homo sapiens
  misc_feature (1)...(797): n = A,T,C or G
caaatcccttggctacttgntctttttgcaggatcccatcgattcggacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgnntcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccaaggctgggctgacatcaagatgggagcccagcccacgggctttataaacacccaagaaccgtttcagatcttctctggtgctgatgcangtagttttaaatttttctcaagttncagtgatagaaaacccacacaatcatcctctggccagtcttaatagaatatcagaggttnanaagggccttcanaagaacttttnacncaatgcctgcttgggggaaanggaaagttgacttaacccccgggttcaaacctggccatttnanggggaaaaaancttnaaggttcnttaccccntngnttggcatgcttgccnccncc

SEQ ID NO: 3254 - DNA, 794 bp, Homo sapiens
  misc_feature (1)...(794): n = A,T,C or G
gnnnnnnnnggtnnnntttcaaatccttgctcttgcntgtngttgatccctcgattcgaattcggcacgagggagcaaataataagcccttgtgtgtgtttttggcagaaaagccatgaagacaagcagatgctaataaaagaatctgcatctttgttngttattccatgttaaagggttgaaataaaggtaagagaatntttgtactgttgttatcccnaatccatctcctgttctactctctattcaaaataatcgtacagtgactaacagagctttcagaccaacagtattttttatttttcattttaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacaccgaatggggagaagaaggtttcatggctcatgtagacagggttatttgatttctatagtaaccagaangatgcaatactggcagctggagacaagtggttaactggttggcagaatggcatgttcctgctgctggaatggttttatggnttaaaggtnaagnctttatgntgtaaagaacctgtttgaagaaaangccgttaagatggggggntttaatgcctccctggaaaatggnttnttccgtcgntangttaannttcctagncccttcttnc

SEQ ID NO: 3255 - DNA, 794 bp, Homo sapiens; identical to SEQ ID NO: 3254
  misc_feature (1)...(794): n = A,T,C or G

SEQ ID NO: 3256 - DNA, 784 bp, Homo sapiens
  misc_feature (1)...(784): n = A,T,C or G
ctaatncttntcnntngctttnnngangatccatcgattcgaattcggcacgagagactcttcattctatcaccctgtctcacaaaagacttgcccaaggctacgaagcanggcagtgactagagtccagacatcagnaactagttccatgttntttttttcactaccagtccctaggccccaaaccgcagatcctgctgtgnngaccattaagcccctgactgttctaggctcaacttccaaccctttctgcaggtcctattacctctgcctcatcctcccaacatgataaccagagtcttccttcacattgtactgcctacccccttatgttcccaggctctcccttggttttattacctccttgcagtccattttcagatcctgtccattgatctccacccgcacaatgatcacctcataataccactcccgccggatgggtgtataccagagactgcctgtgtacaagcgagtggtcgatacctcaatgatctanggaaaaaaagangcaggtcccgtgtcctggcacagaaggagagtgagtccccaaggaccaagcaataagatcagtgatttcttggggtggcaangtcttctacaggctacccttttcatcttcctgcttntaaacaaatcatacccaaagngatttctantttcttnaatgtgttcagggngaaaagacttttccnggaatttttaatttatttggttcanaaatcatacaggccttgganantaaaggtattttaaatctaaaactggccncaattaaantntc

SEQ ID NO: 3257 - DNA, 822 bp, Homo sapiens
  misc_feature (1)...(822): n = A,T,C or G
ttnnnnnnctnnnggnntttcnaatncttgtttctcgncctttctgcaggatcccatcgattcgaattcggcacgaggattttcgaaactcttcagctacttgcccttttttatctgaaaccatcataccttctgaaagaaaaaagcatatcttcattgacataacagaagtgagatggcccagtcttgatacagatggtaccatcntntatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccangacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatgggaaatattcctttgtctttagcacttcatttttctaaataaaaatcanccaatatgtctaaaaaaaaantttnttnataataaacctngaagccctnttanaaccttntnntggaggtcctnntttaccntatgattcccggaacttggataaggaatcccntttggattgganattttgggccnaaaacccncnanncttggaatcc

SEQ ID NO: 3258 - DNA, 1052 bp, Homo sapiens
  misc_feature (1)...(1052): n = A,T,C or G
tttccctnaaaaaaattggnncccttttngggccctnaaaaattgggcccttttgggggnnnnnggccaangggaaatccccccaatnntttttataanccgggcctccggttaanttccaaagccaattttaatttaaccttnagggggccttgggcccctccccaatgggttgggttnnnnntntccaaaaaaanggccccccccnaatttnccaaaagggttnttntttaacctttttccttnaatggggggtnnnaaaaccctnaaaaattttnnnttaaccaattnacccacccaaaaaaatccttttttnnccaattttntntncctgggaaaaccttttcccctttttaatggggctttttaaccttggtcaaccccccaacttaggtantttggatggtctttaagctaanngaaccnaaattnctggatcaatttcactttgtcacatcagggaaccctatcctcttagttctcccattgagatttcactgctggactaagattattcttgattcgtagtcattggnttctgnttccattcattttcagcactgattatgttaatcgtattgctttgagttttttctttgntcaaatgttgnttattacattcattttgnttcatatacacacattntttttttttaactggcattttgaggatattggngttaatgggaaggaaaaaggaatggtgcaaaagcacatggnatttgaattccaaagaccttgaccctcangcattagcaaggtcacttggtttctgagcctcanttttcttactctcaaaatggagggtaatatcccgaaaagnactttgacaaccacaccttaaaagcctggatgcaanaatttnccttttttgnaagtaaattgnggctgggttcttaattncataatnngggataatggggaattcctanggggaattngggctattaggaatccntncnattttaaaaaatggtattttaacangccttggtaaaanggttcanttncatggccatngnggaacaatgttccccntttatgaanntacc

SEQ ID NO: 3259 - DNA, 800 bp, Homo sapiens
  misc_feature (1)...(800): n = A,T,C or G
gnnnnnntttnnnnnnnngtttcnaatncttggcattgatccnttgnttgatcccttnattcgctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaatangggaaactattcagagaaaacttaagccactaagttttatggngntttgttctgtagcagaagcataggcatactgacaatacaaaccgaaatccttctaacgtagtggaccttttcaggccagcatttttttcttgaaaacctggagcatgtattccatcttatagcagagatcactttcacaatggttggggctcttggatttggaatggatgatgtaatgaagccctcttntncagattggnaactaattactcttggggaattgactnggattccacaccccttcttaanaattntacttttnctctttttatcaaac

SEQ ID NO: 3260 - DNA, 1098 bp, Homo sapiens
  misc_feature (1)...(1098): n = A,T,C or G
gnnnnnnnntttnnnnntttttgnaaaancccccttttgcnaaatngnccctttttntggcangggatccccatntttatntcggacattttcgggccaccggaaggggccgggggcccccgggccnccaggnccgggnaaaggccccccttgggcggcccccggncggccccaatgggttccaaaaagggaaaaaaaaaaaagggggaacctgggaagttggcccangaaaangnaaaaaaaggnaagnaaaccttccgccaatgggaatggggaaaaataattttttcttgaaaaacccaaaaaaggaatggttatttttcaaatttaaaaaaggaacnttgggaagaaagaattggcttcccacncgcagaaagggcattactggctatgtcaagtaaaagaagtccttcaaagcttagttgatgatggtatggttgactgtgagaggatcggaacttctaattattattgggcttttccaagtaaagctcttcatgcaagggaaacataagttggaggttctggaatctcaagttgtctgagggaagtcaaaagcatgcaagcctacagaaaagcatttgagaaagctaaaattggccgatgttgaaacggaagagcgaaccaaggctntgcaaaaagagcttttctttcactttcgagaccaaaggggaaccagctnnaagggcnagaaaagttngaaaaaaattccaaaggaactggtggaatcccccaaaaggtttggttggggaaagaaaaattcccgccccaangccaaaatttaaaaggtttngcccccaaagggaaaagncttgncctttaacccaggaattggggaccctggganttaaaaccnataattttcccgccnaattnnaaaaaattcntttnggggnccccnaaaanggnaaaaaaattttnggggggttttggnaaggnaaaaatttnaaatttggatttngaaacttttttngggaattccccagaaagaacttttgaccttccnttngacctnaaaaattttcccttgggggggtgnaanggatgttcccaagctttgtggnatattggtaaaattttnaaccttttntncttacc

SEQ ID NO: 3261 - DNA, 849 bp, Homo sapiens
  misc_feature (1)...(849): n = A,T,C or G
gnnnnnattnccctttnaaatnccncngaaancccttggaagcactaccnctcngacccctttggaacgncgactnctnnatatatcnnggatataataggtgataagttctgncaattagtaacatcnggaaaaaacagctnngncctgggngaaaaaggatgccaaaatngcctggaaaagagcagnggagaggagtccgggagatgngngatgcatcgggacgcancatngntnaacattcactgggtctgccaaaaatgtggatttgngggctgcttagatngttacaaggcaaaaggaaaggaaagagttctagagataaaagaactatatgcttggatgaagtgtgtgaagggacagcctcatgatcaccaacatttaatgcccaacccaaaattataccnggttctgntttgacagacttctagatgccatgcacactcttagggaaaaaatattgggattaaancccatnggcattggactaacaaacaggaatttacaaggtnggaaanttttncnaccaatgaaaggggggatcncaaggttttccagaanggntcntaatcncaggnaataaaaattnctctngggcaagccctgagtcttaancagcaaaaanactcctcccgaancctgnagaaaaaagggggggcagccaggcccnnaaanggaangtnaggcccnagatnaacaangtnacctccncccagnaaaccccannccccaactggnaccngggnaacccacaacntttgcngaagnccaaaaaagnccnnnaganggaaaaaaaaaaanaananaaaaaacctnnnagcccctaagaaaccttaggggnggcccncc

SEQ ID NO: 3262 - DNA, 858 bp, Homo sapiens
  misc_feature (1)...(858): n = A,T,C or G
gnnnnnnttnnnnntttctaatgcttntnaaatnccttggnagcaggatcccantttcaaancgcttggggcctataccaggagagcggatcccagacgtggctgcattgnccatgggcttctctgtgaaagaagacctttcttggccaggactcgcagtgggtaacctgtttcatcgnccncgggctaccgtcatgggtgatggtgaagggagtgaacanancggccctacccccaggcagngtcatttcgtaccctttggagaatgcagttccttttagncttgacagtgttgcaaattccattcactccttattttctgaggaaactcctgttgttttgcagttggctcccagtgaggaaagagtgtatatggtagggaaggcaaactcagtgtttgaagacctttcagtcacctttgcgccaagctcccgtaatcgcctgtttcaagaaaactctgntctcagnttcaactcccctcaattctctgagtnggaacaatgaaagntgacctgctcntttctttctgaacngcaagtgctacaatgatatttcaagctttgctggcctcggacattaagcattntagcccaaggatcaattctncctggaattaataattccacntgggangcctggcaaggtttggaatgaaaaattggggaagcccttatgggggaaanancttttgaacaanttcaataagaatgcnttcnaaagaacccttggttgaccccnttgccaaaaantttggcaacaatgaacatngttcaagncttttatggggggggaantgccnnngggntngaanttaggcccctngnaaaaatcaattttggacaacctccccttcatanc

SEQ ID NO: 3263 - DNA, 835 bp, Homo sapiens
  misc_feature (1)...(835): n = A,T,C or G
tncctttcnaatccttnttgcangatccatcgattcggagtttttttttttttttttttttttttttttttttttttttttttttttttgaagtttttagttaattaangnncttgcgaaaaatccanaccagntttatttcaggggnnanagtnanaaancnctgcaatntgnncttaangggattcgattngaggccccccnccnggggganantgtnanccagggatacnacaaantncttggcaagtcactgganaccgacnttcntgcatttngggaaanaanctgggtttgnggnnaantaaagcattttgacnatgactgntgcctaaananccntggcattggccagggatnctgtggaacccttttttnnttnaatgggtgntgagcattaaactgncacttgttnanngnnattagannctttgatngnaacttttnannancccccgaannctggnncccctnaatntttnaattngcccctntttttccnanggggatatantatttnntntngggtnggaaaatttttanaggatnaanntcnccctttttttnttttttantcccnatcntttnnttntncttttnnncccttttttntnttgngcnnnntanaaatttcnctgtaantggattttnaattttnggnnaannnantntaanggntccctttttttnaatttnanaaaatgggttttnatnttctactcttcnancncntnnggnttttcnacntcanatgtngcnnnngnnaaaaaaantnntttnccatgggnctnnctaanataaatcttcnttnaatggtntntannntttttcaaan

SEQ ID NO: 3264 - DNA, 758 bp, Homo sapiens
  misc_feature (1)...(758): n = A,T,C or G
ctaatagcttttcattcnaatgcttgtgatccctcgattcgaattccgttgctgtcggacagattgccctagtacccacccacctatcagggttatgcaatggaacatcctcgcccaagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggaagcggtttcgatcagcttaaggcttgtggactcttcagaacctgcaaaacatnacccaaggagcccaagattncccttattgtgtgtggggacttcaatgcanaccaacagaanaaggtctncaaacactttgcttcttncagnctnaaccttganagncggcctacaagntgctgaatgcttgatgggcaatttagaacccccatacacctacctgg

SEQ ID NO: 3265 - DNA, 1050 bp, Homo sapiens
  misc_feature (1)...(1050): n = A,T,C or G
tttctaatgcttggctttgagncctctntttaaaatcctttggcnactactctgcacgatgcggcgctgacccggncggncccacacccgctctttnctcttctttgccgcggactccctttcctgcctccaagacctgggtgtctacaactgtgagcccagcttgnnccaaaggcagtccccatgggacctagactcaccttncccttgcctctatgaaaccttctgcttgggcccancccctgttccagctcccgacctgcacttccttgctgggactcangcctccaagctccctgcccagcnagcggncttcagccaccgtcttcccctttctttcgggccctgnttgtnagcanctttgcagaaacccanangggacctngtgccccttgcnaagnctgtcgccttggtgcaagactgncctgtnctgcatcattttncatggttgncgggggtgtggggntnnncnngncgnnncntgntcacaatcaancatntatncctnanntngggtatnacnaatggcctnaagantgctacntcntannnnnganttntcangnnntnttactaacntncnatngnncntnganatagncatgnantnttagtntntgatntanccncnattgcagccncataattatcctacaccacanannaanccntccttnnagaanntgncntctatgnaanagnctnnnaatgtggcnncnaatataanntnntntnctnncatcntannnnnntcctacgtnannnnncatnnncnctntnggnnactatcncatantacatcnntnannncacccatnctnntntnanatntctcntgggnantnnnntctcctnnanatncnctaatnangatctctcanntacatganntanatnacnnatanngnnnanatcnannnngtctctcntatnnnttatnnanngntcannttacnnnannannnaanngtatnntngttcnaaanntatntataaancnncgtnnntttnnannagatgtacnccnntnanntaannatctangctccg

SEQ ID NO: 3266 - DNA, 798 bp, Homo sapiens
  misc_feature (1)...(798): n = A,T,C or G
gnnnnnnantnnnntttnaaatccttnntgaatcctttgaantaccatcccnttttncgaattnggcacgaggaaaggtggcgcgcttctcacggctgagttgctgcgccttgcagacggaagctccccacaggcagagctgcttggatgtgtgagtcatgaaccagagaagccccgctccatgagcagtgactccccangccctgtgacctccctcctncttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgnttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgaactggccaacaacccagttgttgncgccttttcagacagaaccagtgtcatcttacacgtattnaaatggatgtcctggngtctncctaatatgtattcaaaagcaagctggggcctngaccacccttnggcacatattcctcanggacatcattcctgangctgtgtcactggcatgtccttaanc

SEQ ID NO: 3267 - DNA, 817 bp, Homo sapiens
  misc_feature (1)...(817): n = A,T,C or G
ngnnnnntttttnnnnccggtttgaaatccctttgaatttgnaatcgttggtgatcccatcgattcgagaaatcggaacaaaagtagaagttgtggaaaggaaagaacatttgcatactgacattttaaaacgtggctctgaaatggacaacaactgctcaccaaccaggaaagacttcactgaagataccatcccacgaacacaggatagaaagaangaanccccgcctgtatttttccagcaaatataacaaagaagctcttagccccccacgacgtaaagcctttaagaaatggacacctnctcggtcaccttttaatctcgttcaagaaacactttttcatgatccatggaagcttctcatcgctactatatttctcaatcggacctcaggcaaaatggcaatacctgtgctttggaagtttctggagaaagtatccttcagctgaggtagcaagaaccgcagactggagagatgtgtcagaacttcttaaacctcttggtctctacgatcttcgggcaanaaaccattgtcaagttctcagatgaatacctgacaaaagcagtggaaagtttncaattgagcttcatgggattgggaaatatggcaacgactttttacccgaattttttggggcnaatgaagtnggaagcaaggtgcaccctggagaacccccaanttaaattnaattttcatgacttggcttttgggaaaaaaaananctgcttnttaaaaaaaaaacttggagcctttttgaacttttggggngtcggntttacctagatccggaccttgntaagntncnttggntggnc

SEQ ID NO: 3268 - DNA, 725 bp, Homo sapiens
  misc_feature (1)...(725): n = A,T,C or G
gnnnttgttctaatgctnggctctcgttctttctgcaggatcccatcgattcgaattcggcacgaggataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttntttccttaatttgaaagggacagnnctgtgtatgtttataaactaaatgaagataagatattatnttgtataaacattcatctgagaacaatcaaagcagtagccacatggtgctggctcctttgcagcacaaacctggtcattttgatgactgtcaacaggaagacttgaaaaatcacgtggattcatattaccaccgctctcatttcatggagtcttctgatcaaaaaaaagctcacgtcgtatttcttctttnctttctcttttctaagaaaattgggtgttntgaccagaatgggaattttgcttccn

SEQ ID NO: 3269 - DNA, 786 bp, Homo sapiens
  misc_feature (1)...(786): n = A,T,C or G
gntttgaannccctttngnttcanatncttgtttgangcccttntnnaggaccccatcgnttcgaattcggcacgaggctatttgaagtacctgtaacaaaacagttggccctctgtttccatgtactctgcatctgtggattaaaccaattgcagatcaaaaatattagaaaaaataaaaataatacaaataaaaatacagtatnnccagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaatatacatgttaagaagattaaacattagatagtagatggtttgttgcatgctagaactgttagtattgttgaatcaattactttggtttcatgaaaaaataaacgataaatatctttaaagagaactagaagaattttttgtttgagtnattccangctgnagtatgatcntttactgaagtagtttgattggctggctaaacttanaattattggtttcttggtttgtanctgccantaggggttantaattgtaangataaaaatggtntgtgtggnttaaagggaaattaggtggnggttaaaaatcttgggaaaattttccgaac

SEQ ID NO: 3270 - DNA, 784 bp, Homo sapiens
  misc_feature (1)...(784): n = A,T,C or G
tttcaaatccttgttnacgccctttntnanggacccctcgnttcgaattcggcacgaggttttgttctcttctttgactattaaaaagctcagtgcctnatatttctaacatatggcaagtgtttctgtgtaccttacaagtctatatataaatttttcttctcttgacagggttntatctatatnncccaagtnacccctaattcttttagaataaggcagaaaataaatcaacgtaaaggttgagaccaagccagagacagctggccaaagtagctggttcagggatataacctgcaagttgccaacccagcgcattcttctcacccttcttccaccctacgaaaggccatatcttacaagagatgctggtaaatgccanacattcactgngtnaggcttnctcacanctagcagtggcatgagatcagttcaatccaatgacactgaaatggaactctccaagtgagtttctgcaaaagacttctctgttaacagggagttnttaagggaaatattgcaccttcctttcccctgctttttcaatcnangcatgatgtcnggtgctaccngnaacccatactgcnaancatgagggcaaatgagcctgngggaatttaaanctntaacactaattnaagangaaaaaagatgcagaancctngatccttantggnccatnatttaanccccttggacccactttttgaaaccagncctctanaacctatnngtgagtcnnntttactnggatcccntaactngataagaanccnttgnntcc

SEQ ID NO: 3271 - DNA, 762 bp, Homo sapiens
  misc_feature (1)...(762): n = A,T,C or G
caaatcnnttgctctngttctttttgcaggatcccatcgattcgcgacagctctccaatactcaggttaatgctgaaaaatcatccaagacagttattgcaagagtttaatttttgaaaactggctactgctctgtgtttacagacgtgtgcagttgtaggcatgtagctacaggacatttntannggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttccccacaaacccaagggcaggggccactcttagctaaatccctccccgtgactgcaatagaaccctctggggagctcaggaaggggtgtgctgagttctataatataagctgccatatattttgtagacaagtatggctcctccgtatctccctcttccctaggagaggagtgtgaagcaaggagcttagataagacaccccctcaaacccattccctcttcaggagacctacccttcacaggcacangtcccccaaatgagaagtctgntacccctcatttcttnatctttttacttaaactcaagaggcagtgacaggnagtcaggggcaagacattacatttttcatactttcccacatctgaaaagatgacaggggaaactgcaaagcc

SEQ ID NO: 3272 - DNA, 780 bp, Homo sapiens
  misc_feature (1)...(780): n = A,T,C or G
ccttttctaatgcttggcatttnaatccttgttgatccctcgatttnaattcggcacgaggcactgcgtcaagccactcctggagaagaatgatgtggagaaagtggtggtggtgattttggataaagagcaccgcccagtggagaaattcgtctttgagatcacccagcctccactgctgtccatcagctcagactccntgttgnctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgaaggggcacctgcaccccactgatgcccaaactgtcagactttgggggatccccgccttagggcagtgctgcatggctgccctgattccaaagtgctcttatcgcctctgtgtgtgggatcgcccgccccaaccccggggccgcttnagtcttgcttggnaggatgccttcccccagganggcagtgangggatgccgcaacctngacttnttannctcctggggtttccgccgggcnaaaactggctgncttaaatactgggcttggnagttgtttcaataaaaggc

SEQ ID NO: 3273 - DNA, 926 bp, Homo sapiens
  misc_feature (1)...(926): n = A,T,C or G
gnnnnntttntanncccttttcnaatncttggaatttgacntcgttgtntgatcccatcgattcgaattcggcacgagagaagttctagcacatcttaattnccttnatagtttaattgatgaagagcattgntgaagagttaggaggtctccctttgtcctacattntccgnttttttagaatgagaagatgagaacgacctccagttcacatgacggctgcngngaggatccagtangggagatacagtgctcagcaccaagcatgtgcaagtgagcacaatccaattttacatcatgttacccctccaggacagttgctttgacgtggaaggtatagagggagttgaaagganggtttgcatggttggcagangtgccctgcagccttcctntncaagctgnaanccgtttntgnccncctggaancngttggaaagtgtgtggtatggnatgaagatcccattttgactctgttcntgatcttgnttactnaagtganccttgttcnttgacngtattggatgatncattgatcctanctatcccttaactggtcgggtgntgctncngggggacattgntttttnnncaatttccaatgcatnccttnnngnanctntttcctgtcacanccanccaattnaattnatancctgtgnattngaanccnaanttcccagggccgtnngntagtctntntaaaanngggntcaantaaantttnnntatgangccnttngtataannttttntaaccatnggnntntatgncnanttncaacctgnggttnctcttnataactnggcnnttttgtaaattcnngntntnntntgataatntacnttnttttctttnatnagnggctttatntcaaantaatccncgaatanntaatataattgttctatnnatgnnancngcc

SEQ ID NO: 3274 - DNA, 789 bp, Homo sapiens
  misc_feature (1)...(789): n = A,T,C or G
aggnnnnttgtaannccntactgaaatcctttgnatcncctcnttgtttgacccattnattcgggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttccgcgngantaatgcattctaaacatcctaccccactttagaaacggacgtggggaacgcttggtcatttaagccaacaataaatttaggtgaatgtccctaagtgtttactgnttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacattcacctttgggaccatagcatagttaaaattaaatgtagttggaatagctagcattgcagctacagtaggggaactgtagtctanttcccctcagaaaaacccaaggagttgaanggacaggattttgnctangcnaaaaatctaagactcgtgcccttctggtacatnggggttttaagactggaatgtgtaataggagcactgcctttgcccaatcnaatgantgacaggttaactnngaaaatgggacaatcacatttccncttac

SEQ ID NO: 3275 - DNA, 814 bp, Homo sapiens
  misc_feature (1)...(814): n = A,T,C or G
gnnnnnnnngtnnnnntttnaaancccttttcaaatnncttggcattgaatccttgcagatcccatcgattcgaattcggcacgagtatcagacaatattttattattttttcatagatgttctgccacacaaagaacttggggtgtaaggataaggcaaaagctccaatcccatttttcagttctcctaggatgcacccctcagggagcctggccagagttccgnngcccgtgagcgtcagctgttgctttattttccatcaaagccctctgagaagtgagacctcagcaattccgggagccacatagagacagacttggcaagggaccccctggntctgagccagtagctgccatctggaaattcctcttttagcctctccttagaggtgaatgtgaatgaagcctccaggcacccgctgaatttctgaggccttgcttaaagctcagaagtggtttaggcatttggaaaatctggttcacatcataaagaacttgatttgaaatgtttttctatagaaacaagtgctaaagtgtaccgnattatacttgatgttggtcatttctcaagtcctatttctcagntctatnattntagaacctangtcagttctttaagnattataactggncctacattaaaaaaatgcttctcgaaaaaaaaaaannatnnnantacaaannaaaaancttcgaccctttaaaaccttttggggngcngatttacctnngaancccgacctgatnagaaanccntggttaaagtntgganaaaccccacctnnaaaggcnagggnaaaaaaaagcccntttc

SEQ ID NO: 3276 - DNA, 800 bp, Homo sapiens; identical to SEQ ID NO: 3259
  misc_feature (1)...(800): n = A,T,C or G

SEQ ID NO: 3277 - DNA, 817 bp, Homo sapiens; identical to SEQ ID NO: 3267
  misc_feature (1)...(817): n = A,T,C or G

SEQ ID NO: 3278 - DNA, 785 bp, Homo sapiens
  misc_feature (1)...(785): n = A,T,C or G
gnnnnnntttgaaanccctttcnaatncttggcattgntctctttgcaggatccctcgattcgctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaataggggaaactattcagagaaaacttaagccactaagttttatggtgttttgttctgtagcagaagcataggcatactgacaatacaaaccgaaatccttctaacgtagtggaccttttcangccagcattttttccttgaaaacctggagcatgtatccatcttatagcagagatcactttcacaatggttgggctcttggatttgaattgatgatgtaatgagccctctttncngattgnaacttaattactctgggnatttgntggattcccaaccttctaatatttacttttcctctttantaanc

SEQ ID NO: 3279 - DNA, 785 bp, Homo sapiens; identical to SEQ ID NO: 3278
  misc_feature (1)...(785): n = A,T,C or G

SEQ ID NO: 3280 - DNA, 785 bp, Homo sapiens; identical to SEQ ID NO: 3278
  misc_feature (1)...(785): n = A,T,C or G

SEQ ID NO: 3281 - DNA, 800 bp, Homo sapiens; identical to SEQ ID NO: 3259
  misc_feature (1)...(800): n = A,T,C or G

SEQ ID NO: 3282 - DNA, 828 bp, Homo sapiens
  misc_feature (1)...(828): n = A,T,C or G
ttctaatngcttggttactcgcctttctgtaggatcccatcgattcgaattcggcacgaggcaagccaggagtgctggcacaggcctgtngtcgcanctactcnggaggctnacgccggaggatcgcttgagcccancaggtcaaggctacantnagccgtgatcatgccactgcactncaaactgngngacacagngagaccctgtctnttaacaacanancccatgagcggcangccccccagtctggatggtggtaaagaatccttaagatcaaacccacgcagtgcttaaagcttggcctgattctagggctggggctggacaaactgctanagatnatgccgatagccngtgtgatccccctgncctgatngtnaanggcatagtgcagantggaaccctttccctccccaaaanattcagacctgnngggctgagtgggccttattgagtccccaaagttctgagaanctnggtntctggcttttagccttcagctttcttaggttntgatgcaatnagttgngttcccctgcccttttcttgccatgcacttncgaangaanggtttncngggttgcntgggaancnttncccnaacngcctnttanccaccnnaagnttttnnngaatcancacttccctnngggggggaatacttttaaatnccggaagncctttnaacncccttgggntccttccccngantacccaagcttnaaatccaaaattaccggnatcnttagggctttgtagcntntgggttnggntttgcntnttttttcttaanctttntttnaataaaccaatttcttntgnnacncc

SEQ ID NO: 3283 - DNA, 898 bp, Homo sapiens
  misc_feature (1)...(898): n = A,T,C or G
ttgtannccttttctnatagcttggtcttgactccttgttgatcccttntncnaattcggcacgngattacctncaaatctcaaggcggccttgaacattgagaaagaactaccaaagcntagacacgttttcagaaggaagacagcctcctccaggagcatcttacccgacctcttgtcaccgtaccaaatggcgatccgagcnanccgactggangagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggancatggtggcatcaaagattcctctgccacanatctgatagataacaggaaagttccactgaatccgcctggaaaaatgaaaccaagcaaagagaaatcgccacangcaagtaangaaatgagtgccctgcangagagaaatttagnagagaagattnaacagaccgttcttcaaatgcgtttagccnangaaganttccttgggctatgcccccacttggtaaggaanattnatnnaaaaggcttnncctnangggnttctggggaaaatttggcccaccantatgnttnncntgggnatttgaaaaantatttttgganaaagccttaaanaattttggggggaatttaaaccctttggtaacccaataggtatttggtatntaactgggggtnggngnncctttnacttggggaaaacntttttccctttgggcccttngccctgtcagcnacnaatgctttntaaaaattnccttttatttttaacctcnanatattttgggttaaatatttangnancc

SEQ ID NO: 3284 - DNA, 705 bp, Homo sapiens
  misc_feature (1)...(705): n = A,T,C or G
nctaatgctgggctctcgttctttccgcaggancccatcgattcgaaaaattgtgatgtaagtggtacagtggggagaatttagggctctcagaatgcagaaaactagccacctccagttctgtgcctgaccaccatctgactttggataaatcccttctgctctcccacctagctttatcatttgtaaaatgagtctctaggtacagccctttctggggttgagacagagtttctgaggagtaaaagccatgtcattgtggaaacaggcagctattctcacagctggcatgagcccactactcccctataatcagtgctgataaactgctctcatttgttggacttcagactttcctgacccactttgaatgggggccactttgaatggaaactttctatgtattgaattaaaagatctccaagataaatggttaaatgaaaaagcacagtgcaaaatggtgcatatgatatcctaccttttgggtaaaataaaaaaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcat

SEQ ID NO: 3285 - DNA, 701 bp, Homo sapiens
  misc_feature (1)...(701): n = A,T,C or G
gnngnnctaatgctggctacttgttcttttngcaggatcccatcgattcgaattcggcacgagtttacattttgtttgaatcaggatccaaataaggtttaaatattgcaatttgattaatacattaagattcttttaatctataagttcctgctccatctgtcattttatttttatcccttgaaatttatttattgaagaaactatatcctttgctttgtaaaattttccacagtgtggctggctttggctgattgctagcgtcatttgctatttatttttgtcctgtatcttggatctggcgccttgatcagatttaagttgatttttggggacgtaattacttcataggtattatgcatttttggatagaggagtaaagtagtgaaagtaatgtttttaggatggtttgtctggcagcagtgtgcaaaatgaattggtagaggagaaatggagagctgcgaattagaaggcaggttcaatcagtgcaggaaggaaaggctacagtaaggcagaggcagggaaaagaaaggcaatagagatgagagagattttgaaagaaggaattttcaataccttttaggcttaactataagaaatggagagtcggctgggcatggtggctcatgcctgtaatcccagcactttggaaggccaaggccagtggatcacctgaggtcaggagttcaagaccaacctgc

SEQ ID NO: 3286 - DNA, 705 bp, Homo sapiens
  misc_feature (1)...(705): n = A,T,C or G
actaatggtgngtngctcgtncttccgcagganccnngcgntgtcgaattcggcacgagattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaag

SEQ ID NO: 3287 - DNA, 700 bp, Homo sapiens
  misc_feature (1)...(700): n = A,T,C or G
nctaatgctggctatngttctttntgcangatcccatcgattcgaattcggcacgagccaagcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctnccacctcaccttgcttccttcaggactcaa

SEQ ID NO: 3288 - DNA, 704 bp, Homo sapiens
  misc_feature (1)...(704): n = A,T,C or G
gtacaatgcnggnngctcgttctttccgcaggatcccncgatgcgaattcngcccgagcagagctgtgatctgcccccaggtattctgacccccaaactggctctcaaccatgtttacatgatgaaaagaagaggtgactgttgtatcagctctaaaggcctcacttttggtgaaatgggacctaaatttgattgcatacttgattacttgctgtcaatactgaaattggcacttcataattttaatactattgaactttcaccataaccctgtcctataaagttgacttgcaaatgaagaaactctatctcttcaatattataaaatatatccaagagtcacaactagtgagaaaaggacaggatctaactaacaatgtgaggctgtgtcttcacaccaattcaacagagtatcttgtaaatgttgagaggagaggtactttaggtcatgggtgtctttcaataagtgctttagaaaacaggtgacaactgattgggccttgaggtatgaatggatttagccaggcaattaaataggaaagcagatactcaagacagattaaaacagcttgagagaagtgaaatgagcaagtgtaagacaattgatactgtccatggattttagaaagtgtgaagtggagtgattgtgatgaagcttgaaagattgcctggggccaggctgttgaangcttggtttgcttant

SEQ ID NO: 3289 - DNA, 704 bp, Homo sapiens; identical to SEQ ID NO: 3288
  misc_feature (1)...(704): n = A,T,C or G

SEQ ID NO: 3290 - DNA, 700 bp, Homo sapiens
  misc_feature (1)...(700): n = A,T,C or G
ctaatgctggctctngttctttcngcaggacccatcgattcgcagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaac

SEQ ID NO: 3291 - DNA, 704 bp, Homo sapiens
  misc_feature (1)...(704): n = A,T,C or G
ctaatgctggctctcgttctttctgcaggatcccatcgattcgcactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctncagccagttag

SEQ ID NO: 3292 - DNA, 701 bp, Homo sapiens
  misc_feature (1)...(701): n = A,T,C or G
ctaatgctggctnttgttctttttgcaggatcccatcgattcgaattcggcacgagcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttanggccctgtcaggaaacacacggg

SEQ ID NO: 3293 - DNA, 705 bp, Homo sapiens; identical to SEQ ID NO: 3284
  misc_feature (1)...(705): n = A,T,C or G

SEQ ID NO: 3294 - DNA, 710 bp, Homo sapiens
  misc_feature (1)...(710): n = A,T,C or G
gnnnctaatggcngggctctcgttctttctcgcaggatcccnncgattcgaattcggcacgagctctatcttgtttattgttgatgccatcttagaggaaaaaatgtaaaggtaagtaattaagcatatgacagcaacaaataagatacttataacctaatgggactttattttgtagttttatgtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattan

SEQ ID NO: 3295 - DNA, 1073 bp, Homo sapiens
  misc_feature (1)...(1073): n = A,T,C or G
ttnactnatcgcttggcttgttctttttgcaggatcccatcgattcgaattcggcacgagggtaaagagcaagtaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcantncatatannanntctggtcgnctntngnctntttgtttantcnnatccntccccctnccnctcntctnntccnccctcttatnacttcnttnttccntctttnttctntncccctctccncttnnatcttccnnttntnnttntccntcccttctcncncctnctcttctctcnttcctcttcattctntccnctcccttctctctttcactctcntcncttctcttctctattctcttcnntcnntntcttctcctatccactnacntcctntctctctcatccnatctcatnnctctctctcatncntanntcttctctccactttctctctacnatntctcnctactctctnatcananacctcttntccntcttctatcnctctctactnctctctctctcttactatctctctntctnttctttcctctncntcntctcacttcntactnttatttctctnnttctcatcagtctcttnctatctctttctctncngtttactntctncatctcntatctctnctatntctccttctctctcctcctatntctanatcatntctcntncatctnantctctccctttcatccgtctcnaccaantncttntacntgcntcctcnccnnctcttcnttttcatattctctctctcttcnttnttctnactctctccctctctctctnttcctactgcntgcttctncactnnctccttanctacanccatnactcacctcatctcatctcctcnnctcnctctctctcncatntntttctctnctttntatccatcnttcntcntncctcttctctcacactacttntctctnnt

SEQ ID NO: 3296 - DNA, 706 bp, Homo sapiens
  misc_feature (1)...(706): n = A,T,C or G
ctaatggctggnngctcgttctttccgcaacancccngcgantcgaattcggcacgaggtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaat

SEQ ID NO: 3297 - DNA, 709 bp, Homo sapiens
  misc_feature (1)...(709): n = A,T,C or G
nctaatgctgggctactngttctttntgcagnatcccatcgattcgaattcggcacgaggacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagcttctgttgg

SEQ ID NO: 3298 - DNA, 709 bp, Homo sapiens
  misc_feature (1)...(709): n = A,T,C or G
gtncnaatngntntgtagatcganntagcctaaacaaattggcttgncgccccttccttctgtctctggagacccttgacttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggangggtcagagcttccagagccccntgtcctgncanactcagctngtgggctggngtgttaaccccagtcctggcgtangtttacagnctctcaaggtacntngncccctgntctcctgggananangnntcnntnatgatccctaccaaagcacatgtnggatnaaggctgncnnntgcnttgnntcganagccngaagccc

SEQ ID NO: 3299 - DNA, 783 bp, Homo sapiens
  misc_feature (1)...(783): n = A,T,C or G
gtaantaattanctgnagctcgaantagcctaaacanattggctngncgaattcggcacgagacccgaggctcggtgtactaggtgcgaatgccgccttctgtggtgaccactgtcttctcatcctttgcacctataggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcanggccactcttggcagagactttgggtatgtaggggtcctcaagtgcctttgngattaaagaatgttggtctatgaaaaaaaaanntnncccantcnccaanncnttctncnnnanctcnnttnntncntccantttnncctntncnccctantctnccnctacttccnatnnaccnatacatccccntcacttnattaantccnatnttanantngcncnctnntcnnacnntcntctcatacntggtntnatcanttctctanatcctctctcnnctctccgncgctnnactncttcctntancactcaccct

SEQ ID NO: 3300 - DNA, 705 bp, Homo sapiens
  misc_feature (1)...(705): n = A,T,C or G
atgctgganctaatnctggcntctcgttctttccgcagcacccncgattcgaattcggcacgaggcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggcccgtgacttangcagaggagtgcagaggagggtctggc

SEQ ID NO: 3301 - DNA, 710 bp, Homo sapiens
  misc_feature (1)...(710): n = A,T,C or G
tntctnaatntgntnncgnatcttgaggacccatcgttcaattccgnnccnagggggnanctncccntactccntggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgnatctggctggactgatctgtctcacaagaagccatgaggccatagggagaagctccctctccccttcatcttctgctccaaaggtggtancaagaggagtacccagttaggggttggagcccccatatnacatcttcctgtcagaagactgatggatctttttcattccaaccatctcccttttcccccgatgaatgcaaatnaaacttttgtgacaccagcaacccattgctctttanaat

SEQ ID NO: 3302 - DNA, 709 bp, Homo sapiens
  misc_feature (1)...(709): n = A,T,C or G
nnatgctggnnctaatgctggctactngttctttnngcaggacccatcgattcgaattcggcacgagggactaacttacagaggagctgtgtatcctgaagattcagcgactggcaaggaatttccttgggagcaatgtgtgagggaggccatctgaggagatctgtggctttcttttgttgtgggaatctggcttatggatgaatctacgacacaggattgtgaaattacagctctttgggaacaaaaggaaggcagtattgcatgacttagtttcccagcttcactttccctttggcatggtgagtttggggtcttgagagtctattttctttcacacccatcagcactgttaagtaagcaggaagacaacctgaggttgtctctttactttgagttcctacataataaattgcagcctaatttagtacataaacccaaacctaatttaggagtaaattttttgtagcagatagccagatttcagccaatcacaggcttccagctaacaagactatgcccaaataaggcaaatgcctcatcacatgatgctcaaataaggcagccacctaggcgaggccaatcaggtaacttttctactttgcttaattgttcagcctgtacaaatttgctgcttatgactgctgagcagagctgtctaaacctcttctggtttggagtgctgccttatatatgaattgttctttgg

SEQ ID NO: 3303 - DNA, 712 bp, Homo sapiens
  misc_feature (1)...(712): n = A,T,C or G
aacgctggnnctaaatggctggctatcgttctttccgcagnancccntcgattcgaattcggcacgagctgcgacccctcggaccagtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctgg

SEQ ID NO: 3304 - DNA, 707 bp, Homo sapiens
  misc_feature (1)...(707): n = A,T,C or G
gnanctaatngcntgggcnactcgttctttccgcagganccctcgattcgaatcggcacgaggagttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcata

SEQ ID NO: 3305 - DNA, 707 bp, Homo sapiens; identical to SEQ ID NO: 3304
  misc_feature (1)...(707): n = A,T,C or G

SEQ ID NO: 3306 - DNA, 703 bp, Homo sapiens
  misc_feature (1)...(703): n = A,T,C or G
ctaatgcttggctantngttctttttgcaggatcccatcgattcgaattcggcacgagattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacanaacananaanaaaaaaaaaaactcgagcctctagaactatagtgaagtcgtattacgtagatccagacatgataagatacattgatga

SEQ ID NO: 3307 - DNA, 710 bp, Homo sapiens
  misc_feature (1)...(710): n = A,T,C or G
gnnccntaaatngctgggctactcgtnctttctcgcacgnanccnnncgnttcgcacaaagggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaanc

SEQ ID NO: 3308 - DNA, 757 bp, Homo sapiens
  misc_feature (1)...(757): n = A,T,C or G
nnannnnnnntnnnnnnnnnnnnnnnnnnnnnnnnnnnnnnnnnnnnnnnnnngtnctaatgctggcnatcgttctttccgcagcagcccancgattcgaattcggcacgagataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcaccgacagaaggactgcttttggcttctggatgccctcctccagtacacatcgtatggggtgacaccgcctagcctcagtcactctgggaaccgccagcgccctcccagtggagcaggctcagtcactccagagaggatggaaggaaaccatcttcatcggtactccaaggttctggaggcccatttgggagacccaaaacctcggcctctaccagcctgtccacgcttgtcttgggccaagccacagcctttaaacgagacggcgcccagtaacctttggaaacatcagaagctactctccattgacctggacaaggtggtgttacccaactttcgatcgaatcgccctcaagtgaggcccttgtcccctggagagagcggcgcctgggacattcctggagggatcatgcctggccgctacaaccaggaggtgggccagaccattcctgtctttgccttcctgggagccatggtggtcctggccttcttt

SEQ ID NO: 3309 - DNA, 710 bp, Homo sapiens
  misc_feature (1)...(710): n = A,T,C or G
ctaatgctgganctaatngctgggctctcgttctttncgcagganccctcgattcgaattcggcacgaggtcacatcttagatggatggtggcagacaaaaagagagagcttatttagggaaactctgtttttaaaaccatcagatctcatgcaacttattcaccatcacaagaacagcagggcacagacccatccccatgattcaatcatttcctactgggtttcttccacagcatgtaggaattatgggagctacaagatgagatttgggtggagacacagagccaaaacacatcagatgccatggaaatacaatgaggaaaagacagtctttccaataaactgtgctgggaaacctggctatccatatgcaaaagaatgaaactggatctccatctccctccttatataaatataaaatcaaaatggattaaagatttaaatctaagaccttatactataaaactaaaaaagaaaacagtgggaaactctctgggacattagtctgggcaaaaatttcttgagtaatacccctcaagcacagacaacaaaagcaaaaatggacaaatgtgaacacatcaagttaaaaactatctgcacatcaaaggaaacaatcaacaacgtgaacagacagcccacagaatgagagaagtatttgcaagatactcatctgacaagggattaatagaatatataaggagctcaaata

SEQ ID NO: 3310 - DNA, 710 bp, Homo sapiens; identical to SEQ ID NO: 3309
  misc_feature (1)...(710): n = A,T,C or G

SEQ ID NO: 3311 - DNA, 695 bp, Homo sapiens
  misc_feature (1)...(695): n = A,T,C or G
ctaatgctgggctggcgntctttccgcaaganncctcgattcgcccaggctgacaggggctctgccgtctttaacatgtgactttctaggtcagtcatctggtcattgcttttccacacagcagataagacaaaggagtggaaatagaggggtagagattttctcttaaacgtgtgaggctggagtggtatgcttcattggcaagaacctggtcctagcctgcctagctgaaaggaggggagtcagggagatgcactttgcagccaaaattctgttgccaagaaggggaaagtagatttggttggattttgatctgtgtttgctgctgtgttactctataattcagccatgtactctggaggtttagctatgttgtagccaattgatctatctcattcctttttactactgtacattataccacaataagagcatgctacgctttgtttagctgctagctgtttccttcctaatggatagttagctgatttctgttgtttttctctgagaaccaatgttgcaacgcccatcgaggaactctgccccccagatatatgtacatgtgtgatgtttctcttttatgggaactgggtcatcaagcatgtgtctttagtctggatagctattgttaaactgcctacaaactgagcagatctattaatatcagttacacttgggcctttggggtttgagan

SEQ ID NO: 3312 - DNA, 695 bp, Homo sapiens; identical to SEQ ID NO: 3311
  misc_feature (1)...(695): n = A,T,C or G

SEQ ID NO: 3313 - DNA, 701 bp, Homo sapiens
  misc_feature (1)...(701): n = A,T,C or G
nctaatgctggctgttgttctttttgcaggatcccatcgattcgaattcggcacgaggtccagaaatactctgatactagctatggtcagcaacatttaatgaaaacccttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgcccgcctcggcctcccaaagtgctgagattacaggcgtgagccactgtgcccggcctcaaaatcttaagaaaaggttcttttggtgcatggagttttacatggaataagttagtgcctctgcaatttaaatattttttacacagatttgatgctgtgcaaatgccctctccccttttaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttn

SEQ ID NO: 3314 - DNA, 704 bp, Homo sapiens
  misc_feature (1)...(704): n = A,T,C or G
nnnnctaatgctggctactcgttctttncgcaggatcccatcgattcgggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaagtgagtaaattgtattgtactctgtctacaaaaacattgggtatagtttcattacaagtttgtagcttaaatgtttgttcttatggatagaatcaaagtgtaaaaatcagatgtttatggtttttaatttttttggctgtgacttagcattttacatccataaaactttttttgttattgntataacggttactgtaattgttactgtgaatatcaacaatcttggggaagtgtaaatccg

SEQ ID NO: 3315 - DNA, 702 bp, Homo sapiens
  misc_feature (1)...(702): n = A,T,C or G
gnnctaatgctggctcttgttcttttgcaggatccctcgattcgttttttaagagataaggtcttgctatgttatctaggctggcctaaacttctgggctgaagtgatcctcctgtgtagctgggactacaagcatgtgccaccaatgcctggcttctcacactgttttgtaacatagatatgtgaagatgtgtattatagaattgtttgtaatactgtagtgttgtaggcaatgtgactgtctatagggaagtggacaggttatttgtggtaaatactcatggaaaacggtcaagcagttaaaagcaatcaattatggtcacccagcaatgcagataaatcttaaaagcatatgatgctatgataccaaagcacaagcaccgcccctgtaaatagaggaattagatttcttcagcattaaaactttgtgcatcaaaggatagtatcaagaaagtaaaaagacaaatggagaatgggagaaaaatacttgcaaaccatgtatctgataaaggtctagtattcagaaaacaattcaacaataaaaaagacaaataactgagttataaatggcaaaggatttaaatagacatttctctatgtaaagaagatttacaaatagtcaataagcacatgaaaaagatgttcaacatcattactcatcagcaaaatgccaatcaaaaccacaatgaaataccatttcat

SEQ ID NO: 3316 - DNA, 761 bp, Homo sapiens
  misc_feature (1)...(761): n = A,T,C or G
gnnnntttnnnnnnntttntaaananacaggctacttgttctttttgcaggatcccatcgattcgaattcggcacgaggccacacgggccgcatcatccctgcaatctggttccgctacgacctcagccccatcacggtcaagtacacagagagacggcagcccgcttgtacagattcatcaccacgatctgtgccatcattgggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttcctggggagccccaagaacagagtcaggcaaggggtggggagtncagggatcttggggacccctnctaggagagctgcagtctcttnccttaggggaacatnccanaatgcatatngatcagctntnagccaggctttngacaattttccagcccccaactaggtgggacacattaatgaatttgggtttttcccttgggcaagccaacctgncccaaangcaccaaaactggggcttttann

SEQ ID NO: 3317 - DNA, 716 bp, Homo sapiens
  misc_feature (1)...(716): n = A,T,C or G
tacagctacttgttctttttgcagatcccatcgattcgttctcagatacctgatggatccagacacattcactttcaactttantaatgacccttnggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatnttctggagcccctgcttctcctggggctgtgcccgggaaagtgcgtgcnttccttcaggagaacacacacgtgagactgcgcatcttcgctgcccgcatctatgattatgaccccctatataangaggcgctgcaaatgctgngggatgctggggcccaagtttccatcatgacctacgatgagtttgagtactgctgggacacctttgtgtaccgacagggatgtccttncaccntgggatggactaaaggagcacagccaanccctgagtgggaggctgcnggccattctccagaatcanggaaactgaaggatggcctcantctctanggaggcngagacctgggttggcancanaataaaagatttttttcaagaaatgcaaacagaccgtcaccaccn

SEQ ID NO: 3318 - DNA, 726 bp, Homo sapiens
  misc_feature (1)...(726): n = A,T,C or G
caggctacttgttctttttgcaggatcccatcgattcgaattcggcacgagtgaagaatggcgtgggttggttcctttcaaatgcacttgagcagcggtctccaaccacagggccacagagctggaggtgagcagcaggcgagtgaagggaaacttcatctgtatttctagcccctcccatcgcttgcatgaccacctgagctccatgtcctgtcagatcagcagcagcattagattctcacaggagcacaaactctgttgtgaagtgtgcatgcgagggatctaggttgtgtactccttatgagaatctaatgcctgatattctgttactgtctcccatcaccccagatggacagtctagttgcaggaaaacaagctcagagatcccactgagtctacgttatagtgagttgtagaatcatttcattatatattactatgtagtaataatagaaataaagtgcacaatatatgtaatgcacttgaatcatcctgaaattattccctcattcccagtctgtggaaaaattgtcttccacacattcactctgttttttggtagaggcagggtcttaatatattgcccagtctgatctcaaactcctggcctcaagtaatatacctctcttagcctnccaaaagtgctgagattacaggcataagcccccccctcaaccaagactttnttnaaccaaataaaaattaagtgagattactttggcccag

SEQ ID NO: 3319 - DNA, 841 bp, Homo sapiens
  misc_feature (1)...(841): n = A,T,C or G
tacangctacttgttctttttgcaggatcccatcgattcgaattcggcacgaggtcccttgctcggggccatggagacactgcggccagtacggcggcgcctctgtctgaagaaggggaagtgacctccggcctccaggctctggccgtggaggataccggagcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggcttgcccacggtactctggagctgcaagcccgagatccttgccccgcccggccttccacgccggaggcccanaaccgaaaaggaaaagatcccgatgaaggagcccggaggcccaaaanaanaaggaaagagggaaaaaacccacacattgccccacnggaatttggaatttttgattgaatgagcccaantggaccacccaaanggacttncccttgattggaacccgggagaaccccancccccaagggaaagcnttnaancccccgggaagccccagaaaaaccngggnangggcccccccccttgggnacnaaagggtggcctttttccgggnccctttgaaaggagggaccccccannnaaagncnttgggangggaaaccaaaaaatcccctttnngtaanccccggggaanggggnancccttntt

SEQ ID NO: 3320 - DNA, 741 bp, Homo sapiens
  misc_feature (1)...(741): n = A,T,C or G
gnnnnnttnnnnnnnnnttntntananacaggctacttgttctttttgcaggatcccatcgattcgcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtgtgtgtgtgtgtgtgtatgtatatatatatatataaatatctttcccaatatgccccgttgacagtgtttaaattccanactaggactgctgatctgcacaatttaattatgtggntattcgagcacttaatttcactcaaggntcattgggctctgctcttctccctgccattacnggagctgtggacagagctncctccttcaanantctagtggttttgcncaacaggntgnccaatganaaaactganttgcgtgnctgtaaatgttgcncagggngcacatctnnnagggntcnatnctccggcctgtcctccaaaagggctgggccttgggcccnn

SEQ ID NO: 3321 - DNA, 751 bp, Homo sapiens
  misc_feature (1)...(751): n = A,T,C or G
ggnnnnttttnnnnntactganancctttngctacttgttctttttgcaggatcccatcgattcgaattcggcacgagaggcgatatccctgagctgagagcatnaccctgtccccgaatccttctttcctctctgttttgtttttcattcccctccctctctcccctccccctccagtccacgacgactgggctgttgaccctgttcaggcctcggtgaaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgnatatcatctctttgatgattgctcctcttctttgtatcctgncttataatttcaacacatttgcgatactcaatgtctattctaaattaaccatgttttgtaccacaaactcattgcccatggatctgttgctgaaacaaggaagtcttaaacaagaagtggaatctttctgttatcagattgggtctgaatcaaatgatcagaagggtgggaatattacaaantgaagaataacagntgcaaccttcagtttctnaaaaataanaagngagcttttcagggcaaatt

SEQ ID NO: 3322 - DNA, 705 bp, Homo sapiens
  misc_feature (1)...(705): n = A,T,C or G
nctaatgctgggcncttgttcttttngcaggatcccatcgattcgaattcggcacgaggtctagtataatcttgatgctcaaaccagataaggacaatacaagaaaggaagagtataggctaattctacccaataactaaatgaagtattagcaaaccagattcatcaataatcttttaaaaatcaagaattaattggatttaggaatataacactgtgtataacaagtttaagagaaatatatgagaatgataagactgcaattgaaagtagaggctttctctggagggaaaggtgaggaggatgtgatttggaagaacagcatggggaggcatcagttgtattgtaatgtttattttttaagctgaatgataggtacgtagatgttcattgtgttctttttgcctttttgtatatcttaaatatatggtagtgccatgattagcaggcttaatagccttgtgagtttaaatgtcactttcaaatgctgtatttttggtggagttgcttaaacacattccccttggaatctatacaaccagttaaaaaaatcatgtataaaccaccatgaaatataatgaaatgtactgtatatgcattttcatgaatgttgtgtcaaagggcttgtaggaaaaaaagatcgttaactcttttgcattcagtgaaaataggtggctttggaaatagtttcagccttgctaacac

SEQ ID NO: 3323 - DNA, 761 bp, Homo sapiens; identical to SEQ ID NO: 3316
  misc_feature (1)...(761): n = A,T,C or G

SEQ ID NO: 3324 - DNA, 712 bp, Homo sapiens
  misc_feature (1)...(712): n = A,T,C or G
gtnctaatngngngctcncggcnngtccgcaacagcccngcggntcgaattcggcacgaggccttttgtggggtctcatacataactcagtttccacaaagctgtgccccagctcagccctatggatagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggcaatgactttttagatccagcaccaaaggcaggatccaggaaagaaataattgataagctggacttcattaaaacgaaaacttctgctctgtgaaagatgctgccaaaaaatgaaaagacaagccacagactgggagaaaatatttttgatggaaatatctgagaagagaggcttgttatccaaaatatacaaagaatttctaaaactcaataatttgaaaataaacaacccaatttaaaaagtgggccaaagatcttaaatgacgcctcaccaaagaagatacacagatggcaaataagcatatgaaaagatgctcccggctgggcacggtggctcacgcccgtaatcccgc

SEQ ID NO: 3325 - DNA, 1249 bp, Homo sapiens
  misc_feature (1)...(1249): n = A,T,C or G
angctactttgttctttttgcaggnnntttttnnnnatacagctcttgttctttttgcaggatcccatcgattcgaattcggcacgagaaaacacacacacacacaacacaatgttttcacgcctgtaaacctagcacattgggaagccaaggtggggagggattgctttgaggccagggaagttcaagggctgcaagtggagcttatgaattggcncacctggtacctcttagccctgggggaggaacaagaagtggaggaacacctggtcttcttnaaaaaaaaaaaaaaaaaaaaggtttttttttggaaaccccttttaaaaaaattaaccttttttggttttttgggaaaatttttcctttaaaattccaattccaanttttccaaaaaaaaaggnaaggcccaaggtttaaaaaaaaaaaaaatngggggttttaaaccttttngggttttnccttttngggttaacccaaaagggccctttancctttaaaaatttttaagggaaacctttaatttaaggtttaaggggggaaattaantttttttttnaaaaaaaggnaaggcccttgggnaaaanttccaaccctttttttttngggggttaanttttttttngggggttnanttaaaaaaaattaatttttttttnccaatttttttgggttttaaatnggttccccccccaaggntaaattaaattttcccttttaaaccttgggggnaaaaaaaaattttccnttttgggttttttttgggaaattccttgggcccccttggnaaaagnaaaaaaaaattaanttccttggggtttttttnccttaanttanttaaaaaaaaaaaaaaaatttttttttttttaaaaaaaaattaaaaatttnggttaaaaaagggttttaagggaattttttaaaaaaaaattttggttaaaaaaaaattatttaaaaaaaattccaaccaaaaagggggaaaattggttanccccttttaatgggaaaatgggtttgggtttgggacccantttttttaattggaaaaaatttaattggtnggggatttccaattatttacctgggtttanccaaaggaataaggaaaatttggaaatgggccaaaaaaggacccaaaaaccctcaattaaaaatttgagggaaaacgtggttattatgtaattgaaataaaaacattttataattgtaaaaaaaaaaaaaaaaaaactcgagcctttaaactataggggtcgtn

SEQ ID NO: 3326 - DNA, 760 bp, Homo sapiens
  misc_feature (1)...(760): n = A,T,C or G
ttaaananntngctcttgttctttttgcaggacctttcnaaanacagctcttgttnttttgcggatccctcgattcgtttctatacaatttttccttctgatccagagacacggaaaaacaaagggcaagatggaaataagggatgagaaggtctatgtggaaaaacagttacaactgggagtgggtaactgcaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagcccgacgagggtaaacacatcctaacagggaaggtaaactgtcgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaattaatagggtatcagttactaattttacttaaatggnactctgtaagcttaataggtatgcttaaata

SEQ ID NO: 3327 - DNA, 760 bp, Homo sapiens; identical to SEQ ID NO: 3326
  misc_feature (1)...(760): n = A,T,C or G

SEQ ID NO: 3328 - DNA, 752 bp, Homo sapiens
  misc_feature (1)...(752): n = A,T,C or G
agctcttgttctttttgcaggatcctttcaanatacagctcttgttctttttgcagggtcccatcgattcgtttctatacaatttttccttctgatccagagacacggaaaaacaaagggcaagatggaaataagggatgagaaggtctatgtggaaaaacagttacaactggagtgggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagcccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaatttaatagggtatcagttactaattttacttanatggactctgtaagcttataggttgcttaaan

SEQ ID NO: 3329 - DNA, 752 bp, Homo sapiens; identical to SEQ ID NO: 3328
  misc_feature (1)...(752): n = A,T,C or G

SEQ ID NO: 3330 - DNA, 757 bp, Homo sapiens
  misc_feature (1)...(757): n = A,T,C or G
ttggnnnnnnnnnnnnttttannntncagctnnngnnagctcttgttctttttgcaggatcccatcgattcgaattcggcacgaggttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcacccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggcccccatcagaccttntggaagcaagacctgggcctncatggncccnaaaactcctaggggatccgatgtgcagccnaatcttgaaanggcccatttaaaaaanaaagaacatgggtggtacattggggagtnttta

SEQ ID NO: 3331 - DNA, 755 bp, Homo sapiens
  misc_feature (1)...(755): n = A,T,C or G
gnnnnttnnnnnnnntttntnnanatacaggctacttgttctttttgcaggatcccatcgattcgtctccttgcctttctcctgaaaggtatgagactacttgccttactgtcatattattgaggggaatcagccgcaaagcctgnggaaaatgaacagtagctgtggggtcaaagccatgtctccaggttcacgggctcactccccccaggacaagcctagttaggtagtgggctgcatctgggtatccctgggacagaaatgcaggtgagaaggggtatcaagaatgcctcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccctttagtgagggttaattgcgcccttggcgtaatcatggtcatagctgtttcctgtgtgaaattgttatccgctcacaattccacacaacataccagccgggagcataaagtgtaaagcctggggtgcctaatgagtgagctactcacattaattgcgttgcctcactgccctttccaan

SEQ ID NO: 3332 - DNA, 705 bp, Homo sapiens
  misc_feature (1)...(705): n = A,T,C or G
caatgctggttctngttctttttgcaggatcccatcgattcgaattcggcacgagggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaatcgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacaccgaaagaaagcagtactgaaagcagccagtcggccaagcctgtctctggccaagacacatcagggaatacagaaggttcacccgcagcggaaaaggcccagctcaagtctgaagc

SEQ ID NO: 3333 - DNA, 703 bp, Homo sapiens
  misc_feature (1)...(703): n = A,T,C or G
tgctggnctaaatgctggnnatcgntctttccgcantagaacnnncgattcgaattcggcacgaggctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccatctcgggccacttcgtggccgagcactacatgttcctcaagggccacgagacctactcctactatgggcctctcaactggatcaccttcaatgtgggctaccacgtggagcaccacgacttccccagcatcccgggctacaacctgccgctggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccaggctgcctcctggtggtggccattgtcccccatcggcccctcaccttgcaccccancn

SEQ ID NO: 3334 - DNA, 696 bp, Homo sapiens
  misc_feature (1)...(696): n = A,T,C or G
tgctgggctctngttcttttngcaggancccatcgattcgaattcggcacgagaaggacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcatcttcaaagactagtacttacacagtttagaagatttcaaggtactgctgacagtagtttattatgtcagtatacatacgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatn

SEQ ID NO: 3335 - DNA, 736 bp, Homo sapiens
  misc_feature (1)...(736): n = A,T,C or G
gtncctaannngngtgnnggcangctcntatctctnaanagaattgggctttgtcgaattccgcncggagacantctgancgtgctngagcagctgattatcaagcccggggtgcgccagatccatctgtncnacggacnngcgcggnttgaccgagcatgaggctgcctgaangangaccaggggctntttgtncacangngtccaggncannaccgctgnntnccttgtggtgntgngctatggngnccagntnttgcacattgacanacttnactgcactgggtgggagctcgcacattngcccatttgtggtagaatcaaggcatcacccgataagattgncgtggtggaaacgtcacagtccgaccanttngactgtcaccatgccanntgacagcatnnatactttctngcttntagatcactacggggaagatactctctatngtcaanggganntatncttccgaaactgcctcctnancnnccnctanncntntgacngataccgtcanaannatatctgnctgaaggncnnatatatcntngcatatncnnganncgnatggnancgntntanccctnaccntnatcccnagtgcgancttactatcncatnntnnaannagtttgnnttcncttctggnanancacacccatggacnactgcatccncagatgccttnattcactgntanccttggcctgcactnnngngctttccctccttanc

SEQ ID NO: 3336 - DNA, 706 bp, Homo sapiens
  misc_feature (1)...(706): n = A,T,C or G
nnncaatgctggctgctcgttctttccgcaggancccancgattcgaattcggcacgaggaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtattacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacattttng

SEQ ID NO: 3337 - DNA, 703 bp, Homo sapiens
  misc_feature (1)...(703): n = A,T,C or G
caatggctggtngctngttctttttgcaggatcccatcgattcgtgtggagaaccttctttttctatgggaaatcacttctggagttggcaagaatggagaatggtgtgttgggaaacgccttggaaggtgtgcatgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctgg

SEQ ID NO: 3338 - DNA, 761 bp, Homo sapiens
  misc_feature (1)...(761): n = A,T,C or G
ctaatgctggcngcttgttctttttgcaggatcccatcgattcggaatgagagctgctatttgtgtttaaaaagaccatacagggccagccacagtggctcacacctgtaatcccagcactttgggaggtcnatgtgtttncacnnctnttnntnagnannantntgtcatggaggcttantttgtggngtntgatgncatactgntaggccaacatgtgtccnaggnanagnggnangntnangccattagcntggtgnaaacttgccggatgttgatgctctantaaganccgnatgtgccatttntgaactntttagtantganggagtcntggtgntcaanatggatntacanatgcctanttacccgnncntgnctaacnagantntgcccaaccttcatgtcatgaaggnnntnnantcttttattcccanngttncctnaaacgaacantttgcctgnacacattttctactggnaccttacnaatnaggttatcccgnatnttcntgattacttttcttctgcnncnnganatngtgcctntcaccctactcctntatccntccattnacctnttaggccatncncctaaacgnnntgcanntntnancntccctnntnangaattttctaaatangnnttaattctctnncctnacnttnctcttcnnttccnngnatttnnnttnnnnttcnctnttngntntcnccnctanttcaancnnctcttaantttngcnnntcctcnnttcnnt

SEQ ID NO: 3339 - DNA, 706 bp, Homo sapiens
  misc_feature (1)...(706): n = A,T,C or G
nctaatgctgggctatcgttctttccgcagnancccntcgattcgagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttnttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgaaaaaaaanaaaaaaaaaacttcgagcctctagaactatagtgagtcgtattacgtagatccagacatgataagatacattgatga

SEQ ID NO: 3340 - DNA, 706 bp, Homo sapiens
  misc_feature (1)...(706): n = A,T,C or G
ctaatgctggtngctngttctttccgcaggatcccatcgattcgaattcggcacgaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttg

SEQ ID NO: 3341 - DNA, 709 bp, Homo sapiens
  misc_feature (1)...(709): n = A,T,C or G
nnctaatgctgggctgctngnnctttntcgcaggatcccatcgattcgaattcggcacgaggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggccgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactgc

SEQ ID NO: 3342 - DNA, 715 bp, Homo sapiens
  misc_feature (1)...(715): n = A,T,C or G
gtcctanagtgtggtctcgncnnnccgnangagntnggcgggngcgaattcggcacgagcagaacttcacagcagcctgtcctcatcagcaacccaaccaccttcatcagcaacccaaccaccttcatcagcaacccaaccacctcgtcagcaacccaaccacctcgtcagcaacccagccaccttcatcagcaacccaaccacctcatcagcaacccagccaccttcatcagcaacccaaccacctcatcagcaaaccaaccactttcatctgcaacccaaccactttcatcagcaactcaacaccttcatctgcaacccaaccaccttcatcagcaaaccaaccaccttcttcagcaacccaaccacctcatcttggagaaggagaaggaactgcaagccaccaagtcttcatttttcagggtttgtaatcttcccaaagttttcctttgaaaataggataatgggtggaattttcagagtgattacatacctcaacatttttattaacatacaacaatgggaaagttcatcatccatatactgcagtcacttaaacaacagccaattattgcaagattagaattggagatcttgtcctcaaaagtataaatngtcctttgagttatagaaaataatggaattgggatttctacatatcattattatacctattttaaatttaatgggcagccaggcatggttccagctacnt

SEQ ID NO: 3343 - DNA, 708 bp, Homo sapiens
  misc_feature (1)...(708): n = A,T,C or G
ctaatgctggctngctcgttctntccgcagtanccctcgagtcgaattcggcacgagactgcctccttccacacgagtgcccctttggccaaagaagattattatcagatattaggagtgcctcgaaatgccagccagaaagagatcaagaaagcctattatcagctgctctgctcagttagtttttattcccggggtaccaagcagctgcacagtcggtgcctgggaggcacgtagaggcccctggctcaggcagagggagatggttagactcttgcagggctaaaactctaatttggaattgaatattgtggatatcttagttaaaggccatgcttacagcttagaaatgaagccttaagctgcatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaac

SEQ ID NO: 3344 - DNA, 713 bp, Homo sapiens
  misc_feature (1)...(713): n = A,T,C or G
gtnnctaatnctgggctctcgtnctttctcgcagtancccntcgattcgaattcggcacgaggagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgactttgcacctataatcccagcactttgggan

SEQ ID NO: 3345 - DNA, 710 bp, Homo sapiens
ctaatgctgggctgcttgttctttttgcaggatcccatcgattcggaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggtt

SEQ ID NO: 3346 - DNA, 712 bp, Homo sapiens; identical to SEQ ID NO: 3324
  misc_feature (1)...(712): n = A,T,C or G

SEQ ID NO: 3347 - DNA, 705 bp, Homo sapiens; identical to SEQ ID NO: 3322
  misc_feature (1)...(705): n = A,T,C or G

SEQ ID NO: 3348 - DNA, 761 bp, Homo sapiens; identical to SEQ ID NO: 3338
  misc_feature (1)...(761): n = A,T,C or G

SEQ ID NO: 3349 - DNA, 779 bp, Homo sapiens
  misc_feature (1)...(779): n = A,T,C or G
atacagctcttgttctttttgcaggatcccatcgattcgaattcggcacgaggactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttnccaccatgttcccaatgactgactgctgtttcagtccagatgataagctcattcactggtacatctattcaaagaggatgtggcagcggcaaacttgttttctttgagcgtaggactttccaaagggtgtatgaaatagacatcacagatgcgagtgttgntcgctgcctgtggcatccaaagctgaaccanatcatggttggaactggaaatggattggctaaagtctattacgaccccacaagagtcagaggggagcaaaattatgtgtggttaaaacccagcggaaggcaaaacaagctgagactctaactcaggactacatcatcacccctcatgccttgcctatgttncgngagccccgccaacggagtacaaggnaacagctggagaangacagactggatcccctgaagtcgcataaacctgaacctnctgtaccaaggcccaggtcgtggtggccgantttggaacccacnggggcactttttttttctatattgggaanaacattgttttggacaaaancgatgacagtaattcttcgggaagcn

SEQ ID NO: 3350 - DNA, 704 bp, Homo sapiens
  misc_feature (1)...(704): n = A,T,C or G
atgcggncaatgctggctactcgttctttccgcaggancccntcgattcgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgctcctccagaggtctgcacactccacttcacatgccgttgactctcacagtctaagacttcagggccgggacctttgtccagcctgcacagtagagtgaggctgcctctc

SEQ ID NO: 3351 - DNA, 924 bp, Homo sapiens
  misc_feature (1)...(924): n = A,T,C or G
annnnggnnnnnnnnnnnnnannagnnnnnnagnngttgantttgaaacctttagcccttttgcagancccaccgnttcngnagatgatgtggatanacttggatactcccttgagtggaanatannngtgttcagactgnncaagtntanctccanagactttgaagtctgctacccagaggagcctctcagggactggccggagatctccctgctgaccgagaacgaccgccactaccacattccagtcntttaannccgctgggggccnaacagcagngctcaccagtgacggtggtcacagttgcnataaagtngtctctgaaaccaaagctagcatttcacnatggaaggaattangacctattcttcaggattacaggtacactggntgcaagccatgcatggatggnttttcttaatnntncagtngatttgctctnaanncanctgcanatgaaaacanttggcgagtngggngncnggactttgacccatanagggggcgtnggccacttcacatgatgggcggggnctattgggaccacaaatnaaaggccngcntggacancaaacntgggaaaaaannnaagaangaaaaaccacnntaaagngaaaanacangcntgaccttgggagaggaaaaaaaaaccaagttttaaccggtnnatggttcattcattnaaaaaaacctnnancntcggacttgtattttggaggggatttaantaccnaaanaatngggnccttatttttnanaataaagcnnanaaccttttaccnaaagaaancccnanntttgggaatantggcnatntctaaangggancccatnngggattnaacnttgtnaaaaattaactaanactttcgggggaaaagttgncnaaatngaaggtggntcanaaanaaaanaagaanng

SEQ ID NO: 3352 - DNA, 924 bp, Homo sapiens; identical to SEQ ID NO: 3351
  misc_feature (1)...(924): n = A,T,C or G

SEQ ID NO: 3353 - DNA, 785 bp, Homo sapiens
  misc_feature (1)...(785): n = A,T,C or G
ttacatcanctcttgttctttttgcaggatccctcgattcgggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctcccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggangggttatttgtcatttacagtattggggtttttatgaatgtgaagcaaacaaaaaaaatttgtatgtaaactggaaataagaaaatacattagcaagccttaatgggtatccttactttgagtccacatggggttggacagtccccacaccccattaaattcttgtaaatgaaagccccccttttgttaaaaaatttgctctaataaaaacataccaaatcctggnnnanaaannnnnnnnnnnnnnnnnnnnnnnnnct

SEQ ID NO: 3354 - DNA, 785 bp, Homo sapiens; identical to SEQ ID NO: 3353
  misc_feature (1)...(785): n = A,T,C or G

SEQ ID NO: 3355 - DNA, 686 bp, Homo sapiens
  misc_feature (1)...(686): n = A,T,C or G
tgtgcncggaaagatnagccaaatgctttcaaagagctngggacaggaaatagaatngctacngtggctgatntatatgagtgatgtgtctgcaggaggagccctgcttttgctgaattggagctagtgtttggcccaaaaaaggaactgctgntttggnataanctgtnngccanngganancgagattatagtacacggcntgcagcctgtncaggtgctagttggcaacaaatgggtatncaataaatggctccatgaacgtggacaagaatnnncaagaccttgttcttntcagaattggaatgacaaacnggcttccctttttctcctatngntggtactcttatgtgtctgatatacacatttcctngtcttaacnttnagggagttacaattgactaaacacttcatgattggnttcacnccatganccctnatcccanggtttcatttgtggacaattgcttacttttgnggggtcttttaaaaaggnacncgaaatcttcattattgccgtaaaaaccttaaagatctgttggnantcacaagaagacaaanggccgaaattttaaaggggagggaatttttntattttnaaagaacctttttnggttggannaaaaacataatttgagcnttcnncttttnagaattcccctaacatctcaggttgggtggggngg

SEQ ID NO: 3356 - DNA, 790 bp, Homo sapiens
  misc_feature (1)...(790): n = A,T,C or G
nnttnnnttttaaagacttncanctctttttctttntgcaggatcccatcgattcgaattcggcacggggggagcaaataatangcccttgtgtgtgtttttggcaganaagccatgaagacaagcagatgctaataaaagaatctgcatctttgnttgttattccatgttaaagggntgaaataaaggtaanagaatatttgtactgttgttatccaaatccatctcctgttctactctctattcaaaataatcgtacagtgactaacagagctttcagaccaacagtatttttatttttcattttaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaanaaggtttcatggctcatgtagacagggttattgatttctatagtaacccagaaggatgcaatactggcagctgcagacaagtggntaactggtttggcagaatggcatgtcctgctgctggaatgtttttatggattaaagttaaaggcttaatgatgtaaaaagaactgattgaagaaaaggccgttaaaatgggggtattaaagctcctggaaatgtttctcgtcgatagctcacttctancccttacttgagagcttctt

SEQ ID NO: 3357 - DNA, 686 bp, Homo sapiens; identical to SEQ ID NO: 3355
  misc_feature (1)...(686): n = A,T,C or G

SEQ ID NO: 3358 - DNA, 705 bp, Homo sapiens
  misc_feature (1)...(705): n = A,T,C or G
tatncatacagctcttgttctttttgcaggatccctcgattcgaattcggcacgagaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaagagacagaggaagaggaagctgctgaggactggggagaagctgagccctgccccttccgagtggccatctatgtacctggagagaagccaccgcctccctgggctcctcctagctgccctccgactgcaaaggcggctcaagcgcccagaaacccctactcatgatccggaccctgagactcccctaaaggccagaaaggtgcgcttctccgagaaggtcactgtccatttcctggctgtctgggcagggccggccangccgccgcanggccctgggagcagcttgtcggatcgcagccgttccacgcgatacccaagcccagagactgaccctgctacctntgccggcaagctgcccctagaccacttaccctctgctaccaactgctctcttgctnnccagcaacaccttngcantggcnac

SEQ ID NO: 3359 - DNA, 835 bp, Homo sapiens
  misc_feature (1)...(835): n = A,T,C or G
tnnnnnntttatntttnatacaanctcttgttctttttgcaggatcccatcgattcgtttggattgattcagggagaaatttgcactgatggctcagaagcttacgtcatggagagtatgacctacctcacagcagggatgctggaccaacctggctttcccgactgctccatcgaggcagccatggtgaaggtgttcagctccgagccgcctggcagtgtgtgagtgaggcgctgcagatcctcgggggcttgggctacacaagggactatccgtacgagcgcatactgcgtacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggacccgtggagacacttnttgttccgctttggcaagaacatcatggangaacaacttggtacttgaaagcgggtgggcaacattcctnattnaaccttgtattggcatgacnggccgtgcttgtccgcngggccaanccgcttccattccgcatttgggcttncgnaaanccaccgaaccacganggnttttntttgggnccaacaaccnttntggggtngggaaaccttaactttgcaagaaaatttttttnaanccttntttt

SEQ ID NO: 3360 - DNA, 780 bp, Homo sapiens
  misc_feature (1)...(780): n = A,T,C or G
tnnnnnntttaaatccattagctacttgttctttttgcaggatcccatcgattcgtgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaanaacccgtangtggtccncggcggcgcggggaggcccagggcaatnngacagnccctccgnttgactccgccagtgctgcagnccctactctttcanagttgggagccctgggacccaggcaccaattgttcttgcaaactcaccctgcggcacatcaacaagtgcccanaacacgtgctgangcacacccaaggccggcggtaccagcgagcttttgtgtaaatatgaagaatgtctnaagcaaggggtggagtacatgcctgctgcctggtgcacccgangangaaganggaaggacaaatggacngtgaacggccttcgcccgcgggaaagcttctgggagcccacattcaatgatgaagggggagctgcaagtgatgacagcatgacagacctgtncccctgacttttcaccagaaggaccttgaacacngaggatggggatggactgatgatttttgacaacaaagaggttgaaaggcaaanccccaaaaaaaaggccttgtgaaggcagganaaanacaacctntc

SEQ ID NO: 3361 - DNA, 780 bp, Homo sapiens; identical to SEQ ID NO: 3360
  misc_feature (1)...(780): n = A,T,C or G

SEQ ID NO: 3362 - DNA, 780 bp, Homo sapiens; identical to SEQ ID NO: 3360
  misc_feature (1)...(780): n = A,T,C or G

SEQ ID NO: 3363 - DNA, 917 bp, Homo sapiens
  misc_feature (1)...(917): n = A,T,C or G
ttatttcataaactattgttctttttgcaggatccatcgattcgaattcggcacgagggctgcgaggttttcggctttggctcctgatatgcagcgacagaattttcggcccccaactcctccttaccctggtccgggtggaggaggttggggtagcggaagcagcttccggggaaccccgggcgggggcggaccacggccgccctcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggggtcccagcagcaattcggctactccccaaggcaggannanaancanccncanggttntncaaggacatntacaccatttggatcanggcgtnttanaaaaaaaanaatgttaatganttggaaaantatttnaaagcctttnaatgnttnnnnnaatccttngggnttggccttanaaanccaanattntngtnggngggntnttaannccnnncaantncnnnnnnattncnttnaaaacntttnnnccanggncnnaaaaaaanggggnaannaaaaaacttttttnnttnaannantttttttggaaaatttnaaancntnggaaaancntttnnntngttnntnangggaaannantnttttgggnncnaaaaaacnttttnaannnntnnnggttnnnannnnttaaaaantttnnncccccaannnnntnnanngnancttttnnanttngggantaaanttnnnnnnanggggnnttttttnngnnnaatttnnnnnnannnnnnnannnangggnntttngnnngnaannntnn

SEQ ID NO: 3364 - DNA, 778 bp, Homo sapiens
  misc_feature (1)...(778): n = A,T,C or G
ttaatatacatacanctacttgttctttttgcaggatcccatcgattcgaattcggtacgagatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtacttactgtggctttaaacatattcagaacagatgcttgaaatatgcacttagcactttggttncacatctgtctgggtaaaccatgaagaaaatgaactgctgcctcaatcgacccagacagcaccataggcagataaagaattggnttcaccctggtggtggtaggcatcgcgtgtgactttttttnctctatatcaattttcagtacgggaatagtattttaaaatagattggctnataaattatgaatctttaagtagtagan

SEQ ID NO: 3365 - DNA, 765 bp, Homo sapiens
  misc_feature (1)...(765): n = A,T,C or G
gtnnnnngtttgannnccatcnttttatatncatttttctactngttctttttgcagggatccctcgattcgaattcggcacgaggggcgaaaaagatgaccgaaattcaaactcctgaaaatactcctcgtttatttgatttagtaaaagtnaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacacttagaaaaatttactgcaagcatccagcgtttaatanagcangaagaatatttgaatgtccaagttaaggaacttgaagctaatgtacttgctacagcccctgacaaaaaaagcagaaattgctagaagaaacgttgtgcttcaaacaaatatgatgctgtggctgagaagctgtaaagtaaaactgagttaaccttcccatacatcgtgaatatatctactcaggcacagcacttgtaataatacataatatgnttg

SEQ ID NO: 3366 - DNA, 807 bp, Homo sapiens
  misc_feature (1)...(807): n = A,T,C or G
ncttnaagcccttttaaanccgttcgacccatcgatccnantcagganccaancnanatcnaatctgnacgaaggaaccccccncnttgagcnnaaactnnncncttnctggggcaanagggtggactgggnnnnangngnanagagagaacgcanggccannaagganagaaaaccnttcagcanctcaatnaactgcgggccaaganatctacccgtctcccttctcncacaagnaccattggccttnnnatcngaagcatttgacaaaaacttgcttgtttgggcctgtcacctcctgaaaggctgntttagntgtggatgncctngattaagggagagagcacctaggagctgcctgccccagctggggtgacggctgtagggctgggtctatgttgcaagccctatatcctagcntgcagnggaaagtgcttagctntgtncctgctgacctctgggcagncantcatcaaancananagacgtggcngcntgtgggcagcatgcccaantnccttgcttgactnagcactnatttctggtagnntnaaaaaagaattnaangtttnttgggnnnntttttttggggggngttgaggggtgggccaaaaacatggggggtagnntttgagttgttanaaaatgtntntgaatcaanntntnttntnnaaacacgatttgcctttttacccattataaagatgggncttatnacccacngnactggataaacctttngggttttttttggtntgganttggttctttnaaaaaatttacccaattcatgccctnngggntccn

SEQ ID NO: 3367 - DNA, 785 bp, Homo sapiens
  misc_feature (1)...(785): n = A,T,C or G
gnnnnttttnnnnntntaaacccttnagctactcgttctttttgcaggatcccatcgattcgaattcggcacgaggctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttggttaccttggtcttggtttaagtcttaaaaaattaaagataacattataatgtagaatcagatgggacatagtccttgtaagcttnccttggaaatgttttaaatatttaggaagcttttaaaagacctaaattgtactctaaaagacactnaattgtctaatgtacaaaggn

SEQ ID NO: 3368 - DNA, 785 bp, Homo sapiens; identical to SEQ ID NO: 3367
  misc_feature (1)...(785): n = A,T,C or G

SEQ ID NO: 3369 - DNA, 1000 bp, Homo sapiens
  misc_feature (1)...(1000): n = A,T,C or G
aatttttttnnnccnaatttttcccnaagggccccttaaccttttgggtttttcccttttttttttttgggcccaanggggaaattcccccccccaattcccggnaatttttcccggnaaaaatttttcccggggcccnacccggnaagggggaaggggggaaaaatttttaacccaggggggtttaagggcccaaaaaaaaatttttaattggggggaagggnttttggggggaagggggnaacccagggtttanttggaaaaccccccccnatttttttgggaccnttttttgcccacccgggggaaaaaagggaatggaaagcccccaannaatgggcctttttccaaaaaagaaagccttggggggggaccaaggggaaaaataagaaattggcttaccatgggcttggttttatatgaatgatgtgtctgcaggaggaccctgtttttctgaagttggactagtgttgcccaaaaaaagaactgtgtttggtataatctgttgcagtggagaaggagatatagtcacggcatcacctgtcagtgctagtggcaacaaatgggtatcaataaatggctcatgaacgtggacaagaatttcgaagaccttgtcgttggncagaattggaatgacaaacaggcttccctttttctcctattggtggnactcttatgtgctgatatacacatttcctagtcttaactttcaggagtttacaattgactaacactccatgattgattcagtcatgaacctcatcccatgtttcatctgtgggacaattgcttactttggtgggttcttttaaaaagtaacacgaaatcatcatattgcataaaaccttaaaagttctgttggtattcacaagaaagacaaaggcagaagtttaaaagtgganggaattttatattttaaagaactttttgggttggataaaaacataatttgagccatccnagttttaagtantttcactacatctcaattgggtgggtg

SEQ ID NO: 3370 - DNA, 1000 bp, Homo sapiens; identical to SEQ ID NO: 3369
  misc_feature (1)...(1000): n = A,T,C or G

SEQ ID NO: 3371 - DNA, 924 bp, Homo sapiens; identical to SEQ ID NO: 3351
  misc_feature (1)...(924): n = A,T,C or G

SEQ ID NO: 3372 - DNA, 789 bp, Homo sapiens
  misc_feature (1)...(789): n = A,T,C or G
ttccatcagctcttgttctttntgcaggatccctcgattcgaattcggcacgagattccaaaggttncaaanaacttggtcataantatgatnatgagaagacancgtctttctnttaaaacagnttantngccttcacttttgtgaaaatagnnttcancacanaaactgacttntttagacaaagttntaaccaatgatngngtnngcttctaggatatacactctaaancaactcactgtcccacgtggtggtcattgctggccntantnanttggncctgcntaannatattgatatctaatttcntttaaccaccntnantngnccttanttaccancngggnnnnactncacgnggcaactgnggcntngcntncttnnccagctcatggtgngtgaatgttatacaaattgccactcagatatatttttggncgtaatggggggtacaaatgatcatgtgatgtgtncactcatntggtgcaaagtgccccnggcaccaacngngncnnggtnctcanccacaaccntgctncctctgagatncacnncccntcancctccgagtaangagttgcgntacaactcatcaanggnanactggntaatattaaaaatcatccnatatgnccatactttncctnttttgtancctgcccaannatcccgtcaaagggnngtgtttntctngctaatttcccaccagntggnntannnttaattccnctcagggancaaanngttcacaatgcctttctttttttcccgnngggnttttggaagcn

SEQ ID NO: 3373 - DNA, 869 bp, Homo sapiens
  misc_feature (1)...(869): n = A,T,C or G
atttcaaaaactcttgccttnttaaanacctnncgntactcgatcntncacgaggaangaggacctaggcacacacatatggtggccacacccaggagggtagtggngagttagatttnagagtccaggccctaggttgggacccactccaaataatctcctcggtgtgggtggtggttntatananggataaatgaataataaacattnntaaaatatacgctattccttgntggaaatgcctgctgcacccccgtttccantgacntnccgaangnggntatnnggtggtcantggaatnacagtcaatccanangtnanccngcngggntgcatcaagctgncctcgcacctgggntnnncaccctctggcccacactggtnatgatgccacaccttnccatgttcacnctgtttggaaaaannccttttnttttcctcttttaaagagaaaacattganaaagatttttttttttaatgggccgacccnaaaagggagatctncccncccttgtatatnatantnntgaccctncctacnaaganggcgtttttggcaaaatnattnttttntttttcncgnggtggtgggggaaaaatttttcctggggggggccttngnngccnaactnttaattttccccattaaggcaanntttctttgggggnctttccccnggggcttaancnttaaactttggaatttttntnggggttggttngnccntaaatttttannaaaatggtngtcnaacccaaaaaaaaatntnacccccgggggccnaanantttttncccccccttggangccttttantttcccccacaaactttttttttttcccttccaaccncttttattcttt

SEQ ID NO: 3374 - DNA, 1128 bp, Homo sapiens
  misc_feature (1)...(1128): n = A,T,C or G
gnnggggnnnnnnnnnnggggngggggnnnggcgnnnggnncgncggnnnancnnnnnnnnncnnnggggggnnnccccccgggttttttggccaaaatnttgggccnaanaaacccagggcccttacctnggggncccccttttntttttgggcccanggggnnagcccnccncgnncccgggnangggggccnggggggnagggccccgcngcnaangccgnagggggggggggcncgcggcccccncccannngnccaagaganaaannnaggcggcnnagngaangnggaanncccntggggcnnggggnnanananccaagngggagggggggggggggccggccgggntcgggggagnnacggncantnggncnggggggngggaggggcacagggggaggaggncttnnggnggggngagcgagcgcggggcncnancagngngggancncnngcaangggcannagangccgnggnccacctacnngggggangcaaggcnntngnagtnatngggggnaggagcaaaaangggngncccngngctaggncgancntgggggagggagcnngccngaacagcnggggggnnctgggngagaacnggagcgngncngnacggcccnggagacaaggagcgtctgggggagggcgatggcaaggggtatgggnggctgggacangngggggacccnagngnaaanncgtgnggcaagngggacgtnnggggngnnngctggataagggncgcaaggtaccnagncgggnncagggngncactggnangcagggagagccgaggacggnnagngcgnggntgagggnacgncgnggangacgtgccaggnaacccnggggncgngggcgggnaaacnngncgagcncgccggggcngcgtcgcagagcgnggnnnaggcganngggtnaaggnggnggngngggnangnngggggcgaggggncnaaggatnnngaggggggnacacntgggccnganggcatggncgngcncggggccgaaacacgggaacgcggggggagggcangngnggggnctgggggnccgnccggnaggggnacngggggcgggggcgcagtggncagtgtgnnngcggcgagccg

SEQ ID NO: 3375 - DNA, 1128 bp, Homo sapiens; identical to SEQ ID NO: 3374
  misc_feature (1)...(1128): n = A,T,C or G

SEQ ID NO: 3376 - DNA, 793 bp, Homo sapiens
  misc_feature (1)...(793): n = A,T,C or G
aantacatcagctnttntctttttgcaggatcccatcgattcgagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcataagacaggggttttatttttcctggtgggngtngctgatttgnggagcatgcctttaagaatgaaaaaagcctggaatggataaccttcccttaaaaaaggngccggcattccaattcaaaatattttcgtcctggatttnaaagctggttggggtaatgctaattaaaaattccttcagttaattt

SEQ ID NO: 3377 - DNA, 828 bp, Homo sapiens
  misc_feature (1)...(828): n = A,T,C or G
tcccttttngaaagctttaaaccttttttaaaccnttcagctcgggncccattgcnganncnatctantcnnngccggcnccgcncngnngtntnncattnataaanngcttgaanatnatgatgtngccntctagnnacnnagatttgantccgnttanngaatgtggaaatntgcnctggaagaaatgttnncnttnatgatagctcgtgnatggaaaaaagngcactgnatttattacacaaacttacnaatgcttnacttctttacacaacatnngtnaantnatatttgggntattgcatnctatnaacaatttgtgnatgnnttaanatggtgttnatnactntgntnnncgncannntgtttttaacnnatantggccctaaaatatgggtgtgcttatataatcgcttacttctggnactgnaacngnnntacngaggacagntgggntttnaaccctcttnttgnacgtttgccngacctacntggnctantatggattctaaaagtacttcaatgnncttannaagaaacatatccttgnggngtatttagatgctttttgattatacccacacaatncctgaggggacattttggggcntngaatataaaacanttnnatntccacttancatctgccccccngnggtaagttactattngttnngcnggtacaactaaatnncttttcccantntttnaattgggaaataggggcgaatnnctangnctttantggntggtnctgggcctcaatggacnatnnaacaattgnnaaanacaaatntgtaaatcccggaattcctnataaaaaaaant

SEQ ID NO: 3378 - DNA, 793 bp, Homo sapiens
  misc_feature (1)...(793): n = A,T,C or G
nnnnnnnnttnnttttnatatacatncagctcttgttctttttgcaggatcccatcgattcgctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccngtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaataggggaaactattcagagaaaacttaagccactaagttttatggtgttttgttctgtagcagaagcataggcatactgacaatacaaaccgaaatccttctaacgtagtggaccttttcaggccacattttttncttgaaaacctggagcatgtatcatcttatagcagagatcactttcacaatgtttgggctcttgatttgaattgatgatgtaatgagccctctatncagatgnnactaattactctgcgaattgactgggattcacacccttctaatattttacttttcctcttttatcaactctcattctcgct

SEQ ID NO: 3379 - DNA, 686 bp, Homo sapiens; identical to SEQ ID NO: 3355
  misc_feature (1)...(686): n = A,T,C or G

SEQ ID NO: 3380 - DNA, 789 bp, Homo sapiens; identical to SEQ ID NO: 3372
  misc_feature (1)...(789): n = A,T,C or G

SEQ ID NO: 3381 - DNA, 784 bp, Homo sapiens
  misc_feature (1)...(784): n = A,T,C or G
naacacttngctacnngttctttttgcaggatcccatcgattcgaattcggcacgaggagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttgggtaaggatttggggcacagtaccaggaggggggcttggtgccagacctcatgaggaagaaggattttcctatgtacagagaaggggacccctgtcctgttgggangtgctgtgcaaacctaaccaaagttactaacccctctggtttctgnggttacacaaanggggataaatacaaagctttncctnaactagccaattctatttgggtttcctgagt

SEQ ID NO: 3382 - DNA, 775 bp, Homo sapiens
  misc_feature (1)...(775): n = A,T,C or G
aaccaccagctacttgttctttttgcaggatcccatcgattcgaattcggcacgagtgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgnatctcatctcaaaatattaataatttttttnccaaaaagatggtatataccaagttaaagacagggtattataaatttagagtgattgntggatattaccggaaa

SEQ ID NO: 3383 - DNA, 1044 bp, Homo sapiens
  misc_feature (1)...(1044): n = A,T,C or G
naacgcnngctacttgttctttttgcaggatcccatcgattcgaattcggcacgagccccggtcgtgtagcggtggtatactacggtcaatgctctgaaatctgtggagcaaaccacagtttcatgcccatcgtcctagaattaattcccctaaaaatctttgaaatagggcccgtatttaccctatagcaccccctctagagccaatanannaantnatnntnnnaancncnnnancntananaanctcnancctttanaactntnnngagtcntnntnannnnnatncanacatgntcncatacatcncttattttggncnnnccnnncctnnanngcncnnnnananangcnntnttntcaaattnnnnnncnnncgnnnnnnnntcnnnccatnncnnnncnnttctacnnatnncnnnntnctacnnntccnntncnttnnaanntntccncnccntnncngnnnnctnncnnnttnnnntnnnnnnnnnnncnnntctnncncccnnnncntccnnnnnnnnccnnnntcnnnctncnnnnnncncnnctnntntnnccnnnncnnttnntnnnnnnntncnncnnntnnnnntnnnnnnnnnnncntncnnnnnnntnnnncnnnnnnnnnnntnnnnnnnnnnntnnnnncnnnncncnncnnnnnnnnnnnnntnnnnncnnnntnnccnntnnnnnnnncnncntnnnnnnnctnannncnnnnnnctntnnnnnncnnnnnnnctnnnncnntcnctctcnncccnntntatcncnnnannnnnttncnnnnnnnannnnnnnctnnnnntcnnncnnncnnnncnnnnnntnnncnnncnntncncnntnncnnnnnnnnnccnnnnnnntctnnnncnnncncncctnnnnntnctnnnncnnncnnnnnnnnnntntctcnctnnncncntnnnnncntncnctacncnctnnccncnanccnnnntncatnnctnnnntcnctnttacctttacnnccncncncccttnccnatnacncaatnccncct

SEQ ID NO: 3384 - DNA, 783 bp, Homo sapiens
  misc_feature (1)...(783): n = A,T,C or G
tcaacagctggctactcgttctntntgcaggatcccatcgattcgaattcggcacgagcagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggtggtgcacccctgtagtctcagctacttgggagacagaagcaggagaattggttgaacttggaaggtggaggttgcagtgagctgagatcgcaccactgcactccatcctgggcgacagagcaagactgtctcaaaataaataaataaataaataaataaagttaaaaaanaaaaaaaaaaactcgagcctctagaactatagtgagtcgtattacgtagatccagacatgataagatacattgatgagttcggacaaacccacaactagaatgcantgaaaaaaaatgctntatttgtgaaatttgtgatgctatngcttttatttgtaaccattataagctgcaattaaccagttaaa

SEQ ID NO: 3385 - DNA, 783 bp, Homo sapiens; identical to SEQ ID NO: 3384
  misc_feature (1)...(783): n = A,T,C or G

SEQ ID NO: 3386 - DNA, 778 bp, Homo sapiens
  misc_feature (1)...(778): n = A,T,C or G
caacgctngctacnngttctttttgcaggatcccatcgattcgaattcggcacgagcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaccactaan

SEQ ID NO: 3387 - DNA, 776 bp, Homo sapiens
  misc_feature (1)...(776): n = A,T,C or G
catanagntcttgcctttttgnaggacnctcgattcgaattcggcacgagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggatgtaaattatagttcaataacatagttacaaaagataatcaaaagcatgaaagcactgttgatgtggnttggatctgtgtcctcaccgagtctnatgttgaaatgtaagccccctggtgggaggcgatgggattatggggcagantcctcacaaacgggttagcccacccgctcaggctgttctcctgatattgagtcctcatcacatctggttgcttcaaagtgtgtggngccttccctctatctcctactgctctggccatataagangtgcctgcttctccttcgccttntacatgattgtaaagtttcctgagcctcctagaacnaaagctgctgngctttctgtccatctacangancgtgagcccaattaaacctcttttttttttttnngaggnnntttnntnncnntccnnncantttnananncctngnannggtttnnaaaaanaananngnnaannnnnnnnncccccngcccttttaaaataaaaa

SEQ ID NO: 3388 - DNA, 780 bp, Homo sapiens
  misc_feature (1)...(780): n = A,T,C or G
tatacatacagctacttgttctttttgcaggatcccatcgattcgaattcggcacgaggtgccatcttgctatgtttcccaggctggttttgaactcccagcctcaagcaatcctccctttccgcctcagcctcccaagtggctggggttatgggcctgagccactacacagctaagagtgtcttgtatgtgctaatgagatggctggtgtctgagagcccctagagagcttcaagatgggggctagtctttagaaagtccaagcaatggctaggtatggtggccactgcctgtaatcccaggagtttgggaggccaaggtggacagatcacctaggagtttgagaccagcctggccaacatggcgaaacactgtctctactaaaaagacaaaaattagcaagacaaaaattagctgggcttggtggtgagttcctgtagtcccagctacttgggaggctgaggcaggagaatcacttgaacctgggaggcagaggtttcagtgagctgagatcatgccactgcacaccagccgcctgggtgacagagcaagactccatctaaaaaacaaaaaaagtcatgattagagggttggaactttcagcctttcggcctctgcttcttgtccccacctntgggcanaagggaagggctagagattgaattatnccaatggccaatgatttatttaatcaatatgaaaccttcataaaatcccctaagtgataaagttcanagagctttcaagttggtaaagcttttctangtgcttgggaagggn

SEQ ID NO: 3389 - DNA, 815 bp, Homo sapiens
  misc_feature (1)...(815): n = A,T,C or G
gnncnnttntatacatcagctcttgtctttgcggtccctcgttcgattcggcacgagtaagaatccccacccccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactggtgtcaccatttatgattctgaatttaaagttgggaaaggtctaagtatcaaagtttttaatatataatgctggtccaatctattcataataatcttcaaggtcagggagcccgcagagacccaccaacttttncacttatcatttctaacaggttattggataaagaangtanctcttctatttaccgggnatatacctggnaaggccttntttnnggncctttagctctggttcctccnggtaattaaaaaaggttaaaaatatggaaaaaaaaaaaaaaaaaaaaaactccgngggcctntagaactttttggggg

SEQ ID NO: 3390 - DNA, 857 bp, Homo sapiens
  misc_feature (1)...(857): n = A,T,C or G
tcaacngcttggctancgttctctttgcaggatcccatcgattcgcgtctcanacaannnaagtatnctacccatccacaggcagcagacaaggaagtaccttctgtgactgnctggcaaggtcagaggcatnagggaaggtaaantactgnaactatattnntaaaaataaaagtattccctttatgagtgtgaattacgaatcaatgccccttctcactactttttgtgaaaaaaattaccactnctgcancaagtctatgcctgggtaaccaccaacccnccaaanccnagaagaagncccccttttccggcntntggaaggctggagnancattngnatntnggccaacnggnccntaaantggngaantnacccactttccttttacaancggttggcntcntnanaccancacaaattntntggcacccgggtnctctnnacaggnaaccctgnnaancaaanaaaccntggngtctgcactcnnggngcccanntnctncggcttgntntaaaatgactntgncntnccttttttaaaattcacaaatnttttanccnctacatanacatatgaagtgagnaacccncananngaanattnanaaaacntcccagccnncttttaactactantngagnnctntttaatnntctnatccccnnaannttgttgatggangcccattcgtttnncacctttttgganganaatcccncccaccttcctnaataatctnntcngaataaaaaaaacncccctcatattattcnnncaanaaantntttnnnannacnnccanggngggctccntttttngccccncncttttnnanncaccntcnntanaaa

SEQ ID NO: 3391 - DNA, 857 bp, Homo sapiens; identical to SEQ ID NO: 3390
  misc_feature (1)...(857): n = A,T,C or G

SEQ ID NO: 3392 - DNA, 956 bp, Homo sapiens
  misc_feature (1)...(956): n = A,T,C or G
ccctcancgnncnnaacannnctcnnannctcnnatcttanctttcnnnatcnantantcncganannnntncctcccnnatnntaccnanttancttaccncctcnnnaacnnctannttnaantnnttngnnncccngtnttantnttttctaacnctggggaatcgcntctnngnagganccntcgantcgaaaatgccttcattnncctttttactttatcatgagacataagatttattggcttcatatcaacccttaagtattgttaactttatgtaatagcatttgggttggggattggtgtgttttcggttgtacatagcatagttgaattatgttaggcataattatgaccttattattgtctttatttgaaaattatatatgatctcaggaaatgtgtatgagttcaagttgacaaggagtggatnngggatggttgatactgagtgtcaacttgattggattgaagcatgcagagtaataatcctgggttgtgtcctgngagcnatgtntcccaaangagaataacatttgagtcangngggctggggaaaggcanacccacccttaaactgggtgaacaccctntaatcaaactgtctgctntggccagnatataaaagcangccngaaaacntgaaaaggctagacaggcctttagccctctcagccctacatctttctcccgtgcttggatgnttcctgncctcaaacnccanacttcaagtncttcancttttgggacttgaacctggctctccttgntcntnaantttgnatcacnggcttatctgngnggnaccttancngttnagttcnaatacctccnnaattaaacncncttttctntacananactcccnctnaattcgnacccntntanaantnatagtgancccncaaacctnnatccnnnncttgatannganccattgnacnnnttnnnnc

SEQ ID NO: 3393 - DNA, 703 bp, Homo sapiens
  misc_feature (1)...(703): n = A,T,C or G
caatgctggnctaatgctggctctngttctttcgcaggatccctcgattcgaattcggcacgaggagcaaaataggattatattaaagaagcaaaagaatgtcctaaaaattctccctgggattaagtaacacagtgattgatattagtggagtagagggaaagatccatgttagagatagcttaagatagggattagatgaattgagggcaatgactaaagatactgcttgcaagaaaactggctgagaatgagaggaaaatcttagttgcttggcgggagggggtttgtggttgtgaaagatagttttgtttaatcttagtcttaaatttaaaaccaagcagcaaggatctagctgagagaataattgaatacattaatataggaggacagacaaagatcctgaaaaggctgggagaagagcatccaaagcacaggtggagagacaaaaaggttagggctgctggcagctgtggagagaactgtacgtggtaagggggagatataagatgtcctgcataagtattttccctgtagattgcaaagtcatctatggagaggaaaggtccaaaatagtcactggggagagcaggtgaattagatggccaagcagggtggatggatcatttgaggtttggggtgacagatcaactgagatccacttacacttctgaaaaccaagacactttagaaattaacaccg

SEQ ID NO: 3394 - DNA, 706 bp, Homo sapiens
  misc_feature (1)...(706): n = A,T,C or G
atgntggnctaatgcttggctactngttcttttngcaggatcccatcgattcgcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcacg

SEQ ID NO: 3395 - DNA, 699 bp, Homo sapiens
  misc_feature (1)...(699): n = A,T,C or G
gnnnctaatgctggctattgttctttttgcaggatcccatcgattcgaattcggcacgaggcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgccttcagtgctgcgtgatttgattctg

SEQ ID NO: 3396 - DNA, 1104 bp, Homo sapiens
  misc_feature (1)...(1104): n = A,T,C or G
tttcaacgctggctactngttctttttgcaggatcccatcgattcgaattcggcacgaggttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttaaaaaaaaaaaaaaaaaaaaaaaaaaaaaaaaaaaaaaaaaaaaaaaaaaaaaaaaaaaaaaaaaaaaaaaaaaaaaanannnaanaataancntantncnnnnanttnatnncnancttctccatntacnannannttantnactacanntcncatcnnncttatcttctaataccnacccncnnatntnaccatctaccctntnctcaaccntccncntnnatnctcttnntcncccncnncaccctcncncntcnantcctntatanntttctcccctcncctcgnncnctnngtncnttntctactgttnctcntntannctctcttctctnnctctcntnnctntctnnancnttnttnnccnctcngctcnncnctctnncttctctatcttcccntnctcncacnctctcatgcaattnnacnntcnctnctncancnattngactcncntctnnatctntctgcatcactnancnncnnntnncttctctctaccnncantctcttntnnnnntnnnncnncnncttatnacnnnncnnnntntntnnnnactcnntntntannnnntnncannnntnnncntctnnncnntnnntnctnntnnnnncttnnntnntaccnaannnnnnnnncnnncncnntnanntnnnatnantnncatncnctcacntatnnnctctcnnnnanannncncnctccctnnnnnatnnctcncttnacatactctctatctnnnncnaccnctacnancanctnnttntnctnnnnnntanacncttnnnnatntnngctctcnnncnncacnctnttctnnnantnatctcttccccngncnaac

SEQ ID NO: 3397 - DNA, 811 bp, Homo sapiens
  misc_feature (1)...(811): n = A,T,C or G
tttnnnnntntnaatcccttngctaccnccntttgatngacatacanctacttgttctttttgcagggatcccatcgattcgaattcggcacgaggaatcaccctcggctgggaagtcagttcgnnctctcctctcctctcttnttgntngaacatggtgcggactaaagcagacagtgttccaggcacttacagaaaagtggtggctgctcnagcccccagaaaggtgcttggttcttccacctctgccactaattcnacatcagtttcatcgaggaaagctgaaaataaatatgcnngaggaaccccgtttgcgtgcgcccaactcccaagtggcaaaaaggaattggagaattctttaggttgtcccctaaagattctgaaaaagagaatcatattcctgaanaggcacgangcagnggcttaagaaaancaaagagaaaagcatgtcctttgcaacctgatcacacaaatgatgaaaaagaatacaactttctcattcatntntgnataacgnctccttgtttaccctggtattctagaatgtaaatttacataaatgtgtttgttccaattagctttgttgaacaagcatttaattnaaaaanttacgtttaaatttagatgttcaaaaggagntgngaaatttgagaatnngtaagactaattatggnaacttagcttagtattcaatataatgcattggtggggtttcttttacccaaattaaggggtctagttctttgttaaaatcaagncatttgcatttgtggttctaaatacaagtattgttgcntttgagaattgctta

SEQ ID NO: 3398 - DNA, 749 bp, Homo sapiens
  misc_feature (1)...(749): n = A,T,C or G
nntnnnnntntgaaanccttnggctacttgttctttttgcaggatcccatcgattcgaattcggcacgagattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaacccagtataaatcagttctggacaaacttgaaatcatggtggaagaaacagacagtgttagctcatgatttgatttggttctacctttggccttgagttcttattatttacattataaatattaactggttttatattgntaagacaaaacactggtaaaagtttcaacacctcccttttgcttgtataccataaatgggcagnttctgaaattttggataaagcatcaagaactcctttttctgaaacgttcctncttttttagtgcctaattaatatacttacttacccnggannnnnnnnnnnnnnnnnnnnnnnnnnnnnnnnnnnnnnaaaaactcggcctttaaaatatagggggnngnnttacnnaaatccaann

SEQ ID NO: 3399 - DNA, 810 bp, Homo sapiens
  misc_feature (1)...(810): n = A,T,C or G
canctcttgtctttttgcggaccctcgttcgaattcggccgagtaagaatcccccccccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggtcaatactactactgntgncaccatttatgattctgaatttaaaggtggaaaggtctaagtatcaaaggttttaatatataatgctggnccaatctattcataataatcttcaaggtcaggagcccgcagagacncncaactttccacttatcatttctaacagtttattgnataaaggatggtacctctttctattttaccnggnaatatacctggaaagggccttcttttanggnccttttaacctctgggttccctcccggtnaattaaaaaaaggtttaaaattnttgaaaaaaaaaaaaaaaaaaaaaaacctcggggggccttttaaaaactttttggg

SEQ ID NO: 3400 - DNA, 780 bp, Homo sapiens
  misc_feature (1)...(780): n = A,T,C or G
gnnttnannccnttttnatncncntncagctcttgttctttntgcaggatccctcgattcganttcggcacgaggtgaggctctcttaanaaatttaaaaatactgnngaacaaagggaggagtttgtcttaatctggagtggaggaaacttctgngtcaccnaacacagaaaccatcaaagaaaatctttcactttcnaaattagtctatacaaaaaaaaangaaaatcttaccccaaatnanagactgaggcatgagcttcaatcaatcgangtttactggccnnagttngagcntgcccagnaaagcaacacaagtcaaagaaacgtctgtggcctgtgctctcccaaaaagttttcaggaggctcaanatttgtacatttctttaaanggganaagacagtgaggcanatggttatgtttttgtgagactcttanttagtgtcccntgaatctaaactntntggaanatagggtgaacactgnaagancagggagtgacataanaaccaattatgcnacacgtctcatgttacgtggaggaatgangntctcatcttatccttgttctgcccctgngcagataaacttgttattgacattgtcagtntgaaatttaacagacttttgttttangagttaagtttanggtgcacacctaanatgcacttggcatgtnctttgtttnttggaggatatncatnctgaaggtttaggggctgccaaanaatttactgctgaccanttgggattgcagtccctggagattcatgaggctt

SEQ ID NO: 3401 - DNA, 780 bp, Homo sapiens; identical to SEQ ID NO: 3400
  misc_feature (1)...(780): n = A,T,C or G

SEQ ID NO: 3402 - DNA, 789 bp, Homo sapiens
  misc_feature (1)...(789): n = A,T,C or G
gntttnnnncnnttttaatntacatacanctacttgttctttttgcagggatcccatcgattcgaattcggcacgagggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtttgggcctgtcacctcctgaaaggctgctttagctgtggatgcccttgattaagggagagagcgcctaggagctgcctgccccanctggggtgacggctgtagggctgggtctatgttgcaagccctatatcctancatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagttgttagaaatgtttctgaatcaagtttgtttgaaaacacgttgtgcctttgtacccattataagatggtcataanacccaagaactgataagctttgggttttttttggtttggtttggttttttgcttcattttacccattcatgcctagggtttccat

SEQ ID NO: 3403 - DNA, 778 bp, Homo sapiens
  misc_feature (1)...(778): n = A,T,C or G
gntttaanncnnttttaatatncatncanctacttgttctttttgcaggacccatcgattcgaattcggcacgagggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagtttgttagaaatgtttctgaatcaagtttgtttgaaacacgtgtgcctttgtacccattataagatggtcataagacccaagactgataagctttggttttttttgtttggtttggttttgcttcatttacccattcatgcctagggttccn

SEQ ID NO: 3404 - DNA, 779 bp, Homo sapiens
  misc_feature (1)...(779): n = A,T,C or G
caacgctggctacttgttctttttgcaggatcccatcgattcgaattcggcacgaggctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaaccttcttcgggacacaaaanaaaaaaaaaaaaaactcgagcctntagaactatagtgagtccgtattacgtagatccagacattgataaagatacattgatgagtttggacaaaccacaacttgaatgcantngaaaaaaatgctttaatttgggaaatttggngaagcnn

SEQ ID NO: 3405 - DNA, 803 bp, Homo sapiens
  misc_feature (1)...(803): n = A,T,C or G
nnnnnnnntttaaatnccattnntttctnnnnnttttnatntanatacanctacttgttctttttgcaggatcccatcgattcgaattcggcagaagattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgactttgtcattaanaaagactggggtgggtgtggtggctcacgcctgtaaccccagcactttgggaggccaaggtgggcagatcacgaggtcaagagatcganaccatcctgncgaacatggtgaaaccccatctctactaaaaatacaaaaaattagccgggtgtggtggtgggcacctgtcgtnccactctaaggaggctgangcacganaatggtgtgaacccatgaggcacancttgcantgagcgaanatcgcaccactgnacgcactncaacctgggtgacagagcgagactccgtctcaaaaaaaaaaaaatttcaagactggagaggtnatcctgaattgtccagctacnccccatgtnatcacagggccttcatgacagggncagagccaccanctttgaaganncngtcctncccccnaacangcagnctgganaaacttggncangacaagtaggacattcctggagcctccanaanggactgggcttttnc

SEQ ID NO: 3406 - DNA, 773 bp, Homo sapiens
  misc_feature (1)...(773): n = A,T,C or G
caangctggctatcgttctctttgcaggatcccatcgattcgaattcggcacgagcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtcaaacgctgcttggataaggagagcaaagcttctggaactttatttactctntctttttaattntcttttaagagactgggtcttgctatgttgcccaggctggtcttgaactcctggcctcaagtgatcctccagtttccatctccctaagactgggattacaggtgtgagcccgctgtacccgaactttttttggtttttgcttcncg

SEQ ID NO: 3407 - DNA, 808 bp, Homo sapiens
  misc_feature (1)...(808): n = A,T,C or G
gnnnnnnnntttatttacattcagntatngnnnttttgntntaaatacanctcttgttctttttgcagggacccatcgattcgaattcggcacgagggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcanaagttttggccagtgggctgatagcccgggcnaacacccgtttatggattgggattcttctctgagcatcatctttcgaaanttgcagaaaagtttcagggaatttaaagaagctg

SEQ ID NO: 3408 - DNA, 803 bp, Homo sapiens
  misc_feature (1)...(803): n = A,T,C or G
tnnnnntttatttcnttcgttctngnttttattacatcagctcttttctttttgcggtccctcgttcgcaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagaagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaaccgagagcgagaacgagaacgggagccgagagagagagcgagagagggaaccgggagcgagaaagagaaaaagacaaaaaacgggacccgagaagaagatgaagaagatgcatacgaaccgaaaaaaaaaaaaaaaaaactcgagcctnttaactatagtgagtcgtattacgtagatccagacatgataagatacattgntgagtttggacaacccccacttgaatgcagtgaaaaaaatgctttntttgtgaaattttgngatgctnttgctttttttgtaaccatttttagcttgcaataaacaagtttnccaccaaccanttgcnttcattttnttntttcangttcaaggggaagtttttggaag

SEQ ID NO: 3409 - DNA, 823 bp, Homo sapiens
  misc_feature (1)...(823): n = A,T,C or G
tttatatacatcagttcttgccnttttgntngactanagctcttgnctttatgcaggaccctcgattcganttctgnncgagtctctctntctctctctgtgtctctcggaactggttccctgggctgaccggagccgggagaacaacctggcctcagggagagagacgctaccgggcttacgccaccccctctnctcaacacaagcccaaactgctacccgcgaggtgcaagtaagcggcacctcagaagtgtctgcgggccctgaccgggcgcaggtggtggtgcagtgagcagcaccaaggaggcggcagccgagccaaaaagagcgtttgtcgccgtctagattacatcacgcagagcctccagcancagggcgtgcangcagaaaatataactgtgacaaaggattttaggagagtggaaaatgcttatcacatggaagcagaggtctgcattacatttacttgaatttggaaaaatgcaaaatatttgtaactttntttgttgaaaagctaagatagctnttgttgtcatcagcccaccccagttcttatcatactccagggttctggttganaatcttcgacggcaagcctgtcttgttgctgttgagaatgcgttggcgcaaactcaaagaagtcttgtnaaccttgttgggccaaaccttangaaaaccttttacttaattcnaaggaagaagnaaacacaaggaattggggaagggccaaatagatgattnaccnagttcnttccagacttcttcaagttcaattaacttgtncnaccaaaaaaatcaaaagtggcaacnaatncattgcttn

SEQ ID NO: 3410 - DNA, 795 bp, Homo sapiens
  misc_feature (1)...(795): n = A,T,C or G
catncngtttcnagccnttttganatacattcagctacttgttctttttgcaggatcccatcgattcgatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacattaaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccactacttgggaggccgaggcaggagaattgcttgaacccgggaggcanaggttgcagtgaggtgagatagcgccattgcactccaacctgggcaacaagagcaaaactctgtctcaaaaaaaaaaaaaaaaaaaaaaactcgagcctntaaaactatagtgaggcgtattaccgtagaatccagacatgataagatacattgatgaagtttggacaaacccccacctnggaatgcngngnaaaaaatgctttatttgtgnaaat

SEQ ID NO: 3411 - DNA, 778 bp, Homo sapiens
  misc_feature (1)...(778): n = A,T,C or G
gnnnnnnntttaaantccatacagtttcaagnccnttttgaaatncattcagctacttgntctttttgcaggatcccatcgattcgaattcggcacgagagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatggggtggtcactggaatgacggtcactccagacgtcagccggcagggatgcancaggctggccgcgcaccggggctcgggcaccctctggccccacactggcaatgatgccacaccttgccatgtccacgctgttggtcaaacccctctgtcatgcctctttaaagagaaaagaagagaaagatttttttttttaatggcanaccgaaatggagatcttgtagcctanataggatagtctgaccttctancatagtctttttggcaaatgatttgtgttttcagtgtgtggggaanctgtcctgggggctggggcgacagatagcacataagctgtttntggggctgcangggctncctgactggatgttgtgggtgttgccngcttnagaatgtggcnacaaaaagcgtanaccggggccaggtntgccgcctgagctggctcccnaagntgggttgntcancgttattt

SEQ ID NO: 3412 - DNA, 869 bp, Homo sapiens; identical to SEQ ID NO: 3373
  misc_feature (1)...(869): n = A,T,C or G

SEQ ID NO: 3413 - DNA, 807 bp, Homo sapiens
  misc_feature (1)...(807): n = A,T,C or G
nttttatttacatanagntcttgcctttttnnanganatacanctacttgttctttntgcaggancccatcgattcgaattcggcacgaggccacnancaggtgggggccaggacgccnnggnnctgaccgcctccactagagggnggtggccgcgggccgacctggaccttnannccntgtccngacctnccggtgggtgggtgcgccngggagccngcnacattccttnttcttgancagccaaanattggagtncnattcnncnangnacnttttnttttttnngatcangagtgtgtncaacgtacncccctgcctnngnaagccctgantccntnatggagcctcnnagagtggggagcatattggggtggggtaatgcactncanccaagnngaatgnacacaangggntcgtcnaangnnntgnggncnccctnaccccttaccaccatgtgnngntngnctctgtggttgaacatcnnactngtncgcaaangganactnactntaaaaccctttgnacnanggtgcnaaaccacagntgtgncctgncncanctanccatcnaaagaatnacaaaaccncntnaggggcngngggcnancnntcncccttgtcncgncctgtnttggantggcctttcggcttaaacagtgaggctcanaanggncncaacctggggtgntaataaaaagaacnaattaaganactnttccctccnacccccctttccttgtngccagggggcancaaactngattnttgaagcccaanataaaaaaaaggcttnatatcnnggaaaa

SEQ ID NO: 3414 - DNA, 716 bp, Homo sapiens
  misc_feature (1)...(716): n = A,T,C or G
tntcnttcaaatngcttggctctcgttctttctgcaggatccctcgattcggaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggnggctcatgcctgtaatcccagcactttgggaggctgaggcgggctgaatcacctgaggtcaggagttcgagatcagcctgnccaacatggtgaaaccctgtctcaactaanaatataaaaattagcccgggccgtggtggcaggcgcctgtaatcccagctactcgggaggctgangcaggagaatcacttgaacccaaggggcagaanctgcanttaagccaagatcgcatcattgn

SEQ ID NO: 3415 - DNA, 774 bp, Homo sapiens
  misc_feature (1)...(774): n = A,T,C or G
tttttaaanaaancaggnttcctaatncttgttntnnnganacaggctacttgttctttttgcaggatcccatcgattcgaattcggcacgagattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtntaaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacggaannnannnnnnnnnnnnnnnnnnnnnnnnnnnnnnnnnnaaaactcgnncctttaaaactatagggngtcgtttacctaaatccaann

SEQ ID NO: 3416 - DNA, 717 bp, Homo sapiens
  misc_feature (1)...(717): n = A,T,C or G
tntcattcaagtnctaangctggtctttttgcaggatccctcgattcgaattcggcacgagactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaanggtggaaagaagttgtacgaaggtcaaagaaattgtctgttccagcctcagtggtgtcgaggataatgggaagaggaggatgcaacatcactgcaatacaggatgttactggtgcccatattgatgtggataaacanaaagataagaatggcgagagaatgatcacaataaggggtggcacagaatcaacangatatgcagctcaactaatcaatgcactcattcaagatcctgctaaggaactggaagacttgattcctaaaaatcatatcanaacacctgccancnccaaatcaattcatgctaacttctcatctggagtaggtaccacagcagcttccagtaaaaatgcatttcctttgggtgctccaactcttgtnacttcacangcaacaaccgttatctacgttcccancccgctaataaacttaataagaatgttcttagaaaaaaaatntnaaaanctcgact

SEQ ID NO: 3417 - DNA, 704 bp, Homo sapiens
  misc_feature (1)...(704): n = A,T,C or G
tgtncttttcanttgntagcncttggctacttgntctttttgcaggatcccatcgattcgaattcggcacgagcctgtttccaggagatatgtgtgnccatcagcagtgataaaantcttgggcaggagttattgcactgtttgtatgatcnanacccacctnctctgctggaaacaagcagcgtganttgntcacttgcctttcnnagncnctattggccagntgcttgnangngaacggatccacagaacctcacagctatttatgatancatctgctnnattatntcaagttcancntgtntnnacntgctgntnnaggtaanngnngttntnntcaagntntttgcaangngatgacaaactaatgtttgaatnngtcatgataanggggcntctnatactctggancatcnccaanctgantnngaagagctgccngnntatctgntagtgncctgctncttgaaattnccaaacanntgccntgntggaaattcatnatggctggatgtttangngnacattttncaantncttantnnncangatgatggaattcnnncnatcnaacatnctntncgctngntanacttnnnattnactnanngnctntnntgcnatnattngncnctctgtgatcatccatcatnatctangcntcaagtnnctaacctngnttngaagttgtngcaccannttnt

SEQ ID NO: 3418 - DNA, 708 bp, Homo sapiens
  misc_feature (1)...(708): n = A,T,C or G
tntncttnaaatcatngctcttgttcttttgcaggatccctcgattcgaattcggcacgagagagggtggggtctggccacataggtacctctgtggctctggtctggggttagacactgttagggactagcatttattggacttgtaaagacagcacctcagaattagtaactacttgcattttagggtctgttttatgaagccaacaagtgaatgtaaaataggctctgcatcttttctgagagccctgtcactgggcagtgagcatttccaaaattgcagctctgtcanaatgaaccatgaatacttaagaaagggaaagtaggaacagggagcagagcaaagcataacttgctgtgttccagggatttaaaaataaattactgtcaagagcaatataagggtcatgggtttgatcaggaactttttgtaaatgaaaaagttcacaatttggaaaaaacagtgctagatgtgttatggaaattgttatcacaaattattccactgaaactcaagtatataagacaacaatatattgctgtgaaatcttaattttgacatatggaagggtaccaaaaataagaaccatcctttttgcttgaantgcacggtggtaccaatttctaaaatangaaacattangcaaaaaaaanattnncttttnngcttnaaantanaaaaanctngnnccttttaaactttngngg

SEQ ID NO: 3419 - DNA, 708 bp, Homo sapiens; identical to SEQ ID NO: 3418
  misc_feature (1)...(708): n = A,T,C or G

SEQ ID NO: 3420 - DNA, 717 bp, Homo sapiens; identical to SEQ ID NO: 3416
  misc_feature (1)...(717): n = A,T,C or G

SEQ ID NO: 3421 - DNA, 743 bp, Homo sapiens
  misc_feature (1)...(743): n = A,T,C or G
tcttccatttnaagccctttgctacttgttctttttgcaggatcccatcgattcgaattcggcacgagagagggtggggtctggccacataggtacctntgtggctctggtctggggttagacactgttagggactagcatttattggacttgtaaagacagcacctcagaattagtaactacttgcattttanggtctgttttatgaanccaacaagtgaatgtaaaataggctctgcatcttttctgagagccctgtcactgggcagtgagcatttccaaaattgcngctctgtcacaatgaaccatgaatacttaagaaagggaaagtaggaacanggagcatagcnaagcataacttgctgtgttccanggatttaaaaataaattactgtcnagagcaatataagggtcatgggtttgatcaggaactttttgtaaatgaaaaagttcacaacttggaaaaaacagtgctagatgtgttatggaaattgttatcacaaattattccactgaaactcaagtatntaanacaacaatatatcgctgtgaaatnttaattttgacatatggaaangtnaccnaaaaattttgaacccataccttnttggcttnaaattgcanggtgggtacccnatttnttaaaaatnannanacctttnnnnccaaaaatnacttnatnctacaaaaaattttccncggnccatggttaanaaccttgnncncctttttnaaacttttac

SEQ ID NO: 3422 - DNA, 738 bp, Homo sapiens
  misc_feature (1)...(738): n = A,T,C or G
tcntcgtttnnatncttggaaatttgnanatngctaggctactngntctttttgcaggnatcccatcgattcgaattcggcacgagccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcatagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggnggantanttgtgggctggacaaatcaatcgtgtggaaattgttaggagtnttattacattaaacttgttaacctaaaataccatnnaaaaatanaatcngnnntaaaacnancntatanggatgtnanaanaactcgagcttctaaaactntagnggagcctttgttacgtanatccnngacatgnntaagatacattggtnagttttggacaant

SEQ ID NO: 3423 - DNA, 774 bp, Homo sapiens
  misc_feature (1)...(774): n = A,T,C or G
ctnntttnttttngaanccttngctcttgttctttttgcggatcccatcgattcgtgaagaggagacggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgattttttcatggttatgatnaaagaactggatttanccagaaacctttacctggattcaagatttaatttttcctttgagcctcatccttaaaggattttcgggaaaacattaaggggagccaaanccnattggntggttgggcntgccctnnaattgcctttggacttttttaaccgggcttttgnnn

SEQ ID NO: 3424 - DNA, 796 bp, Homo sapiens
  misc_feature (1)...(796): n = A,T,C or G
gccnccccnntttngntctcaacttgtaccctttttgcannancncgnnctncttgcaggntcccatcgattcgaattcgccacgangttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtanatcagaaatgacaaatgaattcaaaacctagcaggtgcattgtnaatgtgtgcccagttntgttttggaaatggcagttccttggggtcatgtttctactggcaaaatttgcaatantgtnctattgtntgtaatttcaaaatttataagattatcccccgttcgcccaagtaaaacctgtnctgcccaatanaatcctggantcgnngagaaatcgcntccattcgnngntcaactcgggatncntcgncttaanaaaatnttntccngganccccntcatnangaanaacaccanactattnngggnacctgnaangctcaatngcccnngccncnnangncnnttttccnggnaannn

SEQ ID NO: 3425 - DNA, 736 bp, Homo sapiens
  misc_feature (1)...(736): n = A,T,C or G
ctacttgttctntntgcaggatcccatcgattcgaattcggcacgangtcactctgtcacccaggctggagtgcagtggtgtgatcatagctcactgcagcctctacctcctgacacaagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtatttatgatgaccattgaacaaatgtgaagaatactgngaattctatgactttatcaaaatcagccacatcncaggagcttgcagttgttgaccaaatgaatgatgacatagagtagntcagatctatcatgtgctcttctatctaatcagtccaatatttccttggncctcaagccaacattcattttttatgtataacccttcttcatgattntnaaatnttgatagggtaaactgctaatgagtttcacaaatgtagcacttttaaaaggaaaaatnnnatgganagtgaaaacaacttgcctacctataattgtgggtctctaatctttctggttttaaaaannaaaantggcattgctaggtttcnnaancanaaaaannaaaaacnct

SEQ ID NO: 3426 - DNA, 736 bp, Homo sapiens; identical to SEQ ID NO: 3425
  misc_feature (1)...(736): n = A,T,C or G

SEQ ID NO: 3427 - DNA, 774 bp, Homo sapiens
  misc_feature (1)...(774): n = A,T,C or G
tnntntnnttnantngaaccctttnctcttgctctttttgcaggatccctcgattcgaattcggcacgagcacaaggagaagaagttaattaacattgaangatgagaagacatcttggaagaacttgaattgggccttggaagaagaacagccattcaaatagatagaattgtggtagcaaaggcatagaggtaggaaagtatagatctccagggacagtagtcatggggttggggcactgttggaatttaaggttggaaggatatattggagccccttgaatacggtaacaaggcacaccttgggcagtggagagttatcagagtgtttgaaaaggagggttattgagtaaataaatagactggtactttaggaattttaaaatgtggatcattgtactactaataactatttattttatatttactatctactaagtaatttacatgtattttcttgtactgactgtaaaccttctgggtgtgggtgttttaagtgccattttactgatnaagaaactgaggcttaaatagttgaaataagtcaccctgttagtgagtggccagaatgacaagtcagatctanggtttgtctaactnccaaagatnatataaaaataatggatctctccttttcccttatgcataaaatatggggagcntttttaaatcattacccatncgattgnccaaaaaaatacctttngggaaaactgattattantattccanaataaatttcaacggcctgcntngnctnctttacaactttnt

SEQ ID NO: 3428 - DNA, 740 bp, Homo sapiens
  misc_feature (1)...(740): n = A,T,C or G
aaacantttgctcttgttctttttgcaaggatcccatcgattcggccaacttcaattcccttttagtcatctacttcctactaacagctgtaactaggatgagtcaaaatcaattgcctatgctcaccagatccctgataaattcccatgaagccacctgaaaggtggtaaaagcaaggtaaaacgtggtgaaagcaaggtaaagaaggtagatttcacaattttgttttttaaaaaggggaatcttccctgaattctttgaggtactaagtacgtggtttaatgcatattttcattcttgttagcagtttaaaaataatgtttcagagactgtattcacgattgctaaaaagcattttttctactaatcattgttcatgggacttaacaatggaagataactgggaaagcagtaaatataggaaaccactaatagtgtctccttcttcctaccctgaccctctctttggcttcagaaagtgacgaggaaaatgtatctttcacaaagaaaagttataccacagaangtactaaaaagcaacaactgcctttggggacaggaaacttacagaggggattattatagagggataacataccgagtttctatttcaataagagggaaattggtttatattctgttcacacttgtttcaaaaccctctcctctaaaagcatgtgttttttggaattcaaggaatgtaccgttctttccccaacccttaaactggggggtcann

SEQ ID NO: 3429 - DNA, 743 bp, Homo sapiens; identical to SEQ ID NO: 3421
  misc_feature (1)...(743): n = A,T,C or G

SEQ ID NO: 3430 - DNA, 776 bp, Homo sapiens
  misc_feature (1)...(776): n = A,T,C or G
tgtcctttnaattctaatgcttggctactcgntctntttgcangatcccatcnattcgantncggcacgagggcaggggcccttanagtcttggttgccaaacagatttgcagatcaagganaacccaggngtttcaaagaagcgctagtaangtntctgagatcctngcnctagctncatnctnagggtaggangaanatggctnncnnaancatgcgngtgctcctattgctganctnnctgnccaaancatgagtcctgggtgatatcatcatgagacccacatgtgctcctgnatgganttaccactacttcaaatgctatgagtactntcagaaactntngaactggtctgatgcccntgntannnaacttnntnnctgnttggcctnncctntctagatcaanggancngcnntaatcccnaanttcatntgantnaagatcannngttcctgctnggcacctttcnagnataatccccttttngcttgntnaaacggaantnnanaaggngtgtntnnttcnaatcttattanaattcttgtnattncatttgctataatccctggagcctggatttcctggaanccgtaaaacngggcttctaagcaccttacncnnttccatccttgaaagnancccccgtnnncatncantnagnctnctanttntaantcntattggagaccctnaanattccntttacatcaaanggnnggtataanaatntttcnggnattttncagganctgngtaaaattnttattntacc

SEQ ID NO: 3431 - DNA, 731 bp, Homo sapiens
  misc_feature (1)...(731): n = A,T,C or G
tnagtttgaatgcttnganttgctaatagcttggctactcgttctttntgcaggnatcccatcgattcgaattcggcacgagcagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatgataagggccatctaataagctggggaatgtgggatctgtcttggttgagttggtggattaactgagattaacanagctggaggaaatgtaaaaagaaaggcaggattgttcattttgtcttttgtttgttttggggaacagggtcaaaattttcattctgcataaggtaggtttagtctttttcaaaacattctagtaggcaagtctgtagctgaatcttggaagaaangcaaccatagtaatatttttgagttnctactgnttattttttcaataaaaaactcaggttctcaagtttancagattcatnggtcttaggaaaggtagctgttnaaccaaaatantaat

SEQ ID NO: 3432 - DNA, 731 bp, Homo sapiens; identical to SEQ ID NO: 3431
  misc_feature (1)...(731): n = A,T,C or G

SEQ ID NO: 3433 - DNA, 731 bp, Homo sapiens; identical to SEQ ID NO: 3431
  misc_feature (1)...(731): n = A,T,C or G

SEQ ID NO: 3434 - DNA, 712 bp, Homo sapiens
  misc_feature (1)...(712): n = A,T,C or G
tctccttgaaattgcttatngctaggctacttgttctttttgcaggatcccatcgattcgaattcggcacgagagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtanacaaaggtttacactgacaatagctgtggagatagagaaaagctgcgagatttcagagttttccaaggtgtaaacaactaaattttgtgatcaaaatgataagggccatctaataagctggggaatgtgggatctgtcttggttganttggtggattaactgagattaacagagctggaggaaatgtaaaaagaaaggcaggattgttcattttgtcttttgtttgttntggggaacagggtcaaaattttcattctgcataaggtaggtttagtctttttcaaaacattctagtaggcaagtctgtagctgaatcttggaagaaaggctccatagtnatatttttgagttnctactgnttatttttcaataaaaactcangttctcangttagcanatcatggtcttaggaaggtagctgnanaaccaaaatatat

SEQ ID NO: 3435 - DNA, 712 bp, Homo sapiens; identical to SEQ ID NO: 3434
  misc_feature (1)...(712): n = A,T,C or G

SEQ ID NO: 3436 - DNA, 717 bp, Homo sapiens; identical to SEQ ID NO: 3416
  misc_feature (1)...(717): n = A,T,C or G

SEQ ID NO: 3437 - DNA, 722 bp, Homo sapiens
  misc_feature (1)...(722): n = A,T,C or G
gngtcatnctttnaantttctaatngctnggctacttgttctttttgcaggatcccatcgattcgctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaagtgtgtgcccagaccggaanagacggtccagcctctgatggctcggagatgatggaccgtggaaagggaaccntctgtggggagtgaaccgcttaanatggccagcat

SEQ ID NO: 3438 - DNA, 789 bp, Homo sapiens
  misc_feature (1)...(789): n = A,T,C or G
tnnttntccacttggaaccccttttnngaaancccgcaggnatcccatcgattcgctctgggagtagctgggattacaggcatgcaccaccatgcctggctaattttntatactctagtantagacagggtttcgcccatgttggtcaggctggtctcaaactctngacctcaggtgattcacccacctnagcttcccaaagtgctgggattataggcgcgagccaccatggctcancctcatgttcgtttttaaaacttaggatggtggctcttntacattgattggcaggaactcttcatattacgaggcacttagctagntgnctgtgaaatanaatactaatgattgaactttctaggaagtgcctattctgctaatagtgnaaatatacacttatccagggtcagnaatactnnagtntacccacttaaangatctagacatacatgaacttgggcttacttgcccgttanaattgcatatcttanaatagtccatcaccttacttaangnagatatgcntngattatccngattactcnntaacatagcctctcnccttancgttctcacctgaatgtantacctggacctctncaagtcnancagaggccnataataaaagttcanaagtttanncnnnacacccctctccccccncccantancccaancccctcccannaccccctctcccncccacncctcacctcnnnatccncccaccccactcnncnnncannccttcccccccaccccccnncnctacncctccntcccatcncg

SEQ ID NO: 3439 - DNA, 713 bp, Homo sapiens
  misc_feature (1)...(713): n = A,T,C or G
ancctttnaaattccntngccntaggctacttgttctttttgcaggatcccatcgattcggctgcacagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggtcagctgactttcacgatctcaggtactgatgaagattgtgaagattattacatcangtgaatgtangggtgatttagagaaagctggtagctaggctgttcaaggaagggcctctgtganaaaggggatggntggctggntgtggtggttcacgcctatnatcccagcactttgggaggttgggagtttgagaccagcctgaccagcatgganaaaccccgtctctactaaaaatacaaaattagcccggcatggtggcacatgcctgtaatccagctcc

SEQ ID NO: 3440 - DNA, 713 bp, Homo sapiens; identical to SEQ ID NO: 3439
  misc_feature (1)...(713): n = A,T,C or G

SEQ ID NO: 3441 - DNA, 724 bp, Homo sapiens
  misc_feature (1)...(724): n = A,T,C or G
cttgcctttgaaaancgttggctactngttctttttgcaggatcccatcgattcgaattcggcacgaggcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgnnntggggcccgtgcccacaccangcnancccctgtatgggatcanaggcncgaagangcantgnangctgntggcanntnaantactgnctgggctggaanangaactnntaaaagtcntngcccnnatccaccttggnacccnannttnnnccnntantcnnngggntnangtggtnnnnnctngggacagntcnntntggnntgncnatngnncnnatgnanacttggggttcannaancntttccnnatgnaancngngtc

SEQ ID NO: 3442 - DNA, 740 bp, Homo sapiens
  misc_feature (1)...(740): n = A,T,C or G
gttcaatnnttgaaatttnanntcgctaggctactngttctttttgcaggatcccatcgattcgaattcggcacgagccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcnagctggaaaagtgaacagtggttggtaggccatagtgctcccagctgggtgacataatgaccacacagcacagtgatgttattagcaactgtgtggtggagtagttgtgggctggacaaatcaatcgtgtggaaattgttaggagttttattacattaaacttgttaacctaaaataccatcaaaaaanaaaannttnatgnttnnacntacntgtnatnntanaaaaaaaaacnttgagccctttaaaacctattanngngtcctttttaccntaaaatccanaccttnnttaagaatncatttggattgaatttttggncct

SEQ ID NO: 3443 - DNA, 740 bp, Homo sapiens; identical to SEQ ID NO: 3442
  misc_feature (1)...(740): n = A,T,C or G

SEQ ID NO: 3444 - DNA, 738 bp, Homo sapiens; identical to SEQ ID NO: 3422
  misc_feature (1)...(738): n = A,T,C or G

SEQ ID NO: 3445 - DNA, 712 bp, Homo sapiens; identical to SEQ ID NO: 3434
  misc_feature (1)...(712): n = A,T,C or G

SEQ ID NO: 3446 - DNA, 836 bp, Homo sapiens
  misc_feature (1)...(836): n = A,T,C or G
ggagggatgaaaatgagccctgggagggaggaagggacgaggaggggtggctgcatgttaccgtccnctacctctcccacgtggagggtggagcagttatgagggaggaagtcaactgctgttcagcctcagaataaaggtgccgttcactggctcagttacctcctgtgtaccggcatcttgtgttgggaatgttcccccctncctagggaccaaggancacccctacaaaaanagtaantggttgggtgatactcccttaagccaaanaggagctacccaacctgttcttagggacccangttacctacaagggtgggagagaattcaatgggcccagatgttggtggaagccccatctctggggctcangtttcttggaanacttatactatccctaccctcctnaangcctgnatcagactaaaatntgtataantcanngcntgggaccctantcnanggtcttgggaagctnccctnnccnnttngggtnccnannagcnaacattnntcncaagggcnccncttatnggnaaaantgtnggnncacattccccccttctccaaaggaangnggccncgnattaacaatnngctanncttttcgccattggctnaaaancccctccccacatttccatnatttcangnttgngcnncattatctattnctttatantgnnntggtanncncttnttnnactcaaagnnnatcncttacctttcacnatcccncaattttncntggctccanctgtgnnccntttnganancctcnncctncttncttncagggantnttanangntnatctaaatntgnggcncatannt

SEQ ID NO: 3447 - DNA, 747 bp, Homo sapiens
  misc_feature (1)...(747): n = A,T,C or G
cttacnttngctctcgttctttttgcaggntccctcgattcgaattcggcacgagttcagggttggtgggtctgtggaccttgagctagtttttaatcaacatggaaactccagtgatctatttaaaaacttgcattgggtcatgccaggtttattggaggttataccctccaatgtatttccaactcagggttaaagccaaggtccttatggtggaagatggggcatataaactggcattctggcgctcacacactccaatatctactactctcccctcttgctcgctcagctgtggcttgcttattcagctttttgctcttcctggaatacatcaaacatatgtaggcccagggttttaaccattttaacaactgaacttgtaactgcactagttctccaggtaagcagaagtattagggttatggacagtttatccgaagtaataaccaggaatgcctaataaaaacatgcangtattgtggtaaaaaatagagttggtgaacaaggagttaccttctgactgnttctcttttagtgaagtaggaggcaaggttattagctaagagtgagatggttaggagatggtgtaaatttaaaggaaaagaattaaggtatgagatagttggctaggataatgaanttnntgaatggttttgagctaagtngtattaaaatcccctttaggtaatagacnatgaanttccaaagcnccacttagccaaccctgggttctttcttttcttt

SEQ ID NO: 3448 - DNA, 759 bp, Homo sapiens
  misc_feature (1)...(759): n = A,T,C or G
ttnnnntcaacnggacnncttttacccttcccgttcttnttgcaggntcccatcgattcgaattcggcacgagatgttgcccaggctggtctcaaactcttntttntcaagcaatactcctgccttggcctcccaaagtgctgggataataggcatgagccatcatgcctggccgaacttatttttaaattctttgggaatctaaaaggactatgtgctttcttttttactggattatgtgagaagataatagtttgcagagaaattcagtgaagcagctgataaaatgctttaaaaatatatttcagagaattgagcaataacagtgatgtcaaaatagtagccccaccttctccagcccacctaaaccaacactgagcatggacacatgcatttcttgtcatcagccagacgaaatggagtagcaaaaatccatcctatatgtcattgagtcttataatacagttctcttttctctgnctattaataaaagaccccactgaatgaagccggaattcttttaggcaatttaaactttctgaaatagaggaaagttggaaaggggcggtagtcaaggaatatagaagtaaaaaatatttttgaggtcaaatgcttatctgaacagattgnctagtctgattatttttaaaagtattatgttgatccagtggtttaaatttgaatcaaaagtaatgatttaaccaaaggttgtgcttccattattaacctcagaaacactaagaaaccgaaatcactttt

SEQ ID NO: 3449 - DNA, 736 bp, Homo sapiens
  misc_feature (1)...(736): n = A,T,C or G
ttnttncnnctnntggaaccctttttgcaggatcccatcgattcgaattcggcacgagcaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagttngtgatgttttctgacagtagcctncaagaacccgttgtgcgaagacagagtcctgcagagtccttccagcctagcctgcagcgccattttatttatattttttaataaaaagtaaaacannaaaaacagacccacattggaacagtgaatcattccatagagaggcccgtggaccatcgttgtcatgagtgatgcctggccttttgaaaccagccnacctaattc

SEQ ID NO: 3450 - DNA, 738 bp, Homo sapiens
  misc_feature (1)...(738): n = A,T,C or G
cttcttttcntnncacgttctttttgcaggatcccatcggattcgggagnaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattangtgttaagagttttccttcangctttacttangagaatggactaagctgaangtgtactttaccagcaagagtcaactctagaatttcangatgttccttctattgcctcttagccatctgtcaggaaatgtaactntggttttattttnggctattccanggggtaagccanaaaatngnaatgatnattctgattaatagcagaaactttttcatcccaaattataaggggnctgctcttttaaaaagcntctaagctaagtcnagagcttaggaactgtgac

SEQ ID NO: 3451 - DNA, 746 bp, Homo sapiens
  misc_feature (1)...(746): n = A,T,C or G
ttnnnttnttgaactttttaccctgttcttntgcaggacccatcgnttcgaattcggcacgagggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctnctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagccggggtcaggacaatcatctcagtcctgcatcttttcttctgctttcttccctccaagagcaaaacctgggcaaggggacttactgagtgggggtgggtgggggttgggaaaagggaaacnnntgggatatggnacatggntctnagcaggantgntgagctacntancgtnttgactcnaaantnngngagcagnnnat

SEQ ID NO: 3452 - DNA, 764 bp, Homo sapiens
  misc_feature (1)...(764): n = A,T,C or G
ttnntnttccttgaancctttttctacanncncctttgcagatcccncgttcgaattcggcacgagagacaaagaaaaggtggcaatcatagaagagtttntagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaattaaatttggtgaagcacttaagaaatgtcattgagattgagagacttttataggaaatcactgatgacccagtttgactttcatacatactgtatganggaanattacccttagnatcttatggtgggactttatttaaaaacttncannaatgttcnttcgacagccttccattttaacttcnaaggcnncaangaattnt

SEQ ID NO: 3453 - DNA, 758 bp, Homo sapiens
  misc_feature (1)...(758): n = A,T,C or G
ttnttccncctttttnaancctttttgcaggatcccatcgattcggactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaatttttttttttttaaattatgcaacgtaagatgtcctccttgatagaagtcttagctcctgtgttacaagggagaactcatttgagatcagtctgttggcattgcaatgaagtgctttgtatcangaaagtgtacactattgaccttttttcctgttcacaagctgagccatatgtacataatctagattttgttttcatagttttgcactttttatagcctatttttgaagattaacacatttgcaagatgatntgactcaatctttgcctaatccaaatgagtgttaccagagagcttgcntgtgactagaacccataaaattcttaaaanggggtatgttgataatagaagggcngggaatttaaaacccnggnttttaaaaaaat

SEQ ID NO: 3454 - DNA, 748 bp, Homo sapiens
  misc_feature (1)...(748): n = A,T,C or G
tntcccttgaacccnttttgntntcctgcagggatcccatcgattcgaattcggcacgagcacctttcctccagtttccaataacacattcctcttttccacctgagacctcaccagaatcacctttaatgtctatattcctaccaatagtctttttaaggcaatataggctttctctaacatgcacttcaaacttcaagatggaggggatgccatacaacaggactatgtgatggtttttggctgtgtccataggaagtcacaacaggcaagggaaagaaaccagaacccagtcatggagttaagaagtgagtcagagagtagatgggtagggacagtgaggtaaggcctctttctaaggaagtttggctgaaggatagactagctggacacatgctggctgtgtggggtagagggaggaatgatgganggtaggagagccttgagcctgcgagaagagtctctagaatagagaagctgaggttaaagttgtggaagacagtggggataactgagtgacagataatcangagaagaaaaggagatccagaatcatgaccagagagatgacctttgccaagagcacagccatctttcactgtcncanagaggtaggacaaaacgattggtgttcaagaattgggtttgtagcacaatattttaactatgtcctttaaaaaagtttctcccccagacactacccaaagccagtcctttcactacagggggccgacagaccntgaaaatn

SEQ ID NO: 3455 - DNA, 716 bp, Homo sapiens
  misc_feature (1)...(716): n = A,T,C or G
tctcantnctaggctcttgttctttttgcaggatccctcgattcgaattcggcacgaggtattcagcttggctggagcagaggcaggagtggggaactggggacaggtgagactagaggttggcagaaaccagccatagtagtttttgcctcatttggacaacaaggagccatccaagagagagcggtgaagctgatggtgacacagccatggcgcattgaaatacccccagtggctgtgttgtagggtatattgggttggggagggacaaggtcaggaggcatagactcgacatcatctgatgtgattcangacagaatggcgagcctgaagtgaagtgtctgtaggataagttggaaaggaaggaaccaatatgagatattaaagaagtgaaagctataggtcccagtgccttaataaaggtaaggagtaagagaagattcgagattgactcccagactctccagtctgctggacatgggagatggaatagaagttgatctcggnntggtcataggagagcagttactgtgttgagcatggatagcctgtcgttccccaggagaaggantacagcttggctggaaatnngcaatgccnannttggagagatccaccttggggtcactcctagggggccnacccttgnancccttgagtagcaatccccccagaaangatncaaagggcttgannctnaactttaaanaancnnt

SEQ ID NO: 3456 - DNA, 712 bp, Homo sapiens
  misc_feature (1)...(712): n = A,T,C or G
tttacantagtagctctcgttctttttgcaggatccatcgattcgaattcggcacgagatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggcacaccanatgcctctgcagtcctcgacagcctcttcagtgtccctcctgcggtgatgtccttactgtccccagccaaggccggggaccggtgtttcactgangacctgcattagaaacattttttaaattgttgtncaggaagagatgtgtcttaaaacagcatctttaaagctgantgtatttctttgcacaaag

SEQ ID NO: 3457 - DNA, 664 bp, Homo sapiens
  misc_feature (1)...(664): n = A,T,C or G
cacgagattttgccatgtggcaagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaatagatggcaaagtccactcaaaacaaccagttaagtgctcacgagagagtagtcaagcacctccagaaagaaaccgggtttttgttcacatagcangaagtgactccctgggtggtnattnatcttggaaacacaggtagattggcagaaaaacgggaacatgtaggtaccgcgatgttggtgcatgtncattactttgggataggctttctcagtctttcctcaaatgatngttgagccagttttccagggggcaattctgantgacttgcgcttgtcttatggtgtggtcaagggactttcanaactacngaaaacttttactganacagctgaaacaagagtataccggcntgagagggaagatgaacactcacctatgtaccactcttttgacaatnaatntagtatttctcaaatcaagtctnnagactgatcctgtctcaaaaaaaaagcctntagactattattgagtccgtn

SEQ ID NO: 3458 - DNA, 822 bp, Homo sapiens
  misc_feature (1)...(822): n = A,T,C or G
atcccatcgattcgaattcggcacgagccatgggcggctgcactcccnacanatgggagtgnccagggaggacttgctcagccatggatncacaccgacngctgagggggcgcctggctacctnntgtaccatccctgtgnctacatgcttgcangaggacggatggcttactgnangaanaagccngnatgcanntctgnatgagaacacaggcagancnccctctatagaaagcctgctttggnanacntnntcatanagccgagactncacntacntcacngccttggngaanatccaactcgaggngatctatgtcttacgttcctgcaagcgcccntggagctgcccntggancagtgtgccagccancnagagtgntggnnaagccccncnnannnaccttcaatcatggacagcacnaancggntggntctgcgcnagangtgctgggtaatgagnttacgtncaaggttngtatccactagagcccgangtatcatanccnccaaccacgtaactntgggnaatnnnaatnaatccaaagatttantngaaactttaattgcgaccantngtaagacaccntggtaaattttagcccaancnaatgaacncctcnngtctttgcaattaaaataaaatnactggcggntttanctgccccccanttngccatttctnnttttannaaaacaggncngttttccaaccatttncgnccctttttcttaaatngttgccttggnccgnattnttaaaaantcnnnatnctaaaatagcccganaagncttttggancaacnttntaaccttgggng

SEQ ID NO: 3459 - DNA, 715 bp, Homo sapiens
  misc_feature (1)...(715): n = A,T,C or G
ggntcttcnaatgctnggctntngttctttttgcaggatccctcgattcgaattcggcacgaggtcacctccactagagggggataaaaaggataataggaaatcagaatattttgatttgtagttcaactgttgatcaattatctttgagacttttaacattcatgactaaggaggattaataattaacatgagctgtagaattaaggtttgtatggcatgataagtataaaccagttttgggaccgctataattctaaaaaagcaggtagactagatgattagttgtacacttattactgctaattcttgattgtagaacaaattttcctatgaaaaccatgttgtgtattttatatctctattagttcgttaaaagtttancagttttagatgtcgaaccagtaaaaaacaagttgcccattctatcattttttttattgtggtaaaatatatttaagataaaatttacgattttaaccatcttaagtgtacattggtacagtggcattggttacgttcacaatgttgtacaactgtcatccctatctatttccaaagctttttcatcacccaaacagctctatacccactaacaacaactccacatcacccactccccagccctggttatctctgntctactttctgcctctatgaattcggatattccagttggnncatataagnnggactcatataatatnngcccttt

SEQ ID NO: 3460 - DNA, 749 bp, Homo sapiens
  misc_feature (1)...(749): n = A,T,C or G
tcttttctaatgcttggctctcgttctttctgcaggatcccatcgattcgtcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaaatgatgagaatgcttcctacctttatggatgtctntttctatggtatctaccattcaaaaacttttttaaaaagtttaaaagttctagcaataaaatccaattggtacagacattttgggtatcattttttggttcttaanccann

SEQ ID NO: 3461 - DNA, 935 bp, Homo sapiens
  misc_feature (1)...(935): n = A,T,C or G
ccntcatcctttttacagnttttnaactntttcngcagnnnccncgantccgcnantncanntggggaacatcttcttgtctgctggacacctgatttgggcccggttctctgccattcctttctgcaattacatgggtttcccagctgttttgcgcggccttggagcacccacagaggcggnccctgctggcangctatgccctgggtgtgggactcttcctgcttctgctccagcccctnacggaccccaagctctacggcagccttcccntttgtgtgcttttggagcgggcaggggactcagaggctcccctgtgctcctgacctatgctcctggatacgctatgaactctcaccggctccccagccctncccancaaggggtactgccanggnnaagnggcttggcctngggtccccccanaatctcanggaatttattgnanngggganttgnaagccngaagctantctacnttccccaggggacccaannagcaanagtaagcnncattttncnnaaangggtgcnnccccccttntattgaaaagggngtngtntntatccaangccancnttgntnatcttgnacggnngaccaacggcgccctatgtntcccangnaancctcancannaccttctactttttactcnnactntnttccnacctncttntncttcnatnctttaantttccctctnnccattnctcnaaaatanaccttctttncagnggcttnnntntnacatcanttaaataancncttntttcctnaaatacatccnaaacatcnaaccnaaccttatnccctncgggnctttttcnacacntanttgncacttctctatatgcgaactacananttaaccatttttggacanatctcggnngananttatttctataatccacactaatnncanntacnt

SEQ ID NO: 3462 - DNA, 750 bp, Homo sapiens
  misc_feature (1)...(750): n = A,T,C or G
nttttgtatactttncccttntctcaggcctttttgcaggatccctcgattcgccacgactcatttgtttcattcacattcctcacgtgcntnaacatanttatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaaagttgcatgattccatgaagctttagttttcctttttttggttttaaaagaaagggttttatatgttctattgnaaaatatggaaattaaacagggacttcaagaaagccgcacagaaagatcaccttctgatggngtgatggtgctcctgacattcnggccgangtctgnattctgaaaaaagan

SEQ ID NO: 3463 - DNA, 734 bp, Homo sapiens
  misc_feature (1)...(734): n = A,T,C or G
gcttgnctnctnccttttcaaatngctnggctactngttctttntgcaggatcccatcgattcgaattcggcacgagagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatgataagggccatctaataagctggggaatgtgggatctgtcttggttgagttggtggattaactganattaacagagctggaggaaatgtaaaaagaaaggcaggattgttcattttgtcttttgtttgtttntggggaacagggtcaaaattttcattctgcctaangtaggttttagtctttttcaaaacattctagtaggcaagtctgtagctgaatctttggaagaaaggcaaccattagtaatattttttgaagttccctacctggttaattttttcaataaaaaactnaggttctcaggttagcnagaatcatggtcttaggaagggtancttgtaagacccaaaattatnt

SEQ ID NO: 3464 - DNA, 789 bp, Homo sapiens; identical to SEQ ID NO: 3438
  misc_feature (1)...(789): n = A,T,C or G

SEQ ID NO: 3465 - DNA, 757 bp, Homo sapiens
  misc_feature (1)...(757): n = A,T,C or G
ttncctccncttaatccattccttnagccttnntgcagatcccatcgattcgcttttctggagggagacacccatctcctgcccttggacatcaggacttttngttcttcggcctttggactcaggcttgccacagangcctcccagggctctcggccagtcagcctcagaatgagagttacaccactggcttccttggttcaaccaccttcttacctggactgagcctcacttacagcttctctaggtctccagcttgcagacagcctatgggaggacttctcagcctccataagtgtgtgggccagttcgcctaataaatcccctctcctggccgggcgcggtagctctcccctgtaatctcagcattttgggaggcagaggtaggtggatcacctgaggtcaggagttcaagaccagcctggccaacatggtgagacccccgtctctactaaaagtacaaaaagtaactgggtgtggtgctgggtgcctgtaatcccagctactcnggaggctgaagcangagaatacttcgacctgggaggtanaggttgcagtgagcccgagatcgagccactgcactccagcctgggtgacagggcaagactctgtctcaaacaanatnaaaatccctctccaaaaaaaaanaccnctcccaagtttaacccattcanntccnttaccaanngaancntctattnancaaaanatcnnnccncctnccccnccacccccnngngtcnttaatcccnanncc

SEQ ID NO: 3466 - DNA, 780 bp, Homo sapiens
  misc_feature (1)...(780): n = A,T,C or G
ntttcttttnttttccnaacaccnagcctacttggttctttntgccangatccccattcgattcgtgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttanaagaatggggccacatancancanaggactgttgtaagggagggaggggtanggacagaagctagacccaatctcctttgggatgtgggcnggganggaaacacgcttgganggttaatttacccacnnaatgtgatantnatagggganggaagctgctgtgggtttaactcctgggttgncttgttgggtagacagntnggggaaaaaggccccttgaattcattgtaagcncaagtcccaacttngcccctgactccctgccnggnggtattnggggaaactttttgacncaaaaccatcngnttgctnnctggaccttttgcangcccctttanccccnttnt

SEQ ID NO: 3467 - DNA, 741 bp, Homo sapiens
  misc_feature (1)...(741): n = A,T,C or G
caacngctctgntctttttgcaggatccctcgattcgaattcggcacgagaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctnccaaacctcaagacaagaagagcatgggactcccaccaaggatcggttcccttgcttctggaaatgtncggtctttaccatcacagcagatggtgaatcgactctcaataccaaaagcctaacttaaattctacaggagtcaacatggatgtcccagtgttctgtataaaatgcaaaataaatggtttttattaaccanacaaanaaaaaaaaaaacntcgagccctn

SEQ ID NO: 3468 - DNA, 741 bp, Homo sapiens; identical to SEQ ID NO: 3467
  misc_feature (1)...(741): n = A,T,C or G

SEQ ID NO: 3469 - DNA, 860 bp, Homo sapiens
  misc_feature (1)...(860): n = A,T,C or G
ggaactggctcaggctggattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatganagagaaaaaaatctggatgacaaagcatatcgtaatatcanggaactggaaaattatgctgaaaacacacagagctctcttctttacttaacactagaaatattgggtataaaggatctttcatgccacatcatgcttgcacgtcattattgnaanaagccccnaangcatttgtccacctgcntngaagcgncaacacccntnttccttggggaagcctttnnncaaaaaggcngttcccntttctccatggnnnttnttntcncnntggcctnccnttnggccgatttncactnacnnaangnaccttcnnctttctcgnnatggatatcccaangngcttttnnaccnnctcgnacccacnanctggntaantctnacatctgcacccnttctggccnccntcttcctcggntcacctanctccgganccaccnatctcnctncccattggtctctcgaggnttcnctctnttnnctctctcacatnatntantntngcnncncccttntncgttntaaatanntccatntcntctcncccngnntat

SEQ ID NO: 3470 - DNA, 1191 bp, Homo sapiens
  misc_feature (1)...(1191): n = A,T,C or G
tgttttgtttttgaaccctttttggnantcccgcaggatccccatcgattcgaattcngcacggagaagactttgggaaacacacattaaaatattctcatgcttttnaacgccagcgcaccaagtagcagnctcagcactttcaaagataaaaacaaaaatgatggccttaaacctaagcaggctgacagtgtanagcaagctgtttattactgtaagaagtgcacttaccgagatcctctttatgaaatagttangnagcacatttacagggaacnttttcancatntgncantactnttncatantacaggcnggnnaannnatcactcaatggggcntgttnncnntangctctctatnttcntcncnntanncnctgccancnnncttnnnnatnnctnnnnnntntcnctnncccccttaattcccgntnnantngcanntnctcnnanctancnatcnanatgnactcatatntttcacncnccctgccntattcatcaacannnnngntancgcatttnnctcactctatntctctctnntnncnnntttntntntcgatatctcttnnacncactacntncctctctnactctcanantactcttntctctctactcttcanacngtnntnaancctctctatctatcncacntnnnatatacancacnctctctactancacacntctcncatcagactctcntctantcacanacgatcctncnctctactnttaccgangnagtcnccntctccnnttacttnaatnccacnnnntcactnnccnatccnnctatntcgcatnnatncactcactcnttcnatncttatntntncnccntctctctntntccnantgangatacatatgtccanactcnancnttccnatcnnctcnctgctnttntncactntctcntntcaccntctannacatcntctctntcnnacgttanatacaatacgctntntacctctctattnttntctgacacanatctcctcctcaccactcactctgntcacgtatctgcgaacactacncantccgtctcacctntnanatcgnctctacantctctnactactactctctcactcntctctctacanctntcacatctctctctacctctccacgctntatacatatacctcctncactcctctnanngtnntt

SEQ ID NO: 3471 - DNA, 736 bp, Homo sapiens
  misc_feature (1)...(736): n = A,T,C or G
ttacctttagctcccgntctttttgcaggacccatcgattcgaattcggcacgagggctaacttgccttgttttactattgatgtttgtgtcctgtgtccttaacactttaagcagctgttctcacctaaaggctaatagttttaagtaagtttctttttctttttttaatttaaaaattaaaaaatttttaattaactttttttaaattaaaaaaaattattaattatttttaatagacaggatcttgctatgctgtccaggctggtcttgaactcctggtctcaagtgatcctcctgccttggcctcccaaagtgctggtattacaggtgtgagtcactgcacctggccaagtttattttttctgtatacatttcttcagccacttcaatcaaacatttaattaacatgctataatgaatgacttttcttactaggctaacaaatgaggcacttggaaacttactttagttacagcctcactttctttttttgngaggaaattctgtgttgacatactctttaatttctttttaccttttctgactgattttctgtaatttgggaatattgngatgactgcttattctaataatattaacatatagcattcttttagcacataaatagtttcatttgcatagtaagcgccaggctttnccatcgaattttgatnaaaataatccatgcttcatggtaccttagagatgggatattttaaggcctctanaactan

SEQ ID NO: 3472 - DNA, 750 bp, Homo sapiens; identical to SEQ ID NO: 3462
  misc_feature (1)...(750): n = A,T,C or G

SEQ ID NO: 3473 - DNA, 847 bp, Homo sapiens
  misc_feature (1)...(847): n = A,T,C or G
tcttttcnananctcnngccttctgcaggnatcccatcgattcgccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacatangtgagtctcttaacctttctgngcctcagtttttctacctctaaaggggtgggatggntcttcaaantgnttctaaaacaccggcactttcagcagtgttcnggtggcctgagatgagagcccgtgttcagaagtgcctgggagtggcccactgggaaactccgcttgcacngaccntggagtctgctcangacctgctgtnggaccacacancctnatgcgctgngaaagcanaaggaantgctgggngtaaaagtttgncattgatttccttngangccttttnaanncctcccncttcttttttgnntttaaaaaaanaaaaaggggtntnttatcantggntccnnntttcggnaaaaaantnttgggcaaaacttttnaaaccnaggggggnccttntccacgcaaaaagccccgcacccaggnnaacngnaatttccccctttnccnggnatgggctcngtcggaaatgcngccttncctcnggaaccanttctcgggccccnaannggtnnnnggccnatttcncctggnaaaaaann

SEQ ID NO: 3474 - DNA, 847 bp, Homo sapiens; identical to SEQ ID NO: 3473
  misc_feature (1)...(847): n = A,T,C or G

SEQ ID NO: 3475 - DNA, 694 bp, Homo sapiens
  misc_feature (1)...(694): n = A,T,C or G
gttacgctactggtgttcaattattagtttgtaccatttttaatttatgtcagttgatgcatctgaaaataagtgcttggagtgttcgtacccttattttttttaagattcctagaaggaatcttnggttaattcagattgagcanttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggtttactgtnatggaatttatgatcttaagaaattactagttgcattatttatccctatgattcattcattcaatnaagcntttactgcataaactttacatccngcactgtagcttaagtnccccaaaaattgaatngnanntaattgngctnttcganaattgcccaacgcnnngcccaggccaccggtggnttnaccgcctgtnggtccccagcnttnctcggggaangcccnagccntnccgganccccnagttcnnnaaaatccagaccntccctggntaacnnccgtcaaaaccccggtctnttantaaaaatncanaagatttancntnggccttggtnggcncccccccncn

SEQ ID NO: 3476 - DNA, 760 bp, Homo sapiens
  misc_feature (1)...(760): n = A,T,C or G
tcttttnttnccttttcgntcntgttctttttgcaggatcccatcgattcgttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttgcatatggaggacaggtggacatggtcctgagctctggacggagcangcaccctgatctcattctgaggtccacatggcaccttctgggccagcagctgtggcccngtgtatcaaagggcgccccttaaagctggaacattccacaagcttcttgcgcttttntgcacccngcaggcccactttcctggcaccctcgantttatataaaaagttgccctgcgtttnaaaaaacccaccccctgaatgaattaaaanggagcccctggcttggaaaaaanaaaaacatctnncnctnnntatcncnnaaaananaaccnnnggcct

SEQ ID NO: 3477 - DNA, 762 bp, Homo sapiens
  misc_feature (1)...(762): n = A,T,C or G
tnctattttntttccaancctttgctacttgtctntttgcaggacccatcgattcgctggaaacctttaccagaaagtgacgggcaaggactgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggangggagcctccattccacggncaccgagacttatgcttcantagggactttgaaatgggggaggcagtgtggaatactgtggatgtctgtgcagagcctttgccggcactgaaggcatgcagcctgtcggcagagtgtcttaacacccagatgcctactttttactgnatngtagtttattgcccggagatgttggggcttttttttttaaataaaataatcataattaaatgttcatgaaaananaaacatnttcnaaaaaacttcnagcctctngaactntantngagtccttatnacctncatnccagancttgntaaggattccattgatgaagtttn

SEQ ID NO: 3478 - DNA, 1191 bp, Homo sapiens; identical to SEQ ID NO: 3470
  misc_feature (1)...(1191): n = A,T,C or G

SEQ ID NO: 3479 - DNA, 756 bp, Homo sapiens
  misc_feature (1)...(756): n = A,T,C or G
gnntttanncnnttgaaanccnctngctacttgttctttttgcaggatcccatcgattcgaattcggcacgaggcctgccagaatggaagcatacagatctgggaccgaaatttgactgttcatcctaagttccactataaacaggctcatgactcgggcacagacactttttgcgtgacttntttcctatgatggtaaatgtnccttgcctctcntgnangtgacgattcattaaanttatgggacatccgacaatttaataaaccacttttttcagcctcgggtcttnccaccatgttcccaatgactgactgctgtttcagtccanatgataagctcatagtcactggtcatctattcaaagaggatgtggcacngcaaacttgttttctttgagcgtangactttccaaagggtgtatgaaatagacatcacagatgcnantgttgttcgctgcctgtggcatccaaagctgaccagatcatggttggaactggaaatggattggctaaagtctattacgtccccnacaagagtcagangggagcaanattatgtgtgggtaaaacccaacggaaggcaaacaagctgagactctactcaggactacatcatacccctcatgccttgcctatgttcgtgagccngccacggagtacaaggaacagctggagaaaggcanactggatccctgaatcgcataaacctgaacttctgtaccaggcccagggcntggtggccanttggaacccacg

SEQ ID NO: 3480 - DNA, 737 bp, Homo sapiens
  misc_feature (1)...(737): n = A,T,C or G
tacagctcttgttctttttgcaggatcccatcgattcgaattcggcacgaggaaaacatctaactaagatggtttcactggtgaattcaatcaaatatttaaggaacacataataccaaaaccataacacatncaaatntatggcccttcagattttgtncttcttttngggtcagtgttaataatacgtatctttcaaagaatatccccctttttttttggtagagataggggttttgccatgttgttggtagcaagccctaaccctgtcataaacaggccttaaataaactggccataaacaggatttctgcagcaatgggacatgctcatgatggctgtcatgcacactgcgaaaagttgttggtttactggagcagggcaaggaacacctggccccgcccggagcaaaaaactgtcaaaccacaaacgatagcaggaaaggcctgtgccttggcagcatgtttttgctgcagataatcagccagagcctgtttctctgctcctcgctgagattgctttgtttcccataaagattgcttttagctaatctacaatctatagaacaatgcttatcactgctttctgtcaataaatgtgtgggtcaagctctgnttgtggctctcagctctgaaaaaaaaaaaaaaaaaaaaaactcgagcctntaaactntgngagtcgnttacctanatccagacntgataggatccatgatgagtttggncaacccncactng

SEQ ID NO: 3481 - DNA, 760 bp, Homo sapiens
  misc_feature (1)...(760): n = A,T,C or G
tttgaaancccttagctcttgttctttttgcaggatcccatcgattcgaattcggcacgagattcgaacatatgcagttattccactaaatgatgaatgtgggattattgaatgggtgaacaacactgctggnttganaccctantctggccnaactattttaagaaaangggngtggtttttgaacaggaaaagaaccttcgcccggtggtatgcctccaaangcagcaactttatctggaaaactcaaangtattccgagaatttcttctgnccaggcatcctcctatttttcatgantggtttctgagaacattccctgatcctacatcatggtcagtagtagatcagcttactgccgttccactgcagtaatgtcaatggttggttatattctggggcttggagaccgtcatggtgaaaatattctctttgattctttgactggtgaatgcgtacatgtagatttcaattgncttttcaataagggagaaacctttgaaagttccagaaattgngccatttcgcctgactcataatatgggtaatggaatgggtcctatgggaacaganggtctttttcgaaaacatgtgaaagtacaatgangctgatgcctgatcancgagagcctttaatgagtgncttaaagacttttctcatgaacccnttggggaatggggtaaaccatgnaangggcnttccaaacgccccttgaatgaaacctggaaaaattgncaatgaaaaggccaaanccnttnt

SEQ ID NO: 3482 - DNA, 752 bp, Homo sapiens
  misc_feature (1)...(752): n = A,T,C or G
tatnnatacaagctacttgttctttttgcaggatcccatcgattcgcacagttctgcatggctggggaggcctcacaatcatggtggaaggcaaggaggtgcaaaaccatgtcttcacatatgggcaaggcaggaaaaaccntgtccaggggaacctccanttattaaaccnntcaaacttcattgaagaattaatcacttaccacgagaaccagattgggggaaccattcccatgaatcaattattctgcacctggccccaaccttgacacgtgggaattattcaatgccagggtgagattgggtggggacccatccaactatgtcaagtatgttttgacttctggcttgattgctangtttgcatagangacaaacatggaaattaatgaagtaccttaatatctggcttcagatcttagacaggatcaganggccagctcaaatttgcaaggaggggaggtagatcccaccattttatgggctatggcaaaatcaaacagaaattatgtgggatgggagatctgatgcangcatctttggaaacatctacttagctaattttatgctaggctttaggtcaagaaggagagaaaaagctgcatgctgtggtacacacttattgtcccancgacttggnaaactnangcaggangattgcttgatcccaagaatttgangtaatgtgccaagaaccgtcttgngaatagccctacccctgaactcaacttgggcaacattganaaaccctn

SEQ ID NO: 3483 - DNA, 783 bp, Homo sapiens
  misc_feature (1)...(783): n = A,T,C or G
gnnnnnttnnnnnttttaancctttagctacttgttctttttgcaggatcccatcgattcgaattcggcacgagaggcgtccttgcggaaagggcattttagctgaggctttggagtacgaataggagctcagcaggcagacgaaatgaaggaantaaaggtcagaagaaaggtcagaagcttgagtgacgttttggaaatccaccccgttttatttggtagaacttgggggttcaaaagggccaggtgcctcagaatttgaggcccacacagtgaggtctggtggggttgaaagggacccaggaaccgaggcgttcaggaaagcaggttgtcagagctatgtggagtctgtgggtggcangggcaaccgctccagcctttgaagactttgaaagccagagattcctgcgcangcttggacttcctgggagctcctccaagtacccaagggcatcagagctgcctgggtgttacatggcccaaggaacccaggttcanggtaggacaggcaagaccagatcccaatgtgcaaagtgaaaacactgggctcctgttaaacgatgaagaattcaagacagtgacagcattacgtcacccctggggacaaangtcaacctaaggtgacacacggggactactgtgctttcggangctncctgtgtcctggagganaaaagctttanagggggcaactggacaacttccacttgcaaaattccaaccttgcttgggcaaggncccngnctgggactnaacatttttgatatgccttaaaaattattt

SEQ ID NO: 3484 - DNA, 733 bp, Homo sapiens
  misc_feature (1)...(733): n = A,T,C or G
tacangctcttgttctttttgcaggatcccatcgattcgaattcggcacgagggaaccatgagaaccgaagctagaattgctattgaattactttattttctcttccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaagacactgggtttagacattggatattttaatgattgggnggtctaatcatgtgctgcaactgagttatctagngatatgacctcctgcttgccaaagccngaattnaagcaggattcctgaatctatcttaaaattgcaatgaaaaccttttccctaaaatatcccttttgtaa

SEQ ID NO: 3485 - DNA, 806 bp, Homo sapiens
  misc_feature (1)...(806): n = A,T,C or G
gnnnnnnnntttnngnntnatgaaaacccctttaatgaaaccctttttgaanccttatgaancccttngctgcaggatcccatcgattcggcagcgcaccaggtggttttaggagaaaacttgatagccacagccctttgtctttctggcagtgggtctcagtctgatttgaaggatgtgggccagcacagcaggagaggagggggacacaagccttcgggaagagcctccatccagtcactcggctctttaaggcagggtgccatactaagcagcttgcctccaggaattgctctgaagagaaatccccacaaacctccatcctaaaggaaggtaacaggggacacaagcttggatttccgacctgtagtgtctccagcaaatggggttgaaggagtcccgagtggatcaggatgatgatcaagatagctcttcctgaagctttctcagaacattgctgtcagactgactttaagacagctgattcagaggtaaacacagatcaagatattgaaaagaatttggataaaatgatgacagagagaaccctgttgaaagagcgttaccaggangtcctggacaaacagangcaagtgggagaatcagcttccaagtgcaattaaagcacttcagcaaaggagagaagangaaatgaagaatcccaggagatattaaaggctatcaggatgtgacaattaaaccgggaagaaacaaagaagaagattgagaaagagaanaaggagtttttgcaaaaggancaggactgaaagctgaaatgaaaaactttttgaaaaggccaaaggtan

SEQ ID NO: 3486 - DNA, 792 bp, Homo sapiens
  misc_feature (1)...(792): n = A,T,C or G
gnntttnannnnnnttttatnnatacaagctacttgttctttttgcaggatcccatcgattcgaattcggcacgaggcataacgaacctaaccctcagaggtttaccaagattcaaaacacgaaactgaccatgaaaccgggacgggcatttgggtcaagtgcgggtnccagtctttgggaaggtggtcttcgggcaacccacttctttcaaccaattttcacaagtgggaacaattggggcgggccttccgtcgtgggcccccttcgggggcttgacactaatgggacagaagctctcggtgcccgaaagattgcctgccaganggacttgaccacagcctggctggcaactgctctgtggaggacctccaggactgagactgggctctggtttccaagggtcttcactaggccccctactacacctggaagtttcagaacccactttggggggcctcctgcctgggcaggctcttcaagtgtggccctctttggagtcaaccctnctttccgacccccttcccctagcccagccccagtcactgtcanggtcgggccaacccctgcactgccttgcanantggcctgggctaggtcacttcacctntctggcctaatttncccccttgagtccctaaggcctggaaggtgggaagtatgtctanggggcaatgtctttttcanggggaattctaactnttgggaacccccttgttccaagggaagggnaacctttttcattcaacattgtaggggcnaagctttgtgcgccccctgttaggancaaaccn

SEQ ID NO: 3487 - DNA, 760 bp, Homo sapiens
  misc_feature (1)...(760): n = A,T,C or G
tcccttggnnnnnnnnnnnntttnannatanagctcttgttctttttgcaggacccatcgattcgaattcggcacgaggaaaacatctaactaagatggtttcactggtgaattcaatcaaatatttaaggaacacataataccaaaaccataacacatacaaatatatggcccttcagattttgtacttctttttgtgtcagtgttaataatacgtatctttcaaagaatatccccctttttttttggtagagatagggttttgccatgttgttggtagcaagccctaaccctgtcataaacaggccttaaataaactggccataaacaggatttctgcagcaatgggacatgctcatgatggctgtcatgcacactgcgaaaagttgttggtttactggagcagggcaaggaacacctggccccgcccggagcaaaaaactgctcaaaccacaaacgatagcaggaaaggcctgtgccttggcagcatgtttttgctgcagataatcagccagagcctgtttctctgctcctcgctgagattgctttgtttcccataaagattgcttttagctaatctacaatctatagaagcaatgcttatcactggctttctgtcaataaatgtgtgggtcaagctctgtttgtnggctctcagctctgaaaaaaaaaaaaaaannnnnnnnnncctcgagcctntaaaactatagngagtcgtnttacgtanatccagacatgataaganccattggtgagtttg

SEQ ID NO: 3488 - DNA, 752 bp, Homo sapiens
  misc_feature (1)...(752): n = A,T,C or G
gnnntntnnnnnntntnatngcctnaagctacttgttctttttgcagggatcccatcgattcgaattcggcacgaggtccaggcttccttctgatggccaacccacctttaatgctggccagtctatctcacacaaagttctaagttttccaggtgtcatagtaactccatagtctccttaaatccctttttgaaatttttcaacatagttcctagtgggatgggcttactttgtgcctgacccatgttttctcaagacaaaacaccatggcaggaacagccacttgcatctggtcccggtgccacactgcggtgcttggtgtggttgtggagcctgtccctgcgcgccttgctcccgttgagccacgctgtctggtgggtgattctctgcctgagccaccaccctggactggccagtctccagagctggcacaccctgctgttttctctttttagacacaacagccgcagtttggcagccactaagtcccaccagctgaggtccgaggaaagcggggtgactcatttcccttgtcagggcccgaggagagtgaggtgtccagcctgcaaagctattccagctncttggtgttggttgcaataaattggtatttaacaaacaaaaaaaaaaaannnaaaaaaaaaaaactcgacctntaaactatagtgagtcgattactanatccagacatgataagatncatgatgatttggacaacccacttgaatgccntgaaaaaatgtttntttnn

SEQ ID NO: 3489 - DNA, 761 bp, Homo sapiens
  misc_feature (1)...(761): n = A,T,C or G
cgtnttttnnnnccnanngaaagcccttggctacttgntctttttgcaggatcccatcgattcgaattcggcacgaggatcagcccacctcggcctcacaaagtgntgggattacaggcgtgagccaccttgcccacccacatcatacagttgaaatgaaactttgccacaaccagcctttgctgtacacacacatatatcactgaacctggttgaaataaagntttttttctttttcctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagtttatttccttttttggttgatgggcagtatgccatattatacccaaagttcttttaaaaaatatttccatcaccatttttatttaaaataaacatttgagggaagtaccaaggcagcttttttcctcaaaagtacctggtcctctttgggaatagcacattttangggcattgggtaatcctgagattttactcantaaatcctgatggtactgggtgtaaaatatctttagtnggattgaaggccttgnggggga

SEQ ID NO: 3490 - DNA, 805 bp, Homo sapiens
  misc_feature (1)...(805): n = A,T,C or G
gnnnnnnnnnnnnnnnttttgaaanncctttnttnnnnnnngnntttanncnnttgaanacnanagctacttgttctttttgcagatcccatcgattcgaattcggcacgaggcaaggcgccgggggacacgttggctgcgttttcggcgggcttccgggtcaaaaatggctggggcttgcgaattctnctgggctactncgtaggcanaanggccantttgggccccgaagttctgggngtcgaaattcggccggacgggaagcttangatatccaccaccacaaattccaaaaatgatgtgatgatcagaaaaagaagcttatgtgcccaagaatgtaatgggaaagaactgaagagaattattgatgacagtgaaattacaaaagaagatgatgctttgtggcctcccctgataggggttggcccgacaggagcttgaaattgtaattggagatgagcacatatcttttaccacatcaaaaataggttctcttattgatgtaaatcagtcaaaggatcctgaagccttcgagtattttactatttggtcaagacttgaaatgtttagttttcaatcttattggattacacttcaagattaaaccaatttaaattgnatgttttcangctggttgnatatttaattaagggatgggaagggttatttggcatttacagtattggggtttttatgaatgtgaagcaaacaaaaaaaatttgtatgtaaactggaaattaggaaaatccnttaccaagcttaatgggtatccttacttgagtccacatgggttggcagtccccan

SEQ ID NO: 3491 - DNA, 805 bp, Homo sapiens
  misc_feature (1)...(805): n = A,T,C or G
gnntttaaanccntttttntnnnanacaggctacttgttctttttgcaggatcccatcgattcgaattcggcacgaggcctgggaaagcgtggcgcccatgaatatccgcaggagcacgcatgacctggtgggccatggacgggatgggttgtaccccgtggggggtaaacgaacgggtagcttncaaccttcaacttccattcgangaaagtacaaaccccganggancaacaaagtggggtgggccgcattcctggcattgtttcaacccgggcgcaagcaagtgtggggttgtgggcgggtgcttggaagctgcttcaatttccccgnccgncatccttccccgacgcttgtcccgtggccctccaccaagcctcttgacccacctaccaccagaagccttgcagccttccacatgccttaagggggaccgtggcccccaccaggggacgtcctgcgccatccgttcacgtctcttgcatcattccttcatgtctttatttagttgnttatttatttaagttatttatcttattgagaggtgaggagtgccacggctgcccgtttacacctttagcgtctggtcctnctgcgtgtcctcccttcactggctgcatggggggcccggggagtgacaagcnggggccttaccggcccaaggcccgttgcctgctnaaaccttgcangctgtggagcaagaggcctgggtctttcnaacactgcagacccacttgaatttgcacatgcggggtcccgggaaggtggggaacaagtgtccttctgtcgtcnnnttgccgngtgcca

SEQ ID NO: 3492 - DNA, 795 bp, Homo sapiens
  misc_feature (1)...(795): n = A,T,C or G
ggctactngnnngtntttgnangcnnttttnantatacagctacttgttctttttgcaggatcccatcgattcgaattcggcacgaggnaatgacattcatgccagttcttccctgaatggcagaagcactgaagaagtaaagcccattggtgaaaacctggggccaaactgggaaatctgntggttgncttcccccangntttaaaggagatcaatgtngaaanggtancnggattcaacatttggncaagccgattcaagaacagtgaaagttattgnggatcttatgggaccaatttgggccaagaagaagtcttttagacagctttacgtccaacaatgggacccatttcaagtattacttgggtgggcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaaccaggcggagaaactgacgaattctctaatgttagaagangaaagangacataggatgcaacactttgagcgaaggaaccaaggcccggcaggtgggaantggangtgatngggancccttgggcttcgaccagaaggtcccgangcagcctcaatgaccanatcgcctcgtgctgatgaaactgcaggaggacatgcnnaatgtcctttaaagactgcagaaactggnaaccctactgnttttcaggcnaaaaaa

SEQ ID NO: 3493 - DNA, 734 bp, Homo sapiens; identical to SEQ ID NO: 3463
  misc_feature (1)...(734): n = A,T,C or G

SEQ ID NO: 3494 - DNA, 766 bp, Homo sapiens
  misc_feature (1)...(766): n = A,T,C or G
gnnnttnannnnnnttttannnnatacaggctacttgttctttttgcaggatcccatcgattcgaattcggcacgagcaccatcgaatatttttatttattttgagagacagactctgtcacccaggctagtcttaaactgttgggtgaatcttaagtgattctcccacctcagcctcccaaagtgctggggattacagggcatgagccactacccttggctgtgatcaagtattttagtctgttggttaaatgtttactaaatagtctgaagtagagaaaatagcacccaatctaaaataaggtgaggtctagtcacttatttaaatctacattttaagctatagtttactattagtttaaactttaagacaggtaatgttcatgctgcagacaatctaagggcattattaaaatgtttgttcttccttatctcagaattgaagtatgtcagaagcaagacttttctttccattttgttatagtagaaatgcatacattaacaggtacgttttagacattacacgtgctcatctgcccaaaagctctaatgagctgccttaccctggaatgtttttcttagcttggatttgcttttttggagggattaagaaaagacttggctgggcgttgggactcatgcctgtaatccacantttgggaaccnagcggtggatcatgangtcaggagatggagaccatccggctaatacggngaacccccgtttttactgaaaatccaaaaattactgggcgtggnggcggcn

SEQ ID NO: 3495 - DNA, 872 bp, Homo sapiens
  misc_feature (1)...(872): n = A,T,C or G
nttanantttnaaaaaccccncttntnttggcctnaccttncggttttctttttttttgggccaggggnaatnccccccatnccggnatttcccggaaaatttccgggnccaccggaagccctgggggaaaaaatgggaaaaaatttnatttnattttttncaaccccccatttaggnttangcccaaatttaaaaaaaaaggaaaattaccttccaagttaaantanccgttantnggggaaatancttacctttaagttccaataaaaaaaagggggaaatggaaaaataaatggggcatttttggcangcaanccctggggantgggaaaactggggangaaccattanttcttaaaagtggaangtaaccttcaagggaaaatgggaaaaaccaaaccggtcggtggtggttcttcactctttaaagtggggaagctaaagcttgtggagggacccaaagggcctaagaaatgatacaatgggactttggagactcaggggaaagggtggggagggcggtgagggataaaacagtgccactgggtcagtgtcactgcttggtgatggctgtccaaaatctcagaaatcaccctaaagacttattcatgtgccaacctcctgtcccaaacctttaaaaaaaatgcgccatccccccatggaaataaagtcaacagcctgcagagcaaaaagactggttagtaacttaaaatattccaaaagagactcctcatgcctactagttcactctgaatctatcaaacacgtaaaggaatttggttcacaccaccaccacccccaatcttnacaatctntgagaaacagagaaganggaattccaactccttgtgaggcagcttccctgtccatg

SEQ ID NO: 3496 - DNA, 710 bp, Homo sapiens; identical to SEQ ID NO: 3301
  misc_feature (1)...(710): n = A,T,C or G

SEQ ID NO: 3497 - DNA, 749 bp, Homo sapiens; identical to SEQ ID NO: 3398
  misc_feature (1)...(749): n = A,T,C or G

SEQ ID NO: 3498 - DNA, 782 bp, Homo sapiens
  misc_feature (1)...(782): n = A,T,C or G
gnnnnnnnnnnnnnnntttnnannnnnnnntnnttnnnnnnnnnnttttnaaaaacagctcttgttctttttgcaggatcccatcgattcgagactactgactctacgcttaaaaattattaagatggcaaatttcatcttgtttttttttaacttaaaaaaactacatataagatagttttgcctgttttcaggtttcttttcagtgttttaggtattcagtatttaaatcacaaaatttgtgatttgaacatttttttcttccttcatgagattttaagtggattgatacttgctttccattctgtcccgatgtctgacctttgtaatgtaaagaagaacattttgtttaattgagagaagtctgctgtgttcttgttgatagaggaccatcctagagttgggagtgctgtctgcacagcaacaaacccagagtctactttggatcaccttatatagttcatgagtaatcagcagatgcctttcctttctatgtctctctctcagtgaaaggcactgtttcttccacttggtgaggaatggcctaatgctcattgtctgtaacaggaatgctacaactgctcaaattgtaccatttatcatatttggtaaggtcttgccttagtcttgcctgttcaattataaaaggaaagaagacgtaaaagatgtagagttgtctgngtgattttccccccattatgtcagaagaggccttaagaaaactaataccccccacaaatatatctttttagatttctattatatatttngncttatcaaga

SEQ ID NO: 3499 - DNA, 736 bp, Homo sapiens
  misc_feature (1)...(736): n = A,T,C or G
atacagctcttgttctttttgcaggatcccatcgattcgaattcggcacgaggttgctttcaaaagacacatatcaccatagtacatgtaataacacacataggctcaaagtaaaggggtggcgaangatctgttntgcagatggaaaaaaagatcaggggtcactattcttgtttcagataaaacagactttttaaatcaacaacagtagaaaaaggactagggcattacataatgaagaagggttcaattcaacaagatttatcctatcacacccaagattggagcactcagatttctaaactattatttctagacctaggaaaagaattaaacggccacataataatagtgggggacttcaacacctcactgacagtgttagatagatcatcaaggcagaaaactaacaaattctgaacttaaattcaacagttgactaattgaacctaatagacatctacagaatactccacccaccaacaacagaacatacttttttctcatgtgcacatagaaaatactctaagattgaccacatgctttgtcacaaagcaaatctcagtaaattcaaaaaagattgaaatcataccaagcatttcagactacagcatagtaaaaatgaaaatcaacacccaggagaaactctcaaaacatggnaactnaacaacttgctnctgnatgactttttgggtaaatataaaaatanggcttccttaaccctttttgnaacaat

SEQ ID NO: 3500 - DNA, 752 bp, Homo sapiens
  misc_feature (1)...(752): n = A,T,C or G
gnnttnnnnnnnnnnnttttnanntantgctcttgttctttttgcaggatcccatcgattcgaattcggcacgaggtcaactctccttggtgagtgcctcagaacttaggaaaagagaacagcgcatgtctctctcatgaagatgacagaggacaaaagcaagcagaaatatacaaggatttgcgtnctctattatgaatttctctttgagaaataatacctgtgagaatgctgctccttcaattaggttcaggattggaggaaaaatcatataaaataggttcctgcaataatattgccccttgagtatgggtgggcttgtgacctgctcagtgctaaggaaatgcagtggaaatgatgctgtgtaacttctgaggccaagttataaaagatcatgcatcttttgccttgttagtttgctgacgcctgatatggagcactagaaagaaattatttttccaagcatcaacccggaagtcccagcataccgagggtggcagacatcatttcttcaatgaacttagtatttagaaagatatcttcactccaagcatcaagtcttttctgtcctgcaaaagtcttaagtcaaaccagaatccctagtagagggcacctttggattcaacagtaaaaggagaatctacaaaaccagctcatcaaaaggggcagtgatgggtatagaacctgncttacttaagttcaagcaatgattaatctagcttccctctggtggatgactgangnctttgcct

SEQ ID NO: 3501 - DNA, 752 bp, Homo sapiens; identical to SEQ ID NO: 3500
  misc_feature (1)...(752): n = A,T,C or G

SEQ ID NO: 3502 - DNA, 737 bp, Homo sapiens; identical to SEQ ID NO: 3480
  misc_feature (1)...(737): n = A,T,C or G

SEQ ID NO: 3503 - DNA, 738 bp, Homo sapiens
  misc_feature (1)...(738): n = A,T,C or G
tnaanatcntgctacttgttctttttgcaggatcccatcgattcgcgtccgctctcattggctctgctggtccagaaagcagcccaggcctttaactccgggctgctgtgtgtggcatgtggttcataccgacggggaaaggcgacctgtggtgatgtcgacgtgctcatcactcacccagatggctggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgccactcccactgagaaggatgtcttcaggctcttaggcctcccctaccgagaacctgctgagcgggactggtgacccatggcttgggggtgctgangaaagcccanttggactggctaccccttctggccacccagtacttccttcagccttaactgggtgaacttgccggttcaaccaccaactttctnagcgagcangggccaaggct

SEQ ID NO: 3504 - DNA, 760 bp, Homo sapiens; identical to SEQ ID NO: 3487
  misc_feature (1)...(760): n = A,T,C or G

SEQ ID NO: 3505 - DNA, 766 bp, Homo sapiens
  misc_feature (1)...(766): n = A,T,C or G
gnnnttnnnnnnnnnnnttttntaganacaggctacttgttctttttgcaggatcccatcgattcgaattcggcacgagcagagacctgacagtggcaatgtatggccacgttactgaatctacatgttgcaagagaaaaactagcagatgttctttggcagccctgtcattcagctattattgctaaagcactaggtgggaatcattatgaaaatttccatcctcaaatagaaaggagatttgacatatcctcttctcttgctggtttaattgatgggaagctttgaaattggaaatttgcttgtgattgtatttgtaagttactttggatctaaactacacagaccgaagttaattggaattgggttgtctccttatgggaactggaagtattttgacagctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtacccattgggggatttcatacattgatgattttgcaaaagaaggacattcttncttgtatttaggtagtttgaatgcaataaggaatgattggtccagtcattggctttgcactgggatctctggttgctan

SEQ ID NO: 3506 - DNA, 735 bp, Homo sapiens
  misc_feature (1)...(735): n = A,T,C or G
tnaannanagctacttgttctttttgcaggatcccatcgattcgaattcggcacgaggtccatacatggagctccctggacccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagaaacaaggagagaagcccgagagacatgtctgcgtgctgccacgcatctgancgattgctcttgtgaagagtttgtcactgaacattttcaggggaggctgtttacccagcnatgtnctnaacan

SEQ ID NO: 3507 - DNA, 735 bp, Homo sapiens
  misc_feature (1)...(735): n = A,T,C or G
natngnttgctcctngttctttttgcaggatcccatcgattcgagacaacccagaaacaaattcatacatctatggtgaccacttttgacaaaggaatgaagaacatacactgggggaaaagataatgtctttaataaatggtgctgggaaaactggntntccantntgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaaagcaaaagtggacaaatgggatcacatcaagttaaaaatcttctgcattgcaaaggaaataacaaagtgaagagacacccatagaatgtgagataatatttgcaaactatccatctgtattaggccatttttgaagtctacaaagaaatacttgagactgagtaatttataaagaagaggtttaattggctcacggttttgcaggctgtcaggaagcatggtgctaacatctgatcagcttgtagggaggcatcaggaagtttccacccatggtggangcaaaaggggaataagtttctccatggcaggtgcagggcaaaaanangggggaagggaagtgccncacaaccagatcttgtgagtnctcagatttgnggngggngcttgngg

SEQ ID NO: 3508 - DNA, 735 bp, Homo sapiens
  misc_feature (1)...(735): n = A,T,C or G
taaacatcnggctacttgttctttttgcagggatcccatcgattcgaattcggcacgagacactgtcccactccatcacccaggctggagtccagtggtgtgatcatagctcgctgcatcctccagttcctgggttcaagccatccctcctgcctcagcctccccagtagctggaactacaggtgtgtgccatcacacctggctttacatttttctgtggggtcttactatgttgcccaggccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgngtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgtctgtggatgacctaccctttnctttaaacacgattntntcacttncaactncaaacttgctcaactaatnctttaaaaataacttgagc

SEQ ID NO: 3509 - DNA, 756 bp, Homo sapiens
  misc_feature (1)...(756): n = A,T,C or G
tnaaannnnntngctncnnnnnnnnnttttaaacaanagctcttgttctttttgcaggatcccatcgattcgaattcggcacgagggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaactgtgggtctaccaatctagacaactcantggcaagcattgaggcaaaggctaatgtgtgctgtgttaaatcagcccctcttccagatccatttggctttcggctgtgcagatcactgtgtccctactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctgcttncaatggagattatatagcttgtggaagtgaaaataactctntttcctgtcctataaangactttntaagactttgctacttttaagttgatacagncaa

SEQ ID NO: 3510 - DNA, 751 bp, Homo sapiens
  misc_feature (1)...(751): n = A,T,C or G
tntnnatcttgctacttgttctttttgcaggatcccatcgattcgaattcggcacgagaagtagaggaggaaagttcagacaatttcataagtgtctaaaaagagacagttntgcgaccattggncgaggagtaaangtcgcttnttngnncntttanttcactncaaatnganaaangaantnccagtttcctgacangcccaacccantgctnggccagttcctgagtccacttaatatatttaagaggaaaagatctnggaccacaggagaatggcgtggattgacctaccagattatgaccatgtagaagatgaactttttcctcctttccacctncagcctntccagagagacaagatggtgaaggaactgagcctgatgaagagtcagggaaatggacacctgttcctgtcctncaaagagaacagttaaaagaaatntcccaagctggatgctcagagattaatttcagagagaggacttccagccttaaggcatgtatttgataaggcaaaattcaaaggtaaaggtcatgangctgaagacttgaagatgctaatcagacacatggagcactgggcacataggctattccctaaactgcagtttgaggattttattgacagagttgaatcctgggaagtaaaaaggaagttcanatgaagttgcngagaatatgacatgaggccttctactgaatagatcctttctgacaacttattgaaagtganatgttgcttctgagta

SEQ ID NO: 3511 - DNA, 736 bp, Homo sapiens
  misc_feature (1)...(736): n = A,T,C or G
tacaggctacttgttctttttgcaggatcccatcgattcgatcacaggggaatgttagaagtgttttattaatttctttgtcagacaagtgtttaggaaactctcactccaggcctaatgctgtgctaggctctgcaaatgctaagagggggaagttactgtccctgcttccaaggagatcatgggtctagtgggaaacccgacacgttcaggtaccttcagatgggcactcagaagagtaagcccttagttaatgtttaaagatgtttaaagatgtctgagactcataggtcaaagtcagatttcagttccaccttattagacctgcactgctaaggagctgctttaggtaaggctgtgttcctagtcaccagggtgttcaaacacagtgctgggggcaatgtgggaatagccttcttttatttaggaagtaatgtgaagtcagtttcatgaatagatcttactttaagcattcattgagggttttggcaagaatagagtaccgtatatgaaggtgtttcctaatctncctgcaccaggaataatctagggctcattanagatgtcaaagatctggtctagtttcttaacctaaaacaagagtgttttaattccattttataggcggggagtctgagccaaacatgttatgtcacttttccaagcttcatancacaaaagtcttctgtcttcccatcctgactttnccacttcatagggactgtcaaaggcagcn

SEQ ID NO: 3512 - DNA, 772 bp, Homo sapiens
  misc_feature (1)...(772): n = A,T,C or G
gnnntttnnttttnnnnntnanagnaaaanctttttgctacttgctctttttgcaggatcccatcgattcgaattcggcacgaggagaagctgacgggcatgtggtggaaacngctggtggcccggcgcagtggcaggtgcccgtgtcacggacaggcacggcccctctggaccgcttaaaggtcttcatgcaggtccatgcctcaaagaccaaccggctgaacatccttggggggcttcgaagcatggtccttgagggaggcatccgctccctgtggcgcggcaatggtattaatgtactcaagattgccccgagtcaactatcaagttcatggcctatgaacagatcaagagggccatctggggcagcaggagacactgcatgtgcaggancgcttcgtggctggcttcctggctggtgccacaacccaaaccatcatttaccctatggaggtgctgaagacccgctgaccttncgccggacgggccaatataaggggctgctggactgcgccaggcgtattctgganagggaagggcccgtgccttctaccgcggtacctcccaacgtgctgggcatcatccctatgcggcatngacctggccgctacnagactctgaanaactggtggcttaacantacaagccacgactcggaaaaccaagcattctctgcttctggctgcggaccatatcaacactgcggcaaatagccanttacccgttggccttgtccggacccnatcagccaaccgtggtattccataacaan

SEQ ID NO: 3513 - DNA, 778 bp, Homo sapiens
  misc_feature (1)...(778): n = A,T,C or G
agnnnnnnnttttnngcnanngnaaactttttaangaagctttaatanncctttctctggatccctcgaggcgaattcggcacgagctacacagttcccattcnttaccttaacnttgtactgagagagacccaggtctgacctgtatagcagtttgagtcgaggggctgtcaaaggggttgccaaagtcatctaaaggacttggcaccagaagtagcattatgacttnggatccacttctttatagaccaatattggcagccatgaagctgcttgtcctgggtgcggaattcagttttagtggctgaatgcacagacagcaggaagagagaataggggacaatgaacaacagagagagaagaaatgcagtgtgtagggaacctgcaggtggtaacagttgaaactcatatcaatgatcttgcctatttaccactccatgtgcctactctggctgtctaatccagcagtaaccagtattgnattctagggccttccccaaattggagctacccccagaatttctcangcttttaattcctgaaaatcttttaaactaaaacttctangtcagttgtccccaggggaactgaggctgtttctacctgctgcattgtcagcaaaacttgctacatgctaattattccactttcagtgaagcaatcaatgagtgacagtaggaaataactttganagttggttggttcctaacatggcctcttaataatggaaatgagaccaaattggggacctaatnttgccaaggaanaatggnnaggt

SEQ ID NO: 3514 - DNA, 778 bp, Homo sapiens; identical to SEQ ID NO: 3513
  misc_feature (1)...(778): n = A,T,C or G

SEQ ID NO: 3515 - DNA, 784 bp, Homo sapiens
  misc_feature (1)...(784): n = A,T,C or G
gnnttttnannnnnnnnnttttaaaanatcaagttcttgttctttttgcaggatcccatcgattcgaattcggcacgagccggagagaagcagcaggagggcggcggcgccgtgcgctgcgacacacctgccaactgcacctatcttgacctgctgggcacctgggtcttccaggtggggctccagcggttcccagcgcgatgtcaactgctcggttatgggaccacaagaaaaaaaaagtagtgggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagacagcctgcgacagtgtggacctacctgtagcagctagcaaaggcctctagcagctacagtcccttctggagtctttatttgcatgcaaaatgcaaaggagtcctggtgacctactccaagcactgcccttctgaacactccttggaaaacagtaaacatcattttggaatgtgaacaaccagagactncccaggagaaaggaaaaaaaaattntgaagatgcaaaatcttgggtggcttcaccgtcaatttttaa

SEQ ID NO: 3516 - DNA, 746 bp, Homo sapiens
  misc_feature (1)...(746): n = A,T,C or G
gnntttnnnnnnnnnnnttttnnnnatcagctctgttctttttgcaggatcccatcgattcgaattcggcacgagcacagtccttctggagccagacccgaagccacagtagcagtgccagctcagcagaaagtcaggacagcangaggaggaagaaaangaaggaaangaaaaacncaggaancntaaaaggcttaggancttangaaacntgcaggcnctgaagtggaattggaaaaanccaaaaccccaancccangaaaangagtcaangangancaangntaagagaaggagaaggagaaggatgaccaaaangtgaatctgcctgtgtaaaaggcagattttttaattgcttaatactaagtcatctgtttnaaatttggtatatgtaagagattcaagccttgnaatatgacatggaagaccctgtgctgcacttaaatatgcttgcttgattatttgattttacatcagagctttataacacgaacttttgtccagaattgtgagttgtgccatgttacatgaganggttttgctagggcctattatttttaccaccattaattagttggggtggagtttactgtaatgtgaaatttcccatttgaatttttaatggctggcaaagctgntttagtcttaaattcancggatgattgctgaatcattncaccctgtatgtccttttggntncatnaaagtttcagtaactttcaaaaaaaaannnnnnnnnnnnnnaa

SEQ ID NO: 3517 - DNA, 777 bp, Homo sapiens
  misc_feature (1)...(777): n = A,T,C or G
gnntttnnnnnnnnnnnnttttatannatacagctcttgttctttttgcaggatcccatcgattcgaattcggcacgaggaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatcctaattcgaattagaaaacttcactaaagcgacagaggaaacttgttcctttgagtaagaaggtggagcgtagggagaaaagaagagaggaaaaggcattaatagctgctcagctggacaatgccattgagaaggaattactggagagactgaacaagatacgtatggcgacatctacaacttcccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataactggatccagcagtgatgaagatcaggatggtaaatcctccatgaggaggaggaagaaaaggccttatgcgaaacacaaangcnaaatgcccttganaggncctgcgganaaaccaacctnttggaaatngaatncaacnggagacaaacccgtgg

SEQ ID NO: 3518 - DNA, 789 bp, Homo sapiens
  misc_feature (1)...(789): n = A,T,C or G
taannnatacagctacttngttctntttgaagcnctttnnananatacangctacttgttctttttgcaggatcccatcgattcgggcctccccacccctgctgcacacctacactgaaggaaggctatttgcagatgcagcaagaangcagccatctgcaaggcagaagaagagaccctcaccaggaactgaataagtcagtcagtctgggacttccacctctagaactgtgaaacaataaatttctgtggtgtaagcaactcaatctatagtagtttgttactattttgttatagcaaccaaagatgactaaccagacaggttatgtcactcgccaagtgtcttggtctgtttgtgctgctataacaaaataccttagactgggtaatttacaaacaacagagatgtatccagagatccacagttctggaggctgagaagtctaaaatcaaggcaccagcagattccacatctcgtgaaggctcactctctgcttcacagatggcactgcttgctgtgttctcacatggcagaaggggcaaacaagcccccctgggcctcttttataaaggcactaactctatgcctaaangcagggccctcatgactctatcacctaccaaaaggcttcacttctttatactattggangggtagaangaacttcctttctagaccttgaaaggttaagaaatttgaatctattaaacaagctgacaatngacagattaacaggagaaaaagcntatacattttttaatgtgggccaaatggcaaaagcttaaata

SEQ ID NO: 3519 - DNA, 763 bp, Homo sapiens
  misc_feature (1)...(763): n = A,T,C or G
tatagnatcagctcttgttctttttgcaggatcccatcgattcgaattcggcacgagcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacaccgggcccgggagaagcgagactacagagagcccttcttccgaaagaaggacagggactatttggataaaaactctgagaagaggaaagagcagactgaaaagcataaaagtgtccctggctcctttcggaaaaggcaagaagangagagagtccncaaagcccggccggacagaaggacccctggaagctgcaaggancncagggaccgcagggccaacccnaggaggtgccccggaggactnaat

SEQ ID NO: 3520 - DNA, 821 bp, Homo sapiens
  misc_feature (1)...(821): n = A,T,C or G
tnannnanncannnnnnnnnnnnnntttgaagccattgctacttgttctttttgcaggatcccatcgattcgaattcggcacgagagcaattccactcctagctccacccacaggaaattgaaagcaaagacgcaaacagatgcctgtgcaccaaagttcacgggcaagcatccttcggccttaatgggcagcattccgtcgtcacaagcgggcattcatcctttcatcaatagcgggcagcattccgtcgtcacaagcgggcagcattcctttcgccacaagcgggcagcatcttgtccgtcacaagcgggcagcatccttcgccaaagcgggcaagcatccttcgtcatagcggcagcatcctttgccatagcgggcaaggtggaaaccctgtccatccactgaggcgtgcatagactaaacatggccagtccaggcactggaatccaggcccgtagaacggcgcccacggtcaaaaggaatgagaccctgatgcactgggcgacacagacgggcgacacagacttggagacatcatgctaagtgaaaagccaggcacacggagcggacggcgtgatcctgctcacgtgatgtgtcccgaatgggcacgttcagagggaagaagggagatggcgcttgccggtgcccggggacnggggttgggagcgacggttgctggtttggggtttctttctggggtgangaantggttttgatatttggnccgttggtgatgtttgcatacctctgaatatgcttaaganccacagaattgaccactttaaatggatgaattgnatggtattgggaattacccaan

SEQ ID NO: 3521 - DNA, 772 bp, Homo sapiens; identical to SEQ ID NO: 3512
  misc_feature (1)...(772): n = A,T,C or G

SEQ ID NO: 3522 - DNA, 819 bp, Homo sapiens
  misc_feature (1)...(819): n = A,T,C or G
aaacagctacttgttctttttgcagggatcccatcgattcgggagaaatgctggccacagatggtgctgcccaacaggcccataccactcgttccagtcagaggtgcttggcctttgtgggatgaatgttcgttggttcaaatcaagctttttccaaatgaacaagancactggnctttaccatattttggcaaggatccgaaatcaagggttcttctttcaaagtgcttgccagggggaatcttgaaagaagggtaccccttgcaacaaaacctggttccctgtaaaccctcttcttgaagggaatcccctgcttgccccacttggcattttccaagtttgcccttcctcaagaatgtattaaaccccgaaccagggtacttgtcttgtgcccaagacgatcttgggaaacccggccccatgggatctgtacttgantgcttgctgagcttcacccactgagagtttacctctggagttcantgatgacttggatgttgtgggtgatggtatgcantgtctncttaactttgctttttgatccttcactaacccttgaagatcatttantcaaagaaattgcttgaagacacantggatattttgggccanatgcaaatggctggagatnggtgcagatcccanggatctcgaaattctgagaaagcttttgnaccattggcttaaaatggattggctactgcaaatgggaagccagaaccacttttattanttgatagtttggggaaccatttactttggtggattnaaattctcgtctttaaaagaagtatttctgaacatntttaacaaaaaaan

SEQ ID NO: 3523 - DNA, 765 bp, Homo sapiens
  misc_feature (1)...(765): n = A,T,C or G
taaanaatcagctcttgttctttttgcaggatccctcgattcgaattcggcacgagcgggactggtaccaccgcatcgaccccaccgtgctgctgggcgcgctgccgttgcggagcttgacgcgccactggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccacttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacattcacatcagcctggccagctggatgttcttaaagagttncacaagcagattactgcacgggcaacaaaggatgggacttttgtcatttcaaagacatgatgtatggggattagaaagaactcaagacactcctgcttgatacagaacaaaaagagcttaacaggaccaacanggcttaacccagacttgacgtaacagaaatgtgccaataggtaataggtaattttctttctctgacttggtttggtttctttgaaataacactgttgtgtnggctngaaanggaaaaaaaaaaaaaaaaaaaaan

SEQ ID NO: 3524 - DNA, 763 bp, Homo sapiens
  misc_feature (1)...(763): n = A,T,C or G
gnntttnaaannnncagntcttgttctttttgcaggatcccatcgattcgccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctggtagtttttcataaatgatctatatcaggctgaataaatttctatttctaaaaaaaaaaannnannnnnnnnnnnnnnnnnnnnaaaaaaaaaaaactcgagcctntanactatagngagtcgtattacgtagatccagacatgataagatncattgatgagtttggacaaaccacaactagaatgcagtgaaaaaaagctttatttgngaaattggggagctattgctttatttgnaaccattntaagctgcaataaacaagttaacaccaccaattgcttcatttatggttcaggtcagggggaggtttggaggttttttaattcgcggccgngggccaatgcattgggcccggtcccaactttggtccctttagggng

SEQ ID NO: 3525 - DNA, 765 bp, Homo sapiens
  misc_feature (1)...(765): n = A,T,C or G
ggnnntttnnattatacagttcttgcctttttgcaggatccctcgattcgaattcggcacgaggtggctatccatcaacataagtaaaaaaaaaaaacactttnctccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtccagagtgctcagaaactcaagataggatatgcctaccctcagctactcctggtttaaagttcagctctttgagtactcttcaattctttcaggacacttgggtggaattcagtaagtttcctntgaacaccctgaanggtgccatccttacagactaantggagacgtttccagatcagcccaagtttactatagag

SEQ ID NO: 3526 - DNA, 774 bp, Homo sapiens; identical to SEQ ID NO: 3415
  misc_feature (1)...(774): n = A,T,C or G

SEQ ID NO: 3527 - DNA, 779 bp, Homo sapiens
  misc_feature (1)...(779): n = A,T,C or G
gnnnntnnnttnnnnnnnntttttaaaanaancagctacttgttctttttgcaggatcccatcgattcgctcgagtnncnaggagacgtgcagctgtccaaggctctgtcctatgccctgcgccatggggccttgaanctggggcttcccatgggagctgatggcttcgtgcccctgggcaccctcctgcagntgncccagttccgcggcttntntgctgaagatgtgcagcgcgtggtggacaccaataggaagcagcggttcgncctgcanntgggggatcccannactggncttntaatccgggccaaccagggncattccctgcangtacctaagntggagctgatgcccctggagacaccgtaggccctgcnccgatgctagtccatggtacattctggaagcactggcatccatcctactcaaaggcctgtcctgccanggaaggacgcacattcacctgccccangactgcctggagaccccggtatcatcantggcatgcggtcccattgngaaatagctgngttcatcgatggacccctggctctggcaaatggaatacccttctttcgtctgccaatggggtgatantgacttcanggaatactgatggcttcctacttccaagtacttcaangaggccctgcagntacgccctaccgaaaccccnttccttgnntggtgatgaaaagacacaatgtaatagtncccnaacccantttcaganaaaggaggaggatccaacattaaatattanttataaaaagaattta

SEQ ID NO: 3528 - DNA, 762 bp, Homo sapiens
  misc_feature (1)...(762): n = A,T,C or G
gnntttgaaanccctttttgatncctcttctacttgttctttttgcaggatcccatcgattcgaattcggcacgaggttcttcaaagccaaccnagacaggcttagcagttttagagcttcagaacaaattgccaaaagccagagttgtttatgctagtgcaactggtgcttctgaaccacgcancatggcctatatgaaccgcttggcatatggggtgaggggtactccatttagagaatcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcactagctcgagaggaaatcaagaatggaaaatgtgttgtaattggtctgcagtctacaggagaactngacattagaagctttggaagaggccggggagaattgatgatttgttcactgccaaagngtgttgcagcactcattgaaaacatttcctgttcanacaggaaaactttntagttactaga

SEQ ID NO: 3529 - DNA, 770 bp, Homo sapiens
  misc_feature (1)...(770): n = A,T,C or G
gntttnnnnnnnnnntttntnnatacagctacttgttctttttgcaggatcccatcgattcgcaggcgtactgacaggtggaccagcggactggtggagatggcgacgctctctctgaccgtgaattcaggagaccntccgttagganctttgttgncagnnnancncgtnaaaaacnatgtnagnntttccgttgaanaagggaaagagantnttcttnatgtttctgaaaatgtgatnttcacagntgtgaattctatacttcgttacttggctagagttgcaactncagctgggttatatggctctaatctgatggaacatactgagattgatcactggttggagtcagtgctncaaaattatcttcatgtgattcctttacttctacaattaatgaactcaatcattgcctgtctctgagaacatacttagttgggaaactccttgagtttagcagatttatgtgtttgggccaccctaaaaggaaatgctgcctggcaagaacagttgaaacagaagaaagctccagttcatgtaaaacgttggtttggctttcttgaacccagcaggccttncagtcagtaggtccaagtgggatgtttcaacaccaaagctcgagtggcacctgagaaaaacaagatgttgggaaatttgttgagcttncaggtgccgganatgggaaanggtaccggcagatttcctccaaaggccatgggtacttacacattgggcattcnaaaactgntcttntgaccacactaccaggt

SEQ ID NO: 3530 - DNA, 786 bp, Homo sapiens
  misc_feature (1)...(786): n = A,T,C or G
gntttnnnnnnnntnttnaagntcttgctacttgttctttttgcaggatcccatcgattcgcccgaggagcggagcagaggcacccaggcagcctgcgcggagaaattggatcggcggggacggcctgcagctcccgcgcgcggggaaagggaagaagtcctcccntacaaagcaaattcncaaacttggaagaagcantttacacaggatgtgcagatctcaatggaaggacacgggaaacgtgaaaaagcaaggaagtggggacgcctccaaaggaacccagtaattctccagcaacagatccccatccaaaagaaattcaagaaatgtcatatagagaattgtggaaactgattttaaccaagattagagggattcaagagacttctgaaaaagaaagtaaggaaatgtcaacagcaattctggatatggttgaggtatttaccaaccagatacagagttttccagagcacatggcaaatgtggaactgaagaaatcactggatgaaatccaaagtatactcgaaagcttcaatgatagactagatcaagcagaaaaaaaactcttaaaacttaaaatcttgaagcttttactcaattcaaatatttaatgggttgtctctggccattcangtgaacaaaatctgctgggttaattntttttttttttgaaatgggatnttcgcttctgtcgcccaagcttggaattccattggccgggaccttnggnttactgnaagcttccgcttccaggttnacgccatttttccttgcttaancttctn

SEQ ID NO: 3531 - DNA, 786 bp, Homo sapiens; identical to SEQ ID NO: 3530
  misc_feature (1)...(786): n = A,T,C or G

SEQ ID NO: 3532 - DNA, 783 bp, Homo sapiens
  misc_feature (1)...(783): n = A,T,C or G
gnntttnnnnnnnnnnttttaaantacttgctacttgttctttttgcaggatcccatcgattcgcccgaggagcggagcagaggcacccaggcagcctgcgcggagaaattggatcggcggggacggcctgcagctcccgcgcgccggggaaagggaagaagtcctcccntacaaagcaaattcacaaacttggaagaaacantttacacaggatgtgcagatctcaatggaaggacacgggaaacgtgaaaaagcaaggaagtgggacgcctccaaaggaacccagtaattctccagcaacagatccccatccaaaagaaattcaagaaatgtcatatagagaattgtggaaactgattttaaccaagattagagggattcaagagacttctgaaaaagaaagtaaggaaatgtcaacagcaattctggatatggttgaggtatttaccaaccagatccagagttttccagagcacatggcaaatgtggaactgaagaaatcactggatgaaatacaaagtatactcgaaagcttcaatgatagactagatcaagcagaaaaaaaactctcaaaacttaaaatctgaaggcttttactcaattcaaatatttaatgggttggactctggccattcangtgaaccaaaatctgctgggttaattttttttttttttganatggaatctngctnttgtcgcccagcttggaatcaattgcnggacctcggntnattgcaagcttccgcttccaggttcacccattnttctgccttancctnctg

SEQ ID NO: 3533 - DNA, 783 bp, Homo sapiens; identical to SEQ ID NO: 3532
  misc_feature (1)...(783): n = A,T,C or G

SEQ ID NO: 3534 - DNA, 772 bp, Homo sapiens
  misc_feature (1)...(772): n = A,T,C or G
gnntttnnnnnnncntntttatnaatacagctcttgttctttttgcaggatcccatcgattcgaattcggcacgaggaaccaagaaaatatttaaaaatctaagcagtcctttgctcattaaaggataaatcagtagttaacactttttctacaaagaaatgggtgtgcctggatgggtcgtgtaggtgagttttccaaggattatggtaacaaatgagtgagacctctatggagaaaatattgaaggacattaaagaagacctcataaatggagagagatatatcattaatggatagggaagcctcaatggcataagtatgtcagtttctttcaaaactcacctatggattcaatgtgattccaaaccaaatcccacaaggtctttcctggaattggaagccagattctgaaatgtatttggaaaagtaaagaggcagggttagctatttcattaacaaagaaggaacatcaggcagggagacttgtgttattattaaggcttattataaattattattgtgatcaagatagtgtatttttggtgtagagatagttaaattgccaatggattgagccaaatttncaaaacagacccacaaataaatgaactctaatttacaacagagacagtactgcagatcatggggggaaaggatgaactattgagggattggcaacttttttggtaaggctanacagccttacgtggggtcacagtgtctgtggaantaggcacctctgctgnggtattgtaagancactntgancat

SEQ ID NO: 3535 - DNA, 781 bp, Homo sapiens
  misc_feature (1)...(781): n = A,T,C or G
gnnnttttnaannnnctngtttcnngnatcanttccaagccttngtgcaggatcccatcgattcgaattcggcacgaggggattacaggcatgacccaccgcgcccagcctgtaatttcttatactttgtattttgtacttgtattatgcttctgaatacgctataattatttatgtacatgttttttttcttcaatagactggtggaactcttcgaatgtagggactcctagagctagatactcaattattttttattaaattgaatgacttgaaactacagatcctttatttaaacttcccaaatttctgctttatctaggcaactctttaaattcttttatctcatgtagatttcaaaggctgaaataattgagattttttagtttgaagaaaagagaactgaggatttaatgtcattattattatatttttaatggactgtttgggagtaagttgcagacattgttcactttcactcctaaatacttaaatatttcctaaaaacaggacattcttttttttttttatggagtctggctctgtcgtccaggctggagtgcggtggcacgatcttggcttactgcaagctcccccttccagattcacgctgtctcctgcctnactgctcgggangctgangcaggggaatcgcttgacccnggangcggangttgcananagcctaaacgggccattggactccagctgggtaccaagaaccggacctccgttggaaaaaaaaaaaaaaaaaactnngcctttanaactttngggggcg

SEQ ID NO: 3536 - DNA, 768 bp, Homo sapiens
  misc_feature (1)...(768): n = A,T,C or G
gnntttnnnnnnnnnnnttttaagntactgctacttgttctttttgcaggatcccatcgattcgaattcggcacgaggttcttcaaagccaaccaagacaggcttagcagttttagagcttcagaacaaattgccaaaagccagagttgtttatgctagtgcaactgggtgcttctgaaccacgcaacatggcctatatgaaccgcttggcatatggggtgaggggtactccatttagagaattcaagtgattttattcaagcagtagaacggagaggagttggtgccatggaaatagttgctatggatatgaagcttagaggaatgtacattgctcgacaactgagctttactggagtgaccttcaaanttgaggaagttcttctttctcagagctacgttaaaatgtataacaaagctgtcaagctgtnggtcattgncagagagccggntcagcaagctgcagatctgattgatgctgancaacgaatgaagaagtncatgtggggtcagttctggctgtcaccagaggttcttcaaatacttatgcatagcatccaaagttaaaagggttgtgcactagctcgagaggaaatcangaatggaaaatgtgtngtaattggctgcagtctcaggagaagctnnaacattagaactttngaagaaggcnggggagaattgatganttggttcaactgccaaagtgtgtgcantcactcattggaaaacatttnctgctccagcngggaaaacttatggttacttggn

SEQ ID NO: 3537 - DNA, 755 bp, Homo sapiens
  misc_feature (1)...(755): n = A,T,C or G
agcnnnnnnnttnnnnnaataaactctttgcaacttcnctttttgcaggatcccatcgattcgcccaggatgaactggttgcagtggctgctgctgctgcggttncgctgagaggacacgagctctatgcctttccggctgctcatcccgctcggcctcctgtgtgcgctgctgcctcagcaccatggtgcgccaggtcccgacggctccgcgccagatcccnccactacaggggagcgaagtcaaggccatgttctaccacgcctacgacagctacctggagaatgcctttccttcgatgagctgcgacctctccctgtgacgggcacgacacctggggcagttttctctgactctaattgatgcactggacaccttgctgatttggggaatgtctcagaattncaaagagtggttgaagtgctccangacagcgtggactttgatattgatgtgaaccctctgtgtttgaaacaaacattcnagtggtaggaggactcctgtctgctcatctgctcttcaagaangctggggtggaagtagaagctggatggccctgttccggcctntctgagaatggctgaagaagcggccgaaaactcttccaaccnttcaaacccactggcatgccatatggacagtgaacttacttnatggggtgaacccaggaaaaacccctgtcacctgtccggaaggattgggaccttnatggtgaattgccacctgacagctnntggtgaaccgtgttcaanaan

SEQ ID NO: 3538 - DNA, 762 bp, Homo sapiens; identical to SEQ ID NO: 3528
  misc_feature (1)...(762): n = A,T,C or G

SEQ ID NO: 3539 - DNA, 765 bp, Homo sapiens
  misc_feature (1)...(765): n = A,T,C or G
gnntttnnnnnnnnnnnttttatnnntacagctacttgttctttttgcaggatcccatcgattcgaattcggcacgagactaccccggctacggttcccccatgcctggcagcttggccatgggcccggtcacgaacaaaacgggcctggacgcctcgcccttgcccgcagatacctcctactaccanggggtgtactccggcccattatgaactcctttaagaaagacgacggcttcagcccggtaactctggcaccccggatcgaggacaagtgagagagcaagtgggggtcgagactttggggagacggtgttgcagagacgcaagggagaagaaatccataacacccccaccccaacacccccaagacagcagtcttcttacccgctgcagcccgtccgtccaaacagagggccacacagataccccacgttctatataaggaggaaaacgggaaagaatataaagttaaaaaaaagcctccggtttccactactgtgtagactcctgcttcttcaagcacctgcagattctgattttttggtggtgtgtctcctncattgctgttgttgcagggaagtcttacttaaaaaaaaaaaaattttgtgagtgactcggtgtaaaaccatgtagtttaacagaaccaganggttgactattgttaaaaacaggaaaaaaataatgtaaggtctgttgtaaatgaccaanaaaaaaaaaaaaactcngcctntaaactnttntgagtcgtnttcgtaaatccaan

SEQ ID NO: 3540 - DNA, 820 bp, Homo sapiens
  misc_feature (1)...(820): n = A,T,C or G
nnnnnnnnnttnnnnctntgaagnnatagctacttgttctttttgcaggatcccatcgattcgaattcggcacgagatatttgtacatgcatatttcaaagacctgttaatggtgtccactttggattcttacatgaaacgattcaagtggcncattggtaaggcctaanggaccacgccaaaangggttcccaacttatttaaaggtatttcaagtacccttccaaaaangttaaatggcatttaagacactttcangaatggttaaactggcttctaaaacaaaaactccctaaagtctggtccctatgcaatatatatttntaatataccatatatattttttaccataggaatactcacaaaagtgcaagccaataataacattggcaagaaaaagtaatacatatctgctaggtgacaatatcaaacaattcaggggaataattttactttaattaacattaacagaatttctttttccacttcaaatcaatcatatttctgtcatctccaacctaagatattttttagattgtctccctattctttgattcaaaagccaattacagaaactatgaacttgacctaattctggtttttgacaattatgagacagaaataaagaaatgcaagcagttcttttctttgccactgaccattttttaattcatcatcctctatgatgatggtgctttcacaactgcagctctnctgtatgtcaaaatcattctggttncaggtaaatggacaaanggagatttgccttcagtgtctaaaaggcaatttacttttcaagctgncttaattacctatgggt

SEQ ID NO: 3541 - DNA, 767 bp, Homo sapiens
  misc_feature (1)...(767): n = A,T,C or G
nnnnnnnnntnnnnnctntgaagcnanagctcttgttctttttgcaggatcccatcgattcgaattcggcacgaggctatgctaaacagcctttacatgtatggtctggttaaagttcctttgttccttttgttttaataaaatgtgtcactgattttttagctcaaaaatcatcactggtaattccaagcccccaaaatatggttaaaaagattttttttttaatcatgaagagaaaattagtagcattctttctctcccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgntttctgtctgcttttttcttatgtctcttgntgagttttatattttcagtggttatttttgcttgngttagatcattattaaaatatatccaatgnccctttgatacttgngctctgctgagaatgtccagtttgcattaaacatcccagtctcatccttcaggaatttgcagtcaatgagaaganggagacaaatttaaagatgaggacagaagcatctntacagatgaaaattacntaaataaaacattctccatcaacactaaaaaaaaaaaaaaaaaactcgacctttagaactntagggn

SEQ ID NO: 3542 - DNA, 765 bp, Homo sapiens
  misc_feature (1)...(765): n = A,T,C or G
ttaagctanagctacttgttctttttgcaggatcccatcgattcggtcgggtctccaacctcattaagcaccacagggttcacactggagagaagccctataagtgcagtgactgtgggaaagcatttagtcagagcttccacccttattcagcatcgggagaaattcacactgggagaaaaagcctcacgttgtggtaaatggtatgtgggaaaagccctttagttatagcttcagtgctcccgaaagcaccagatcatccacacgggagagaagccgtacagatgcagtgtctgtgggaaggccttcagccacagctcagccctcattcagcaccagggcgtgcacacaggcgacaagccctacgcctgcacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaccagtgtggtaaagccttcaccgaagctcaaatctcattcaccaccagaaagttcatactggggaaaaaccctacacctgtgttgaatgtggtaagggcttnagccagagctacacctnattcagcatcagataatncacacgggcgagcgcccctacaaatgcatgagtgtgggaaagccttaatcagcgtctgncctnatcancaccagaggattacactggg

SEQ ID NO: 3543 - DNA, 734 bp, Homo sapiens; identical to SEQ ID NO: 3463
  misc_feature (1)...(734): n = A,T,C or G

SEQ ID NO: 3544 - DNA, 768 bp, Homo sapiens; identical to SEQ ID NO: 3536
  misc_feature (1)...(768): n = A,T,C or G

SEQ ID NO: 3545 - DNA, 10 bp, Homo sapiens
  misc_feature (1)...(10): n = A,T,C or G
nnnnnnnnnn

SEQ ID NO: 3546 - DNA, 936 bp, Homo sapiens
  misc_feature (1)...(936): n = A,T,C or G
ttangtgnacnccctgganaaccacttgntttttntgcaggatcccatcgattcgagnaaatngtcctgcantcctatatgcngaattttntnnatatcttgacccaaaataactggggtaaaatatntagtngaaaccttgtatatattataaacttagctttgtaatattaagtatgaaagcagcananatagatagtctcagaagaagaagaaaatgtataaatncttggggagagctgtgataaanngactagacttacctttgagttcctagccgatccctacctgacagctttcccagctgggaaaaatctgcttgggcaagggaaagggggaatatgattattggangaacttcccaccttatagggactggcaagaggggatacatgaccagggaatgaaccataaaagggagagaaattggacatttaaattttacanggaattaagatgagatctaagnataatttgaaagattttgaaanaaagagccaaatccgaggaaagatgtaaggaaagtgatggggangggaaaaaaaattatgggatggtnaagactttctaaagttaatggggggaggaaatccaanggaccaccaagggtaaggtttaaagaaggggaaagganccaaaggaattttaanggaacccatggttttttcancccccagaaccaggggagaaanccaaangggaaaggaaagganccggaanggcttggagcccnccagggggggcttncaccgnccctggttaattcccccaccccnctttttgggggaagggcccaaanggccggggtggaatccancgnangggcccngggagaaatnggaccancccatncccngggcctaaaccaccgggggnaaaaccccccctcttnttaccttaaaaaaatccccaaaaaaaaaacccgccanggggcat

SEQ ID NO: 3547 - DNA, 769 bp, Homo sapiens
  misc_feature (1)...(769): n = A,T,C or G
tattatacanctacttgttttttttgcnggatcccatcgattcgaattcggcacgagattatacagttccccacattgaagttgggaagaagatatatggagagcagttgaagacataaggggctctggggaacagcatagttttgctttaattctccagcttgttctcagtaagggtggaaggagaaagagaggaagtatcgattttacagacgtcacatcgtactgctaagaacagacagaaaacttgttgtaataacccgtacacactgtaggagaactaaggaggcccctggtgtagcaatcattttcccaaggatgacggattgtgaggcaggaaggtgtgaaaagaggcagtcatttatataattttggggtttccgctgaggaaacctgagtgaactcacttcagatgcatttggaatattttaataaaaaatacttgattttggctgctgcaggaactgctggaagaaggaaacaatcctagaattggcataaaaacacactgactcattactcctctttgttactattaggcatcagagatacatgttttgttgattttagttacagaaatgagacaaagttgaatctgaatacattggcttncttgttcaaggagctcctcttggatacaatagctatttcatgaaacttctttagagaacaaccatgatacttccaacaagctattttagaaacaaaaattatgctggatctaattactcctaaaatggtcattttcaatgaatattgcactgattct

SEQ ID NO: 3548 - DNA, 883 bp, Homo sapiens
  misc_feature (1)...(883): n = A,T,C or G
gnnnnagnnagngnnnttnnnccntnttaacctttnacanctcttgncttttagcangatcccatcgattcgaattcggcacgagatttaatcttccataagatntttcctcagtgtcttttacttcttctcctgccatcagattcttaccttgattgaaaagccatgttaagtgcaaggcaaattctttacgtctttatacagagattaacaatctctgggtgatgggagcgttaagtgattaacctttgtcactagtanatgtgggaggttagaaaagtgctgccctttttgggtctcagtccctcagttctgcaattacaggcagcctcattattnggncaaatctatgtaaaattgatancncatatccaattaaaaaggatggtnagnggcaaaaaaaaaagagagagagattgattatnacctagtccttgatagcccaacagggngaatatagtccataataattggattggncattggataataactaaaaccntaattggattgtccgaacacaaatattaagcttgaggggatggataccccatcttccatggacgtggattattactgatggcatggcctatggcaaaaatatctcatctgnggcataagccccaaactaaggtncccgccaggaattaaattnaccaannnngccctccgagncctcttaaaaacctattagnggaggtccggtanttacccgtaggaatncccggacccttggaatnaaggaatacccatttggattggaaattttngggaccaaaancccnccaaacctttagnaaatggcccngtnggnaaaaaaaaaaaanggcctttttaaattttggggggaaaaaaattttggggggnaanggccctattttgg

SEQ ID NO: 3549 - DNA, 768 bp, Homo sapiens
  misc_feature (1)...(768): n = A,T,C or G
actattgacacctcttgttctttttgcaggatcccatcgattcgctccctctgcttcctcaaacccaggcttcgctgcctctgcggagttcttacctgtctctcctttccacccgggttccctggaggaagctaaactcagaccaaggccctgggctccccaggagttaaaagggaatacgctgtcccaagattctagaatgaagagtcaacgtagcccgagtggcttaaacctcctgtccttaaatgcaagaaatgttttctatcgagccctggacaggtgtctctgctggcctggggttttcaacaggtcatgcctgcctcagaccccagggacaaatgttcttccagctctaactcattctatgctttaagcttttgacctatctttgttttcccagtgccacaccaaatgctgcctggggatctctctttcttcctgagttcccatataagaagccccccatttaagaattcagttggaatgggttgtatttcaaaagttgctttgcaagttagttatttggatttcaagttgcattttaccagggtaacaatattataatgattggttaccttcccagagcaatccagaaatgcccacataacccatgtcacacctgaaccaccctgagttcttctatccttgaacctcttaagctttnccctaactctaacaggtctcatggtccactcaaggtgtttcatgcttctcaantacgtccctttccactgntgtctaccctntntccaaacacaacacaaaaca

SEQ ID NO: 3550 - DNA, 769 bp, Homo sapiens
  misc_feature (1)...(769): n = A,T,C or G
tttaaatctatatacangctacttgttctttttgcaggatcccatcgattcgtaacagactaaattttctctgtaagaggttatttcctagatagttaatatttttggtactactttgtgctgtattttataactattaaggaatgttgcagagaaatgctatcaattgttaaaattttgccatgaatacagcagcctcactgaattctcttagtagttctaatagcttgccatttgattctaacaggttttctatgtaaaagatggtgtcatcttcaaacaatgatagtttcatttcttctctttcacctcttaccttccttgtgtttctttagcattgggcaggtccttcagggatatgtgaaacagtggcagtaacaaccagacatcctggcctctttgtttttttttccatgatgaagtctcactccgttgcccagctggagtgcagtggcacgatctcggctcactgcagcctccacctcccggcttcaagtgattctcctgctcaaccccccaagtacttgggattacaggtcctgccactacacccgactaatttttgtacttttagtaaagacagggtttcaccatgttggccagctggttgagaattcctgacctncagtgatccacctgcctcgtcctctctaagttcttggattacaagtgtgagccaccacgcctgccattgnggcctctttattggtcttcttgaaaatgccctgaagtgtcttaatacacataatgttgctgtaaancaatgatt

SEQ ID NO: 3551 - DNA, 765 bp, Homo sapiens
  misc_feature (1)...(765): n = A,T,C or G
tgaacctttntacacctcttgctctntttgcaggatcccatcgattcggaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctgggacaatggtgaggaccgttataatggttactctcacctgtgctccagacgctccacttggtgctagaaatcacagtgaacaaacatggttcttgcctccacacacttgcagttantagggcagactgacgacattaaaaagatccatcggggtggtataat

SEQ ID NO: 3552 - DNA, 789 bp, Homo sapiens
  misc_feature (1)...(789): n = A,T,C or G
ttaaaccttttgacaccctacttgttctttttgcaggatcccatcgattcgaattcggcacgaggtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttctgcccctcgagacactcttgggagatgcattttccgtctggctcacagggggagggtgaggctttgcaccccagcccctgcccaagccactgtgagggtgggtgctggctgagcccccggggcaacangagccaagcangtgatgtctttgttctcggctcccacagcagaaccaggtgagggggcgcctgccanggccagacccaagtggggcagcctgaacctgcttcccctgtggccggcatgccccgatctttacacactggtgaccctgaaagaagaaggaggaaggaaccttgcnggggtgtctgaaggccgcactgtcagcttggccggtccaaacctgtngcttggaacttggggtctgtttacctaataaaagtncccacaagtgccctnanttaaaaaaaaaaannnnnnnnnnnntnnnnnnnnnnnnnnnnnnnnnnnnnnnnnnnnnnnnnnnnnnnnnttntnnnnttt

SEQ ID NO: 3553 - DNA, 775 bp, Homo sapiens
  misc_feature (1)...(775): n = A,T,C or G
ttgaacnatttganacctcttgactntttgcaggatcccatcgattcgaattcggcacgagataacactgagaaaggagtatggtatacttggtttgaactgtgtgctacactaccaggccccttccacattatactactaatttatttaaaatagataggtatcacactgagaggatataaaaaaaatttctgcctcttcatttttgtttcttgtttgaacagaaaaaatgaccaaaatattgggagtacttctaaggaaaaggcaacacacattccagttaacacttggatgtgaaaatatcaatgaatattagaatttataagtcaaactggctctgctcgctgattgcaatttttagttacattcactattttgtgctaaatttaagtcattggtatacgactggccagagtccttggttttaaacattactgagaactttatatatactcttaatgggtattttatataatgtcgaatgaaacttttatttttagatttttaaaaaatattttgcactttggacttaattttacactaaattgtatcagccagcctaagggcattatgctaaatgtaaatctagttcttggttaagcttttattgaaagatangtggtgctgtaagttaatatattgtagtgaaagtgtgggagaaaagttaaattggcacttaaatcttanttttcaaggaaaacgtgtcccgcacatactgcattatgatggacttgtctcangtgaagtgaagaagtgaaagaatcaagtgtatggc

SEQ ID NO: 3554 - DNA, 828 bp, Homo sapiens
  misc_feature (1)...(828): n = A,T,C or G
ttnnnannatgnnaaaggngcagccnctttgnaacccttggtaaagccccttgttctttttgcagatcccatcgattcgaattcggcacgagtatctattggcagcaaagantntttattggtatactacaatatgatttaactgttattttggggataaatagtagaaaaaagtgaaacagaatgaaggcaggtgtttnttattctaatgatggaataatacagagatactggacgatctctagcagttaattattgtgacccatataaaattatacaggtcacagtataattctctattaccgnttttacaccagtaagtcttagataaactaagcatgcttatgaattatgtatacagttagaatgcattatttttacagaggaacaattgcttgtatgtactaacactgnactcttggcttgcctcaagttctactcattattntatataaaatactattaggctgggcacggtggctcacgcctataatcccagcacttttgggaggtggangctggcggattacttgaaggccaggagttcgagaccaccttggccaaaaatggggaaaccccnatctctataaaaaatacanaaaattancccangtgtcatggataccatgcctgnaaatccancttctttgggaaggctgaaggcacngggaatcggctttgggccccggggaancacaagtttgcaaatggagcccaaganccatgccacttggacccnaaancctggggtggacaagagtgcaacacttgnntcanaaaaaccaaaacaaaaaacatcagantantggnttggngaagccnanttgc

SEQ ID NO: 3555 - DNA, 782 bp, Homo sapiens
  misc_feature (1)...(782): n = A,T,C or G
gcnnnnnctngggaggggngnttgngggttnnccctttctcaaaatanctggacntcnnactcgccnaaacanataggncggggcgcattacatgattctgncttaacgaagatagaagcatnttattgcataagttttcttctgtgtgtgggaatcatatgtgggtgtatatatgtttaaggggtatgcatccgggtagacgtttgtgtgtggacatgtgtgtacaggtatataagtacatgtgtcatagccttggtacaggtctcatagccttgcagcactgtgttcctggcgggagtggcatcngtctgcatgtctgaaaatgccacgtgtgcattctgctgatcaccaaggtnngnggctgtaggcatcctctcttcantgcgtcagaagtctgaagaacatgtagcngcaccggggcgncatgagaaagnaacntgtaggatttatnaactcatttcttgaagccactcactgtntgnttttaagnaccaannncgattgcccattgccaantacagaanagacttcntttggtgagtacangnatgagngacttctctccnnnggncnnnctataatgaactntcngaatcctgacttcncgcancagtcncncggactcccctganctgggctnnttccgctccccacanngaaatnangcnntnccccattccccaaangncgnccccccnnctnccnccccnnccncccacccnccnccncccnccncccccccnncccnccancccnnnncnccngcccnncncccnccnct

SEQ ID NO: 3556 - DNA, 754 bp, Homo sapiens
  misc_feature (1)...(754): n = A,T,C or G
ttanatacanctacttgttctttttgcaggatcccatcgattcgaattcggcacgagcagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatggcaggacattcccgttctaaaccacatgtgatcgccttattggaacaatggaaagagcctgaagtgacagtgaggaaagatggaagaagatggtgcacaggataagaaagctccagtctacaaacaaaacatgccagaagatttttaggcgatgatgccacctgcacatggaaccaaaagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaacctgttcacatgaaagaatncatagtagtgaa

SEQ ID NO: 3557 - DNA, 751 bp, Homo sapiens
  misc_feature (1)...(751): n = A,T,C or G
tccnnttctaatgcttggctactngttctttntgcaggatcccatcgattcgcccaaaaccatttattgaagagacaaccctttcctcattgtttgcttttggcattcttgtcaaagatcagttgtccataaatatgtggctatatttctgggatctctcttttgttcccttggtctacatgtctgtttttaatgggagtatcatactgtttctattactgtaattttgatgtatattttgaaatcaaatagtatgatgctgctagctccattctttatgcttgagagtgctttggctatttagggtcttttctagttccatacaaattttaggtttatttttatgcttctgtaaaaagaggccattggaattttagtagagattgcattgaatctttagatctctttggatagtattgacatattaatgattctaatttcttgaatctatgaacatgagatatctttccgttcatgtgtgtattcaacaaattcattattattattattantattatgattattatcattattattgagacagagtctcaatctgtcacgcaggctggagtgcacgatttcggtttactgcaacctctgcctccggcttcaagtgattctcttgcctcangctcccaagtagctgggattataggcacgtgccaccacgcctggctgaataattggatttttagtagagacngggattttaccatgttggccaagntgggtctngagcctttagaactan

SEQ ID NO: 3558 - DNA, 747 bp, Homo sapiens
  misc_feature (1)...(747): n = A,T,C or G
agtnnttnntttttgactccttgctggnctcttgttctttttgcaggatcccatcgattcgaattcggcacgaggccacatagcaatggtntaactgcaggactcaggtccacttgcccagcagctggcagggaagggccatgaggcagtagagtccctacaggccaagaaactgagcagaacccatgcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaaagtctggtccagaatctgttccacaggatctctttcaaatgtctcagataatgctggtgttcaagggagccctcttgtgaataattatggccaggggtcaccagcagccaacagttcaatttcacccaggccctggaccgccaaacagctactcanctgcttaactggcccacaagtacagaccagagacaaagcaagagaagaagcagagactgtttggcccgggcccgagaagaagcttgctggcnaaggggacgttccaacgaagagaccactgtccttcgagcagganttaca

SEQ ID NO: 3559 - DNA, 778 bp, Homo sapiens
  misc_feature (1)...(778): n = A,T,C or G
gggnttnnnccctttgaaancttttatacaagctacttgttctttttgcaggatcccatcgattcgaattcggcacgagggttgttctaggtagtttcatgcggatgctgacctaaactagaatgtagaaattagtaggaaagtgaatgcccactaggtggaaacctgaaagcacggggacctgcgatcttgtttactgttatattcctgctgcgcagctcagggtctctatgtaaaaaatgagtgaatttattttctagctggtgcctacaaaataatctgcaatgtatccatactggtttattaatggtaacaaatgaaccgtactaatatgagataataggggaaactagatatggagtgtatgggaattctatctttactatttctggaaacctaaaactactctaaaatagaaggtttatgttttgaaagcactctgctcattgcgctcttgtctgaaaagtgaagcctggcctcaagccactttgagtatttctcttctgccagttaattatcttaccattgcctctcagtgatattaagagaaaacccatccttaacatttttcattactttttaggttcaaaatgagcctgtttggaacaacctcaggttttggaaccagtgggaccagcatgtttggcagtgcaactacagacaatcacaatcccatgaaggtccacgaaaagctttctggggcttgtaggaagaagtttgggcagagtttcttccatcaanggccagaacccgagatgaccttgggaacctcctttan

SEQ ID NO: 3560 - DNA, 772 bp, Homo sapiens
  misc_feature (1)...(772): n = A,T,C or G
ttgaanctttatacagctcttgttntttntgcaggatccctcgattcgagaaagaaaaagaaaaaagccatatggcatagaaaaaaaaaattctgtctttggaggaaaaaggaaaaaagtcccaggtttgaagccagttgtggcctcttactaggtatattattgagtctttcagctctgtttcaaaatctagaaaatgagttcagtattacctgtttaaatttgtgaataacgcattgatgtacaccctggattccctaaaactgtcttaactgcgtgagtccagtggactcagtgcatgagtctaaatccttagacttctatcagaccttctcccctagcagtttcatttgctctttaaatacaaacattggacactcatgcagaaccacagaaatcatgtagacaaactagaaattatcgtgcactcacaaattatagcttccattattaggtaatacatgctaaaccctagcaaacattaagtacgtgaactcctattactaaatagtaatcactcaagtaaactggacaaaatgtcttacggagggtcacatctcatgtgaaattaaaccatgttgcaggcagtgctacacctgagattttacacaggtatttacatttcttttgcctttgtggcaatatgtgcctgttaagataggctattagagaactgggcaatgagnaaccctacaccntaaagtacaaggaagnnatgtgccatatcagcagattttttgcttatttagttagtaatgaatcctcaaactct

SEQ ID NO: 3561 - DNA, 771 bp, Homo sapiens
  misc_feature (1)...(771): n = A,T,C or G
ggtgnttnnccttgaanttntatacagctattgttctttttgcaggatcccatcgattcgaattcggcacgagctcagctcatgggaatntgcctctcactggtcctcactgggtttatcccagtgaccaattctaggatgaccagaagaatgattccactgggcttgggagtgtttgctggtacctctaatctctgngtanagttnatggtacctgtgtgctctgtggctaggtcctcagagtcagtccctgggcaggtactgtcagccttcagttttccccacagactgtgttcctgggcctgaatcgctcagactacatgttccagcgcagcgcaaatggctccccancctgaaacagatcgaaatcaacaccatctctgccagctttgggggcctggcctcccggaccccanctgtgcaccggtgggtcccctgggcagnccccggcatacctgtggggtgacatgctgatgggtgtacagtcactggctaggccagggaactccagctatgattgtgctttnctgggccccgggtcacatgttgcccctgnccaccccgacagcagttnncacttgtaatgagatccttggtatgtcaaggagaaaaaggacctcatagctcatctagtgctgtcctccattgaacaggcagaaggaacaatatcttgaaaaccccaaaatanaggaaatgcaagggacttctggcttggnggctgngcctggtacatcatttctaccagcattgatgctccaggttcaatgattt

SEQ ID NO: 3562 - DNA, 786 bp, Homo sapiens
  misc_feature (1)...(786): n = A,T,C or G
ggnnnntnnnccctttgaaaaccctttatacaagctacttgttctttttgcaggatcccatcgattcgaattcggcacgagggacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacngaacacaacaaatccttnctgaagtgaattaggaaactccnaggagtaatttaagaccttnaccaagatncatgtatactgnggtacaatgacagccatggttcatatggttgatttttattgcncatggt

SEQ ID NO: 3563 - DNA, 838 bp, Homo sapiens
  misc_feature (1)...(838): n = A,T,C or G
gnnagnnngnnnnttnnnccnaccgganccacgtgaaccctttgttanaacccctngnncttncgcagggatcccatcgattcgaattcggcacgcagggcagcncttntatctngtnntttaaactctggccngccnttcctaatnctcagaccaacaagtagtgttttcccattcggatcgcttancanaaaatgaggagagtcttgtggccatcanctttattgnaagccgaaccactgtnagcaaaaataccaaggagaggnctgatcccactnttgnaanaaaaagaaccatgagggccctgcnnaatncaactggaccntggggatactcactgaagaaggtgnatctatttaggaatgcaaattgtcttnctaccccagacnccccaacaanaaanacttggggtgganggtganatatnncagccaagnaanaacngtttgcatntntccttnttggttngacaaagacntgntnccanatngtcctcaaaggtacataaatacanacatatgatatttgtgtatatataaacacatatgtntagtaanatccnncatttaccttggggngagacttgaagaaacnccagccttctttctagagagcctctgcttctggtattnacctgtcacaaaagcccatacctggttgtcaaaccctttccttgtaactganggagngcatnttacgaatatgggngtagagtaaagtagccaagtgcntatnggaaaatttaagccngaaaaannnaattannaaaaattccnaaaacagcccaataatctnnaggntggggaaannaaaaacccgnnntnggttnttttgtntt

SEQ ID NO: 3564 - DNA, 676 bp, Homo sapiens
  misc_feature (1)...(676): n = A,T,C or G
aacctntttacantcactggtcttttgcaggatcccatcgattcngtgaagtggagatatgtgaatgaccttgntcttttatttgaaatatattttcctatgtcttcattttccttcactgtctgtggtgatttatgtgcatcagataagacaaccacctctcccagnctcgtcagactggtctcatacaggagaaagatctcaacaatgtatccngccagagattttaagggcttctncaatctcaaaaacagactgctatatctcctttttgtggcccactggagcntataatgtgntatgtcctgtcagaaccctcatgaatagnatggtaggagcaagactctttagacatanctgaaaagcttacttggtggatgtgtgtatgcagntccttctatcttcanggngaagttgancaaagatgtttatctcccactattctgtctaacccgaaaganatatttgtctccattcagctgcccctctgtcctggggagaaagtagnggaaggggcccatctgtgtcacctcttgnntctgnggctatctctcantggntctacacttatanctaatnattttcaagntctgtgcggtggtgcctcaaacagngtgaatatccatnacaggtgggggggcncgaagggtancataactcctcatatgananntat

SEQ ID NO: 3565 - DNA, 781 bp, Homo sapiens
  misc_feature (1)...(781): n = A,T,C or G
tntnncnntttgaaaccttttatacaagctacttgttctttttgcaggatcccatcgattcgaattcggcacggaggccatacaagagactccagatatgcagctagagaaacttaaggaaggtgagcttatcaacgtgcattcagaaagtggttatgattacaagaatgaagatatcccagaggaattgacattgtcagaaaacttcacattaatcgaattctcagagatgtctcacaacattgaaagcacaaaagatgaaatgttagaagctggtgcacagtaaggataaaggagtatggcagttcaccaaggcatggaaaagatgcctgctccatattgttaagttatacagtgagaagaaggaggcgaacatagttcagactactcttggtaggtttttaccaaaaaataaaatattttaagctcaatatttttgacattgcaatgtactttaaaagatgctgggattaaaggcgtgagccaccgtacctggcccttggtggaatctttagggttttctattcatacatataaaatcatatcattggcaaacagagataattttacttcctcctttccaatttggatgccttagatttcttttncttgcctaactgntctgtctagaactcccagcctatgctgaatagagtggcaagaacaagcatttgccttgttnctaaccttagaaaaaaaatncttcaccntttaccattgangatgatgtttgctgttagtttttcataaatgatctatatcangctgaataaattctatt

SEQ ID NO: 3566 - DNA, 762 bp, Homo sapiens
  misc_feature (1)...(762): n = A,T,C or G
tatagtaatacaagctacttgttctttttgcaggatcccatcgattcgggcaactgtaagaaattcttctttcaaggcagttgtcttcgtatctatcattttaccatacctggttaaaacagagtcccaggtacatattaaagcaagccttcatacatgttggccctctatctaaaagcctcttcccactcctttccctttacctggtaatccctgttattccctagatgcctgctttaaagagatttcctttggtaaatcaccctgaaccctcagactagtccagacctctctttgatattttcctcttgacattcagcatttatcccaattgaaagtaataattacatttgtgtagttattagattatctgtcttccttagtaaaaagtaagcttatgggctgggtgccatggctcatacttataatcccagcacactgggaggctgaggcaggaggatcacttgaccccaggagtttgaaaccatcctgggcaacacagaaagatgccatcaataccaaaaaaaggaaattaggtgagtgttaaggtgcaccagccactctggaggctgangtgggaggatcacttgagcccgggangtgggaggatcacttgagcccgggaagtgggaggatcacttgagcccaggaggtcgaactgtagtgagctgtgatcatgccactgcctncacctgggcaacagantgagaccgtgcctcaaaaaaaaaaaaaaaaaactcgagcctntaaactatagtgagc

SEQ ID NO: 3567 - DNA, 773 bp, Homo sapiens
  misc_feature (1)...(773): n = A,T,C or G
tgaaaaccttntttacaanctacttgttctttttgcagggatcccatcgattcgaattcggcacgaggggaaagaaaataactttgtgaagccagtgtattctgtttttaaaactgtgcctgcagtgcaatactccttctggtgtattttatccattatttcacttgctggtcgtcatttcacagccagctttgacatgcccgtgaggacaggagccgccgcttcagttgtcactgcagagccatcgtatgtcagttgcaatttccatctgaagctatgtctttgacttcactttaagcagaaaattttgtaccctggtggtcgagtcttcccttaaaaattgttaaatcatttggctttaatggttcaataatttggggtggcttcatggtgtttcttttcttcccagtttaaaaaaaaaactttttaagcgtaaaatctttaaggggtacacatttataagtctggctaatttctaatatgctaattaaacatttcccattttaaggttatatacagtgaggctcttcaggacaattattttctgggttgattgggcatatgtttgcccgtgtaaacacggatatgataaagtgtcagtaacaatggaaaaggtcccagaggcattaggcatctaagangatgccctcagaaacgtattctggcttgatttgtgttattaacttcagaagaacctttcaaatgtcccaatatcgttcttagtgctttgggaaaaaatatttaacacactggtaataaatttgtatcagaag

SEQ ID NO: 3568 - DNA, 795 bp, Homo sapiens
  misc_feature (1)...(795): n = A,T,C or G
tttgaaccctttgaaaccnatatacaatctacttgttctttttgcagggatcccatcgattcgaattcggcacgagatnatagntttatccatacaatattgcgattgtctctggtcttgttgctttcctgcactagattgtgagcaccatgacattagggatcatatctttncattgtactgttanctacacataacanactgcatgctatacgttggnaaatgttaantnaatgaatatcttcncaggctagcttttttgatcgccccaacgcctaggctagttttctctcatcctgcctcanantgctgtggtgatgcatcccgctagcacctgcagagacancccngntggtaatgttggccacagnnccagctntgctgccagtgcccatcgatgnggacatggaggcggtcctagcttcaagctgacggtgctcccctgctgatacanaaactcctgattccaaagctcattattttgttagntttatgccctgtgtctntgtatcaccacccccatngntaaagcctggtnnttatgtctggagaangaaggcaatnggagggaggaggcctaatgngctcaaaatcaccccttttttntatgaaagtgcctcaaactcatttaccttggctctcanancctgaggaatgactnnttttcttgcnanactctttggttnctcatttaaaatggacccctgggggggaatttcttttcttcaatctgacagaanctaaattttgnccctgttntcaagggnaancaccaactggggcttntactngggg

SEQ ID NO: 3569 - DNA, 801 bp, Homo sapiens
  misc_feature (1)...(801): n = A,T,C or G
gntnnccntttgaaaccttttatacaatctacttgttctttttgcaggatcccatcgattcgctcagatgccagtcacaagtcccaggcctctcatacttctgaccgactggctacaaatcaggggttcccactacctcctcagattagataatttgctggataaaactcaggaaacattattattaagggcacaactcagcaacagcccagtagaagaggtgcacggagcaagcaccggggggacgtggagtttctgtgccctcctagggtggcctcctgcccagctcacccttgtgtgtgcaaggtccccgaatcttgtagttagagtttctgtagaactcaatctctaatcctttccttttctcttcatttctcttcaggataagggaccggggggtcggtgctgaaagttccacactctangcactgggtctcttgggtgaccagccccatccagangccatctaggagggctgcttttaatcacagcgttagcattaacagttgtgattgaaangggcttgttttgaacaataaaaaatatttctatctcaggaaatcccaaagatataggaactgtgccaggaactagagacaaagatgaaatatgtcttatatcacatttcttttgaattggttaaagtgccaataagacaacaaaaaataatattaacccntttatataacacttggggttaggtggttataaaataatctaaaagatgaatttaaaagtattgggggaggatgtacataggttatantgccaaatacctatgacgttttatataagggactt

SEQ ID NO: 3570 - DNA, 735 bp, Homo sapiens
  misc_feature (1)...(735): n = A,T,C or G
ttnaanncntttgaaaccntttttacaacctacttgttctttttgcagggatcccatcgattcgaattcggcacgaggtctcttggtgcgctttnatctgtcctctaaagcacaccctgcccctccctcctctgtcctcatgccgccttgtgcgtggtccccagctgttggtgtcagggcaaggacaaagacccgngacacctcangtctgagtcctggtgattgccaggccctggggaatgggggaagatgtggtcagaggctnttcttgtgaccggngcaagatgtntcttntgctggaccggcaccttttgtttgtnccattggtggcagatgtgagcnacatcaggcgctttctcagtgnatttcacgagccacangtggggctnatccaagccgnccagcanctgctgtgtgatgagcaagccccacagaggnanaagctgctggctgacctcctgcacaacgtcanccataacatngcggacgagaccnngnctgatgacccccgtggnttgaagcttggagttncgatttcanagcangtntggctatctganatacanctgtnagagccggatcccgagttacctgagggangtgagctcctaccntccacggtgggtgcggagnctaagaggaattctgcggtcttgctcattgcagagctccgtcatcatcatgcnctattcaaaagaccaagcggagcgcttgcacgaagtgttctgcaggtct

SEQ ID NO: 3571 - DNA, 766 bp, Homo sapiens
tatattttacaagctacttgttctttttgcagggatcccatcgattcgaattcggcacgagacagatcctccctctgcagatggtgagcagtttcccactcggctcttttgattgttctgcaattttcaatgaccatggcacaaatttatttaaagctgaaatacttcacttctattaaagcagttggctgggtatattgtttttgctgaaattattactctaggaggtaaatctaggctttatttactactttgggaaagtacatttaaaggccatgaatcagaaactaggttacaaacgttaagactcaaaggatctgtatactgaggcctatatttccatgaagtggttctctactctcagcaaatctagtattgctgaatgttgtagcattataagcaggaaaatcatcttactgcacataatctatccccacagaaacctatgacatttaggtattatgcaggcatgtgtcttcagttggctgtctccttattttaaccatgtgtccctataaatacttcagatccaaaaggttttttccacacttcgttataaaaaagtactaactagcacatatctgcattttattccgggatccacatctccaaaaagttgattataaagtttacagcaagcatagaattcaaaatttccttttttttctaaatgaccaacaatacaaactttctcatgtacacacacatgagaacacacatgcatgtcatacacacatcatgcattcatcacacaaagcaagcacag

SEQ ID NO: 3572 - DNA, 773 bp, Homo sapiens
  misc_feature (1)...(773): n = A,T,C or G
tgaacnttgaaaccttnttacaactacttgttctttttgcaggatcccatcgattcgaattcggcacgaggttggccttttcnattcagatgtttncntgcaggangtgcctgngatnnantttggnttgntnacatgagtttnatatgcatgcgcatttttggatgccaaacacataggcagatgaaactaagaagccagatgctagagatcgcagngcgatgaattgaaactagcctaactggctccactgttggagtcattngctcaaactactccaaacttttgtttgntctactgaaaacattantnggaaaggtacagngntaatttanggcngggaagcctnnatcncgtgagagtnaggtctntntatgcgatgctggnanggaaggatnggagatgagagtnattttacgggcgcctatctcctcctcttnctatcntgccctggactgcganctcatctttcatannctcttgcntggtggtaggcccagcaancggatggattttaagnatctcagaattttcanttnatcannnntcactntcagagntccttttntttntcaagggtacccagtctaactggttagcttcttttcaatagncctccttactnacttacgcctagtcanggacgaanantaatggtaactganttactntcctccaacaaancattagntgattngactttttacncctcattcnganggcnttagaccccttttgtgcactttacncaaggatgttganacctanaattt

SEQ ID NO: 3573 - DNA, 790 bp, Homo sapiens
  misc_feature (1)...(790): n = A,T,C or G
ggtgnttnnccctttgaaaaccctttaatacaagctacttgttctttttgcaggatcccatcgattcgaattcggcacgaggnaaagcttcatgttccgcacctggggggcggatgttatcaacatgaccacagttccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcangtacttaagctacattagtaagaccagaacttagtggtgagggttgaagctggctggacaggcagttaggagtgagtcangcgatggtgagcctccgtgccagaacaacttgtaggctgtggaagcaacccgcaaagggatggcagcggtgatatatatagttgaaagatcactgtctgctgtgtagaggatggatttggaagagtcaccanagcaggaataagaagttaaagggcctgcaccagggcttgtagcatagagtttnagaaagtcttggggagaattgantcaccttgacctactgattcatttggaangtgggaatgcaatcatgggggtaagtcctctaagataggacctttnaagtgtanggatn

SEQ ID NO: 3574 - DNA, 715 bp, Homo sapiens
  misc_feature (1)...(715): n = A,T,C or G
ttgattcnntccttggccttttgcaggaccctcgattcgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctctttttcaaaaggaatgactttaataaccatagcaacacttactcagttttgtgatccactccaagattatgggagcaagaacagatactcctgaaagcaaccctcaccttctccccgccccctgccctcacaagtcctgcctgtgtgaactgaagggtttggaagctctggtttctaggantgcccagaagctagaaagactanggtgtctagttattgaggggcaattgtcantggcagtgtgggggcaccccantggtattcgaggcactggattgctttttgnctcc

SEQ ID NO: 3575 - DNA, 750 bp, Homo sapiens
  misc_feature (1)...(750): n = A,T,C or G
tntatanatacagctcttgttctttttgcaggatcccatcgattcgaattcggcacgaggtctcatcctgaggccactttctagggccatttctggcaccagatgttttatttcagctcccccaaaagcaaaaccctgaggcagggatcttggttgaagtggggaggggatcccagaaagtggggtgagggtacggaggcatgaggtaggaaagggaagaaaggagataaaatgtgtgttaatgagcaggttagcactgtggaccaccacgctcaatcccactgagacgtgaggaagctgggaatgtatccaccaggccttaatttatcaagatgaggattactcctgagatgttaactccttgttgttggacctaggctgaacatgcttccgtagccaagaaagggcttcaggtgaagagacacagagaaccttctgcaggccacattccaggctgggataaggggaattgggtgtgacatcaatagcatctcatcccacagtgaactaagaagatagaagagcaaatgcaaggaatatttgcatgctttcaatacttactcatcaaagggtcgactcgacttanaagaaattacaaatcctgcttaccattttcagcccaatatgctcacgttggccaagccacagctgcctttaaatagtaccaactcttgaaaaaaaaaaaaaactcgagccctttanaactatnntgagtcgnattacgtagatcccgaccntgataagatccnt

SEQ ID NO: 3576 - DNA, 749 bp, Homo sapiens
  misc_feature (1)...(749): n = A,T,C or G
tttgaaanccctttgctacttgttctttttgcaggatcccatcgattcgaattcggcacgaggcgaaacaccactgcaaggtgaacagcctgggttactagcanaaaaacatcattcagtctgtaaatatttatgaanatctgtganaggcactacccttaccctggagctaacctgtgacccagagagcaaggactcttgcttttacagaacacatattcttgtggaatgagaggggctatcatcaantaagcaaatcattcnatgnantgtgttantntattttcccattgctttaaagaaatgccttttnctgggtaacttataannaanagaggatnnattggctnatggntccacaggctgtaccataagcatggtatcatctgctcagcttctggggaagcttcangaaacttacagtcatggcaganggcaaatgggaagccagcactttacatggncananaaggaggaagaganagagagaggcacgaggtggtacacactnttaancaacctgatctcgtgagaacccactatggtgagaacagcataganggaatgatgtttaaccattcatgantaaccaccctcatgatccaatcncctgcaagcatgnaccaacttcaacactggggattacaatttgatgtgaaatttgancagggacacaaatncaaactcatcactaagtatcagngctttgggaaaaaaatacgtnnntccanncntgatagatncctnnt

SEQ ID NO: 3577 - DNA, 745 bp, Homo sapiens
  misc_feature (1)...(745): n = A,T,C or G
tntataganacagctcttgttctttttgcaggatcccatcgattcgccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgnngcagngattggaattgccacanaacgggccccnatgcagtgccaaggttatgtggcattgctgggcagtgatgaccagagctggggctggaatctggtggacaataatctactacataatggagaagtcaatggcatgttttccacagtgcancatcncaccaaaatatcagataggagaaagaattcgagttatcttggacatggnanatatgactttngctttnnaacgtggatatcagttctgggggnngnttttngaggactccaaagggctggttattcccagcanttnatgctgtatatgggnncncagaantnactttggtnnnactnggnaaacctttgtacggnnacaanngnnnncttgnnatnnctncnnnangnnnganaaat

SEQ ID NO: 3578 - DNA, 752 bp, Homo sapiens
  misc_feature (1)...(752): n = A,T,C or G
aaatngctaggctactcgttctttttgcaggatcccatcgattcgaattcggcacgagcccagctctttgggaagctgaggtgggaggatcactcgatcccagnggntggagacttgcctgggcaacatnntgcancctnntctctaaanatatntnttgcatngantngcccgncatggtggtgcacgtctatagccccagctacttcagaggctgatgtgggaagatcccttaagcctangaggtcngaggttgcagtgagctatgatngcaccattacnctccagcctgggcgacagancgagactccgtctcaaaaaaaaaagaaaanngactntnnncgaanggagacacgtnaaagtcttgctaattgtcatatccactcccaantntagcntttctggatgatgnccattcctnctgcaatnnccttatnatccatctnaacnttttgcaacctatgaactgnttcgtananttaattactaccaatacaccctatgtacaggagcatanggaaatcaanaanantgangaattnnantctattaaaggccacnagaatggntnacacctgtaatcccaacactntgggaggccacngcgagtggatcacctgagatcangagttcgagactggcctggncaacatngtgaaaccccngtncctactaatggtncaaanattaccaagccgtggtggcacgtgcctgtgancccaagntnctcnggaagctgtagcangagaaat

SEQ ID NO: 3579 - DNA, 725 bp, Homo sapiens
  misc_feature (1)...(725): n = A,T,C or G
gtgttgaatcnttctcncatnaaacnctttgganacccaccgattcgaattcggcacgagggtgattgggctggttctgtaccgggtgtactccgtggggggcgtnatctggcaaagccttggaggtgggactgtggaggcaccattgattgaactgtgtcccctgcagttcacatgttgaggcccaaacccccagtgtggctgcatttggagtagggcagtaattatggttaaatgaggtcgtatgggcgggtgctgatccactaggattaggatccttataagaacctgccaccttctctctgccacgtgaggacatggggagaaggcggctgcctcccacccaggaggagcccttactggacactgggccctggctgcaccttgaccttggacttctagtccccagaactgtgagaagtagatttctgctgattacgctttcctgtctgcggcctgagctaagacagcggcgcttggggagaagcagaatttgaggagctcctcantggcaggctgccctggccctgctgtcagcagaggggaatggccatccatgctggcccctaccagccgggccttcantgagctccccgggtaggtgaanctctctaactctgtgtcccccgcaaacaggcccacgagccaacgcctatggggtggantgaaaattangaagaaacattacccgangggtcactctntttnanaagacctcaatggnt

SEQ ID NO: 3580 - DNA, 737 bp, Homo sapiens
  misc_feature (1)...(737): n = A,T,C or G
nggtnagttaatttagcctngtgaactcttggaacnccgattcgaattcggcacgaggagcagagatggccacagaagccagagaagctggacgaggcctttttggcaacaaaagagtgacttaacgcagttctaatgtcctacatttttatgctcttatcctgcagttacaggataagtcaagatacacggtctacaaagaaattttgttctaattttataatagtagagatggggtctcactatgttgcccaggctggtcttgaactccagggctcaagcaatccgcctgcctaggcctccctaagtgctggattacaggcatgagccactgaacctggctgtacaaagaaatttatggcagagagatatgctctttattttggggaggtggcatggcattatcaaaatagcatgggctttggaatgaaaaccttggtgaccgtgagcaaaggaagcatcatttgcttgtcttcaaaagagggatagtgcaacttaacctgcaggagtaaatgagataacaatataatagtatttattaacagagtcttgctgtgtacctatagtacatcaagattccatttctactttttttcctttttcactgnctaaaagttttaataacnttttaaataagatgatggtatatcaaaagccanttataggctactaaatatttttaattatttcttaagaaaaaaatttaagctaaaagaaccaaatgggatatttttttg

SEQ ID NO: 3581 - DNA, 718 bp, Homo sapiens
  misc_feature (1)...(718): n = A,T,C or G
gtntttatcctgctcttgcantcgtaggaccctcgattcgaattcggcacgagccctccttgcccagagcaggcattgctcatccactaggcacttcttcctgccaaggcacctcttcctgccaagtcagtgtctcacgatccctttcaacacagccacgaggaagccatgatacatcaactggcactggcaaataaaatcaaacctatttgcctatccagtcttatcccactttgttgttttctctaagtagttggaaaacaacatgtccagagaaaaataccagaacttattctgagtatgttcttcagagcaaacctttagaatcttaatgatgtttagacactcaggaatgagtgaaccagttgcactgatagaatcaaaacaatactgcaaatattagtcatgttgcctattatgaaatatatctgtgtgtgtgtatagatatgaaaaaaaaactctaaagtctgagttaaagagccctgccaggtatagttaaatgctctctaacctatnaagaattcaattccatttggcacctccaaatctggtatccagaaggaagaccagagaagcagcccccgatgcaatttgcaagatgtgttcctgtctgggggtgccacacgttaacagcagcttaaaaaaaaaaaaannttnnnnnnatnnntaannannntnnntnnattnnaactnnnnnnnnttcttncnntttncnant

SEQ ID NO: 3582 - DNA, 721 bp, Homo sapiens
  misc_feature (1)...(721): n = A,T,C or G
tnncttaatcntgctcttgcatttctgnggacccatcgattcgcccaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagtactcctgggctggcaggcgaaccgactgcggaggcgctacttggactggaggaaaaggaggctgcaggacaagctggcggcgacgcagaagaagctggacctggcctgagactctgcgccttccgcccattctgtccccctcatggccaccttgccatgttcgcgccggaccccggtcccgncggcgcccagaaccaggcttgccacacagtccccgnctgccatggccggntcttnctggaatgttgcttgttgaanatgcatatagactacccggaaa

SEQ ID NO: 3583 - DNA, 723 bp, Homo sapiens
  misc_feature (1)...(723): n = A,T,C or G
attgggtncngctcnttgttctgctgcaggatcccatcgnttcggataatacttgtggatcttgatgctaaggagcctgctccttatgcatcaagaaacacataaccaggtacagaaactctgcagagtactcatgagtggcaggaggagctgtaccacaagaaggaagggctcagggaaggggacatgtcttactcacttgttagcttccacggatgggatgtggcagtgctcatgaaaggatcttggacaagtgtcgcagcagaacagccgtccccatttgttgcacacctcacatatatttgagttttccggctagaaggggagatgtagacatcaccgggatcagtgagacccttggaccctagaatatgtgacctttttatgtatcaagggcacacttgtaaatttctgtcctcaaaatattaaagattgctgagtggagatctcagaagacattttggtctgcggcaaagttcagtagatagtggctgtgtgtcaggccagaaaagttttctttatgaaaccagagattctgacatgatgactagtgacaaaaataggatgaattagagattttttgagcaatttattaaacagctgggaaaacctggcccagaaatagtgtcttttctagctgctacatcgtatnctttaaactgacttgncaagggtgatttactgagaatttaatatgantggaataaacttctgagatatcnc

SEQ ID NO: 3584 - DNA, 717 bp, Homo sapiens
  misc_feature (1)...(717): n = A,T,C or G
tggtgcnnggtccttgctcttgtnngctgcaggatcccatcgattcgaattcggcacgaggtccaggccaataatcagttggttaagtgaaaaaagtgtttaaagtgaagaattataaagaaagtcattatggatctcaaacttttactttaattgaaaccataaaaacatatattcactcaccaatgttttatgcagggttaatgccttctctttaaaattggacttctgattggatttctacctcatttttcttatgtaaacacttatagttcacttttgatatttatgggttttgatttttgaaacaaagggaaaatgttaaaacatatactgttcagtaatgccacctaatccatgcgggatatgtcccaggacccctagtggatgcttgaaaccacagataccaaacatgattactgtcagtcggaacatttttttttttttggagacagagtcttgctctgttgcccaggctggagtgcnntncnnnnnnntnnntnnnttnnaantantnnttcnnnntantccnnttaaanntttcnnatnntttctnnnnnntncnnnnnntcttattnatntnnnntnnncntntannnnnnttttnnnnttcantnantantctttttncaccttnnattnttcnnttntcnttttnntnnnnnttntnntnttnntttnnttnnntntntnnnantantntnntnnnnctcntnc

SEQ ID NO: 3585 - DNA, 746 bp, Homo sapiens
  misc_feature (1)...(746): n = A,T,C or G
aaagggnntnattagttatccctttccaatcccgtaggatcccatcgattcgaattcggcacgagatgcctgccagctgagaggcagttggattccnttngcngagcaggcatttcagcagattcagcagtcagagtgcaccaagaagggtgctttagtttggagtttcaaaaggccatactgtaatagtgaaccagaaatcaagcagccctcagaaagactgaaacgcatctacggatcatctcaatctgattgcataaaggtggttcaagatttattagtgctttttactcgcctctccaatttttcatatataatgtccagcaccacatcaaaaataacccagcatagatggagataagacactatcactaacacaatagaaatagatccacaaaagatttagatcagggatcagcacatttattatataaaaggccagataataaatatgttatgctttgttggtcacatacagtctcttgnatattctttttctatttttgntctataaccctctaaatatataaaaactattcttagcttggagatcactcaaacactttctctggcataatcaganatatcttcaaactatgcttcaaatgttcaagggaaataactgataagattgaaaaattccanggagangcacaanaagtcattanaaaaaaaagcccctanaactatagtggagtcntattaccgtagatcccgacatggntaagatccattggtggagttcg

SEQ ID NO: 3586 - DNA, 728 bp, Homo sapiens
  misc_feature (1)...(728): n = A,T,C or G
aggggttggangaagccctttgaattccntcggacccatcgattcgaattcggcacgaggttctgagcagttagtacgtggcagttgtattattagaggaagcctgtcttgtttttttttaaataagctgatagagtgaggattcttttaatcaagactgtttgggattgaattgccactcctgcttaccagagtgtaggcagtttttcttaaactttccaagaagactggtgtcctcatctaaaatacgaaatgcttacagtaattgcctcatggggttgtttggggtgactaaatgtagtaggatttactacatagtaagttctcaatacattgtagctattattattagttcggtagaaagaatgtgcagattcttatgagtttaagtaggctttcggggagatagattgactctggtcttttaaaagttaattttgaagttgcagttttgtgattaagccttaaatctgttattctttccttctgaaatccttaaaaacagaatgtttagtagaaggtgataaccagatttctttattccaagaactctttgctctcatgtctaacctttattttcctggtacttactgatgccagaagcttctcttagtnaatataatacatctcctctctcctaatttgctccccgtctttccttgtaagggaaaagtaaatttactttccaagcctnanggttatttatggattangtgaaccactgaaat

SEQ ID NO: 3587 - DNA, 787 bp, Homo sapiens
  misc_feature (1)...(787): n = A,T,C or G
ttttgaaaccctttatacaagctacttgttctttatgccggatcccatcgattcgaattcggcacgagggcagagtaagtacggtaatttctgcacccgaatgggtagtgttgcctttgaagtagtcaccttgggaagatgtatgtttattccagtgaagctgaccttacacagaacattcctagaaccctctttagaaactgtcaacttgtaagggtcttcagtgttggtaaatctttgtcctttaagggtagatctattttttgaggaatgatttttttttttaacagctaaagagcattagaaaataagtctgctaaataaaatgggtgaagcagctcaggatgatcttggtgggcaggaggaggggttggataaaacacaaggtctgactataaagttgtgaggcctcttgccttgcatggcttcaaaggtaatcccaaaggggaaccctaagtgttcttggcacatgcaacatcaagaaaataactccaattatgctaactcttgagtgcatatgttctagtgtatttggttaaaaaggtggctttgttcattttcagtcatatttcgtataagcagaaatggaaaactccatctctgtgatttctcccaanggaaagatctcatctactgcttagagaattaaaatgaaaagcacttggtgtcatgtctacattagccccccccccccccaaaatgtgccaatgggtaattcctggatacctgagtcttncccgtttnggaaaantgggtnaaggaccctntaaaactatagtgagtcgta

SEQ ID NO: 3588 - DNA, 744 bp, Homo sapiens
  misc_feature (1)...(744): n = A,T,C or G
tnnncttnatttnnanccnttggntctttctgcaggatcccatcgattcgggagatttcaacttaacttgaccactgcactccagcctgggtgacagagcagacaagactgtgtctcaaataaataagtaagtaagtaagtaaatatcctgtaggtatctatgtgactcaaggctagtcactttcctatctatgctccagttttctcatatttgagacaagagacttgattttagcataaaggtgagagttgaagtaatgagtgtgaaagaggaaagggagaaaacatacagagaagagcagaaaacacaagcagctggtaggcagagaatgcagaaattcaagttagagctgttggaagatgtggtaggctgactaatggtgccccaaaaatgtctaagtcctaatccccagaacatgtaaatatgttaccttacagggtaaaagagactttggggatatgattaatttaaggatcttgagataaggagattagcctggattatccaggtgagcccaatataatcacaagcatccatataagacaggcaanagagcagaatcagaataggagatgtgatgaaggaagcaagagattgcagggattccaggaaggttctgtgagccaangaatgccaggtggacccctngaagctgaaaaangcaaggaaaatggattcttcttctcannagcccttccncttaagggacccagcccttgccagcaaatttggccaacttcact

SEQ ID NO: 3589 - DNA, 858 bp, Homo sapiens
  misc_feature (1)...(858): n = A,T,C or G
tttaaanctttaaacaagctacttgttttttntgccngtatcccatcgattcgaattcggcacgaggtacttcctaggagtggttgcatttgggaatggaattgttaaaacttgatgcttaggagcgaatgcagactattcattgggtgtttggggtgggggaagggggggtgggcanaggaggtatgcacnggagaggggntctgngctnctcnnattattgcacaaccnctaaccattgttctataactgcatnaacanatnataacngggccttncnngatntatcttaacgcttannttttncnanatatanatgtaactaatcactcnctttnngtaatnanctttnccntnnttttgtaagaacgccnctcctctgnnactgacctttnttacttccccccccttgccncctngaccttcctgntntttctcacgtngatngtggcanttnnggantaacatnaatgntnaaaggcntngnttcttatntaaaatttnncactctccacnatnnntttangatnaaaaccnnctnntnttncanaaaancgttttnctanttnnaannaccctttttannatttttnnaacaanaanctnttatttttnnttnccatnctaaccttttacaaaantnnnggttaaccccnttttttatataaaanctnnntnnnttatnaanaattaannantatttngtnaaannccctttnaaaaataanttnaaaangccctnnttnnatgcaannattntnaatntgtttanccccnccntttnncncatnggnnttgtcctngcnttnancaatntaccttcattttaaaaaaangncccanattnttttnnnacct

SEQ ID NO: 3590 - DNA, 767 bp, Homo sapiens
  misc_feature (1)...(767): n = A,T,C or G
tgtggtnanangaactcttgcaatnccctttgcgntnnccgcaggatcccancgatncgaattcggcacgagggccacnccgcctgtgangnatttnngtnnctntttnntgnacctggcatcctnnttccttccccncctngcnggcaccgccnaggaccgncggccgggggacgagcncggagcngcngccaggtagaacnatanactanatagcactgaattaacctgcactgaaagctgngnacctgcatnatgtgcactcatgangnangtgaccntgtcnnaagtgcaagtgcaagtccagaaccnatctgctgntntnacngggagccaaanactgaacangaaccagtctnnacggtnacanncnangatgantatccctnntacnactanctcnctgcccnttgaaaatgcnggtngacccattcaaaacttatgntngacccatctncanatatgacatgcaccagtgcaagntgnacaaaagcatancccctctgtagaactaaagcacctgtgcctnaaacttgtaaaaaaacccaatggtttaaatccgggaaggacccttaacncatcnggantgccngtttaacnantaanntaccatcatgaanaaggaggtgncatatnccaccgngggtannttgaccccaattgccaaattncccnntttactttatcaaagtnggnanctttntggnnggagggnaanntatnttnantggcaaatgcnanaacnnccaaaagntncnaaaaaacnn

SEQ ID NO: 3591 - DNA, 732 bp, Homo sapiens
  misc_feature (1)...(732): n = A,T,C or G
gnttnttttaaccntaaggaancctttgatgcaggatcccatcgattcgaattcggcacgagggcaaatagccctaggagtcccatttttttaagctgagggaaataattttcaagaagcttgtcttactagtagcatcattcttttttactggctcacagcttggaaggggtgatggtttttcctatgaaagctaacaacatttgagcagatccagtgtgctggtgagtcacagtgaaagtgtggagtgctaaggaagcctcctggtggaaatgtaagttcagagaaggtctgcagaaaatacagggtgaaatgttatcaaggagccagggtattatttaagaagaggagggaggggaaaaatanaaaatcaaatacactaatagaagtaaaattccctattcagaaaaactagtgagggctgagctccagtaatcagagagaagtctaatcangtcactactgncatgggaggacatagtcactctctctttcangagcctatgaagcttgcgagagctcagctanggaataagggtggccaganacagcancattaactggcacaaatctcaaggggcctgtggggcctgaaaaaaggaggatnacaggacatgctgacagtaaatgcttcattctgtgcctaacaattttccacttncctgnngactttcctcaaatggatttacttaaacttttcccaaccttnaacaggttaacttgcntccanct

SEQ ID NO: 3592 - DNA, 823 bp, Homo sapiens
  misc_feature (1)...(823): n = A,T,C or G
tncnntttaatnccatcanctcttgttctttttgcaggatcccatcgattcgaattcggcacgagggttcatgcagtaagatttgttgtttatttgtaaatagaatggtattctatttcaaacttttaagacaaacctgttgccgcaaggctgatgcacattggatgatgactgttttctggttccagatcttgtctttgtgatataggagttatggaatgagccctggacaggatcctaagatccgggtttgttcctacttctactcattaatagcagtttgacatttaatataggaataatgttaacttgtcacttaaaacaagattctcttcatcttgttttcaagatttcaagattcttttaaaaattagcatgaagtatgggataatgattggggaggaagtatttttaaaaagccttcttgagtttttatgcatattacatttttattcaataaaaaattccccattgttttattgaaatggattagttgtcgatcctctgaattagacatattctttaaaaataagatccgttgtcagccatctaaaatgtttttataaattcatacttacattcttttttgccggttgcagtcagcctttagtgccaagagagaacattacagcatggatgaatgcaattggtttgatcatcactggcctccaagtgagttaataattgngaattggacttaagngatgaaaaacaagccngctgttncctgtcaggnctctagaactatagtggaggccgnttaccttnatncccgccttgaatnaggaatnccttggnggagtttggacaaanccncaactnn

SEQ ID NO: 3593 - DNA, 1035 bp, Homo sapiens
  misc_feature (1)...(1035): n = A,T,C or G
nncnnttnattccatcagctcttgttctttttgcaggatccctcgattcgaattcggcacgagcaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcancggntntcccttcnnnngcatcntatntnaatacntntccctnttncnntngttctgtnttnttttatannnttcnnnccnntntnnncctcttntccctgtncnntttgattnttttanttnttntntttnnnctcnttnctnttcnttttactatcnnatcntctttcnttntttctttntttntanttctnttnnntcctttncttcacnttntantncttcgcctntttaacnntnttntttatttntcnttctngtaatntttcntttatatntntntntttcanntcnnttaattcnnctctantnngtcctttccntattntnattngncctannatantttcnatannttctcntnnnnnctnnttnctatttntnnnaattcnngtntgtntcatntcnctnctncttnctnntnntttttnttnatnntatntttnntatcttcnntctnncttnntanatnttatctntntntcnttctncntataaactatactnttnatcttnctcnnttntcntatctaatctncantntattantttctctantntntcatacctcgancnannctcntnacgntntntnnnatntnnnnnnncttannatnttcatntaanatattatnatantttatttctnttctanntntctcnnnatanntnnctnnantctanttncnttnnttntatcnttttnaangtattttttttnantatctantnnnatnccc

SEQ ID NO: 3594 - DNA, 992 bp, Homo sapiens
  misc_feature (1)...(992): n = A,T,C or G
cggnangnncgtnaacggaancccgncnnttgcggatccctcgattcgaattcggcacgaggaactagtcatgccaggnactaaattttngggggcagtgagggatctggtgcagaancaacctgatcaatgggacaggacagggagtctcaaaatagccataactgcatataaacatctagtatatggntaccacagtattcaattcaagggggcaaaatagagactttttaataaatggtgttggaataaattatagttatttgntcaaagagttataattttatgcattccttacacccatgcactagatgatcctccaaatggattaagactgaaatgggaaaagaaaaaaanggggggaattccctatatcatctgggnctaagggaaaaaattttttccaacctatggacccaagttcccacatggtaacctggaaaaaattaaaaaaacccnggacctcntcctcctcntaataataatattaataantnnnnaaccttttccaatggggccaaaaaaaaataaaatccccaatttaaatggaaggggnaaaccaattaaaaaaaagggaacccaaaaattaaaattaaaaanccanggggaaaaaaaaaaataatttggggangggaataattaattaattnaaccaaaaaacctnccccaggaaaattccattaaaaaggaaccattccttnaaaaataaatgggaggaaaaaaaaaaatgggaaaaaaaggcccaccaagaaaaaaatttncgccaaaaaaaggnatggacctgggacaacctcaaaaaagggtattaaaaaaaatccccttaaaaatatgtaaaaggggttnaacctcacacatactagggaaaaattaaaataaaaattattccggagaaaaaagccacccatcagaatngacaaaaaagnccnaaagcctnggacaanagacccttttggccaaggctggccaggangggaaaaaaaaaaaacncccct

SEQ ID NO: 3595 - DNA, 812 bp, Homo sapiens
  misc_feature (1)...(812): n = A,T,C or G
nncnnntttaattncaatcaagctacttgttctttttgcaggatcccatcgattcgaattcggcacgagcttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggctcacacttgtaatcccagcactttgggaggctgaggtgggcggatcaccagaggtcaggggttcgggaccagcctggccaacatggtgaaaccccgtttctccccagaaaatacaaaaattagctggtcatgagggcacacactgtagtcccagctactcaggaggctgagggggaagaattgcttgaacccaggagatggaggttgcaatgagtgaagatcgtgccactgcatccagcctgagcaacagagtgagatcttgtctcangaaaaaaataaatttaattgctgtggatctgtaaanggtgtttatcgtaacagttcataatattctatttnaanatgcgtgggagaaattttntntgganccagttatgcctttnctggaatgntggttgggtttaccttaaggccactnaatttcagctgatggtttttctggt

SEQ ID NO: 3596 - DNA, 830 bp, Homo sapiens
  misc_feature (1)...(830): n = A,T,C or G
nncnnntttaatancaaacanctacttgttctttttgcaggatcccatcgattcgaattcggcacgagcttcctccaggcattataatattaggttaatttagaggagcatatttatatgtggagttacattgtgttggccattcaggagactgactgtgaaagaatccaaactttatatttctgccttgccagtttttttttccttttcttcactccatttgagacactcttgacctaatccagtaaactctaattaatagtcttggtaaattctgtttcaagccatcctgagtagcgtcactgacacccgatctgtttcagtaaggtcaaattagcatcctttactatttttctggcatttaaatgaatgactttgctatggtttttcaagtgtttatagtaaatatgtccatttgatggaaatataaatatgcattaagtgtaagtggctaggcacaccctgctgtcactttttatggtaatcaagtgtctttcactttctgttgtttttaatagggaccagctgacaacgccacattaaaaccacagggactcaaaagataactcccccaccccctcacccggcactgcttttatcttgcaaaagtattcatgtttttctcttagtatgccaattacacccgttctctgacatttncacttatgtactcatgggaaggaatgaatgggttactcaaactgggaccattgaatttggggacacctggtggactccactggccttaaganctacanggttanttggaaacagtggggcaccgtgggttgacttggccttttntttgccagngggttttgggccttgan

SEQ ID NO: 3597 - DNA, 820 bp, Homo sapiens
  misc_feature (1)...(820): n = A,T,C or G
nncnnttttaattccatacagctcttgttctttttgcaggatcccatcgattcgaattcggcacgagagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaaatcagtatctgagttgcataccaggcagtattaaaaatctaacangtctgtttggcccattgatagatctcaaatggngtctccttctgggtatggattttgccnttggttaccctttctcaatgtaatggaagtattttacaagccaattggnggnggaaatggtgctcttgncttttcntgnttacaaactactttcacattg

SEQ ID NO: 3598 - DNA, 856 bp, Homo sapiens
  misc_feature (1)...(856): n = A,T,C or G
gnnnnntttanttccaatacanctcttgttctttttgcaggatcccatcgattcgaattcggcacgaggatagaataaccaatttaaaatgtcttatagataaaatctagaatgaagctttggtaagaagtctgagctacgtacataagattatcagcaacatatatgttaaggtggagccatttaaagaaagaacagaagggacctatgatttactgattgttgaaaatcaaaataaaggaggcagagaaaataaagattgtgagtcagcaggacttttgtcttattttcaagtggatttattgattacttttcttcttacagccaagtgcaagatttgtgaatgggcgtttgaaagtgagccactatttctccagcatatgaaggatactcataagcctggagagatgccttatgtttgccaggtattgcctttttctccagggagttttagcagttttgctctcaggaagaatacaaagaatctactaatgaatattgttgaccacctactgcatacactcagtttaggaactctgagtaggtacagaagaaatagtaaacacagtttatcttcanggtttncatgccnggagaaaaacataaaaagaacatgttccctacnaaaaaaatttttttttaattaccttgggcatngngggtgcaccactgtagtccctagcttacntngggangcttgaaacaaggaaggctcgcnttgagcctcaaaaggataagtccctaacttcctcaaggaaggcttccggnggaanctatgaatcatgcctncaancctggggcaacaagtggagaattttggcttntttaaaanaaaaannnnnnnnnaaaactcggg

SEQ ID NO: 3599 - DNA, 800 bp, Homo sapiens
  misc_feature (1)...(800): n = A,T,C or G
tttaacnctttttanancctcttgatcttttgcaggatcccatcgattcgaattcggcacgaggaagaaagcagatgccattttatctattngcacatcaggactgacagacatgaaaaaattggccaagtgggcagcagagtccaagctcgacccaaatgaccccaacaatgcccctttgatgcagcttatctcggttgctaccagnggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctncagcaggttagagaatcagngataaatcgtttcttaattgcaaaacaatattttntttttggctgntatggatagnagaagaagaagttcccaatttcancattttgggnctaagccttttcaagctngccanaacaaaancngaccactgnggncaaggngaaaaaggnnggnangaangtgancnnccccaaancctngnntnnnnggagacntaaaanntggctnnngaanattngnnnnnancttacnacnttccaanngnnggaaancnnnnnttnnnnnaannncaannnccnnnnnggntttnnng

SEQ ID NO: 3600 - DNA, 784 bp, Homo sapiens
  misc_feature (1)...(784): n = A,T,C or G
tnaaccctttaacaagctattgttcttttgcacgatccctcgattcnaattcggcacgaggcgggcgcgaccggaggcngtttccgttactatggcaatgacggcagggactacaacaacctttcctatgagcaaccatacccgggaaagagtgactgtagccaagctcacattggagaatttttatagcacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagangaaacacagttcttcatttcagagactgttcttggccattagatgccgatcccccagntgggtttcattccntcnggatattnagcccgacaacccttttnttgggttgcccaagggtcatgtaaaattn

SEQ ID NO: 3601 - DNA, 772 bp, Homo sapiens
  misc_feature (1)...(772): n = A,T,C or G
gnaacctanaaacagctattgaacttgtngcacgatcccatcgattcgaattcggcacgagannaaaggtgtgagccacngcgcccggnntanntaagaannatnantnngnncttgcngnanaacatctgtnntnncaacttantacnaacaaatatnannattaaacncttcactttgncttnnnaactgntcnaaacactgncactttggcttnaaaactgctcccacaatntngctagcatttttggngattcaacattcatgtcaaaccaccacactagggctccccagttncttnattnactcattgttgcatgcacanattttggtatgatctatctcagccggtcctactccttnggggattccttacacctccaaaattttgaattataagcntttttctccnaganctccctcattnntttacttatcttaatcattctcntccaacancacttnatntactttgggaatgccaangaatccgatntcttnttcactcgtcattacctctntgcctgctctntcttttcttggntgttatngacccagtttagaggatgcagagtncttnaatataatcactactttgaaaacatcctcagctgttttgctcctnttgactttgcttggcaaaactcagncntggctaaaacttntggccatttgcacctgcctcaaacactggngctggctacaaacaantgctaccagcatngactggntccacttngnaattcggaccncacctcatgtaggnnctcac

SEQ ID NO: 3602 - DNA, 771 bp, Homo sapiens
  misc_feature (1)...(771): n = A,T,C or G
ctaanncngngngnctcgnactngccgaacnaaanaggctnnggcgcatctgtagnaattggctttccgtttgcatatttaaatgaactttgtggcttttgttaagtataataaaaagcatggagtcaaatataagccaagagtattacagagacttttaggctgactcagtatctcaagttctgtgtagattcatctaaacactgctgttatccatgctatactttaccatgttatcccaaaagggaatcatcagcaaattttaccagaaactgctgaattcaagatatattcaatatatattatacttctgacatcctaggaagcctatccaaagaatacattactttgatagaatttgttctttatgaaaattcattttgactctcattgataactttattccattttgggggaggactgaggagtcagtgggatgggaacagagctaactacaaagtctttgagtttagatgggcagcagaaggggaaaggaagtaggccgtgggatatataaggacttttccaatggaaaacaattgtcagtggaacctctatgactacttgttcaatttcagaattaaacttcctgtatattttaggtggaatcaagctgagttctagtcaaaatgctcgcattatttcccatgaaaaatcccccaaacaccaagcagacagaacagtggttgataaacccatcatattccatttctgaagaaaatcatcaagccccaaatcttgttttagaaaatttctcaagaactaattctn

SEQ ID NO: 3603 - DNA, 732 bp, Homo sapiens
  misc_feature (1)...(732): n = A,T,C or G
tgnnnnttgattnnngcnnttgtctttctgcaggatcccatcgattcgaattcggcacgaggtttctttttttcagagttttgctgctaagaaatatctcctcaacatttgacttcatngtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtccagatgcccaaggatcttaaaacaactgggaagaatgcatcgnaatatgaatttctggaaccn

SEQ ID NO: 3604 - DNA, 858 bp, Homo sapiens
  misc_feature (1)...(858): n = A,T,C or G
ttntttnaattttcnaatncttgctctttnattccgnaggatcccatcgattcgaattcggcacgagggtagcacaggcctgcccttgcacccatgctgtacagtgcggttactagacttgtggccgttgttgtgctgtcttctcattagcatgcaatattcacttgactgaattcctttttagctaagagaaatattacagggcatgatcattttaggttattaaggtgtctaactcaatatgtaaactgctgaaaagaattatatgtttntatcagataatctcaacatttcaaaagacaacacattcagactacttccctttncccccaacttttatctaatgnctgnaacccccatgactagtgnccnaaanangngttttagtnaaattnnagtcacccgtggatnacaaangcaaccctggattcccaatcctgcttgtgggggggtttnntnggccaaatnganttaattttcttgggcaanaaannttttncttcttaccattaccnggaaccccantanttgcccaaacttttggnnaattttttttaaggaaaaaaaacctggaaatngggggttaaattcttggnaaaanttntttttttttaaaaaacttnccattttattttaaaaaaaaccccccntttaaacctngggggntccttttncctttttggaccttaanttaaatggaanngatttggggaacccaatanantnaatannantatnnnaanaananaattnattnatnttntancnaantaaaaaaaaaaccccttttnaacnttttggnggggccgtttcccnnaaacccnancttatnanaannnttnttaatttnggcaanct

SEQ ID NO: 3605 - DNA, 1718 bp, Homo sapiens
  misc_feature (1)...(1718): n = A,T,C or G
nctctaaaaatatcttttttnattataaaactttcnaaagtcttatnggacnttngggnaactccttaaaaaacntccntnaaaaataaaggnaggntctttnnttggggncctcccaaanantttcnnatactctaactgctcancncacnctcnaccatcactcaacatntatntctntacacattntatctcncanacnnantacnactctnattactctnctatatatntacnaaactactntcctnatnntactctataccnatactctctctatcntctatctntntcatacttanagnngncnnatatcactatactanatcactctnnnctcatacaccantntnccntatntatntcntcanatctcattnnttatntnacnatannctacacncnntnacatctaacatanntnnataacnatctcannttatctnntntncaannctcnnntatcactncnattcattnaannacttanaccnccnntcannnnnnacancnncacnttanctnntctccctannctnaccctcncatacatattnnntanncnccnatccttacntnacaantntcatcctancncnttcnactntcattctccnttnccttnatnacccaactcncantcacaanatncntccncaccactcttntcantacncaacctattcatncnncatnatantntntanntcncatacacnaccccatnctatnatcaancnntcantccttcntttntaatcatnnanccnnctcnnctcctatnatgnnctctgcccctannntatcatcttcacnacaacncnactctnnctnccanacnatcntnatanacncantntcactntattctaacatnantnnanaccacntactccatantcnntctaacatactnnattaanaatanattactnctcntatntcctnctatctcnatcactcctccncnctcattacacatctcttataatctncnnatncncatntctntcatctcttntatcntctctatnnnactctcctatcncatntatcnaancattactntntntatanatnacactctcncatcnctcatancactatntcncttnttatatatntanattatcatcgtatacntcnctactctcnatcactcatnatactatanactntatnccncatatcacanacanacctntcatntntcacactcnctntnntanactatntcncactcctcacanctctcatatctctatacatcnctactctntntntnctntntnatcntcttncattntntnctctatcntttcnntcatatncgntntcanatntnacnatcatctctnccatctntctctngtctntnattncttccacnatctctcttcanntttacacacacntacattctatnttctctctatcttctnctctnacctntctcnctnanacnacatatcttatatcnnncatntcatnacnnctactatcatacncatantacaccatatntntncatctctctnccantnccntatctctatacnctctatatcncntttcatatatanttacnacatnnctatanattcntatatctctaccatatactntcttctactctatcangtaantatnctaanntattattatatcncncantctctctcacncaccnctctatcncatcntntctcctctatccn

SEQ ID NO: 3606 - DNA, 1015 bp, Homo sapiens
  misc_feature (1)...(1015): n = A,T,C or G
gggggnttttaaannttntgggcttgttgggttgcaggatcccttcgattcgaattcggnacgagactggactaatatcattttaaataatattgctntttagcttcaaaagacagagcctccagcatattattattattatagtaatctgattctttagcaattcagagaactcacctcattagtgctcccttgctctatctgggcctgtgggaaaatacccttgcatctttctatgggnatggnccacnggancnccatctgnctttaacatttttgaagnattggacttttnaaggaagcngnacncaattcccntggtncntncnattctagaancccgnaancgtttcccngncnanttaaaggggaanttntccccccttgnttgtttgccncnccccngttttttacagnngggccggtttttaaaaaaganangtgnttnttnttnaaaaaattannatannnntcnnttttnggggccatnncccttntngnncnnnnnggtgtatgnacgaaccnnannnatnantnttantnncnnnttttnanttttcccacgnnctntnnttncaattatcnantctcnggtactcngggcctcnatcncaantntanataccccttnnnntgcgncncnananatnatgnnncncnctataantnnggantgttggnnnccnaananatnntntantnatangtantgtnnntctnnnnnctatacccnctgtngnttgtgcancnctcgngtacnctnnnnacannatnngntataatanntngtctcccnntagntgntntanagtgacnntccttntttaangnaccatctntcggnnancgtnactaacctnantttancanctcntcntatnaaancgtnacccccgctntgnaatggngggaatngnatnnnnaagtnncntnacaangtnnngtcttanngtntgccttcnctcgtatntntannttgcgnnacanngggtgnnnaanntaaaggnncgcgccn

SEQ ID NO: 3607 - DNA, 740 bp, Homo sapiens
  misc_feature (1)...(740): n = A,T,C or G
tggnntttnaaatttttnatgcgttggttttgcggattnatcgattcnaattcggcacgagcctagttggccatcagactttcagcaacttttatcatccagatagtcaccaaatgaaataaaatagaaaaatcccttgagcaatgaaacaattgtgaatgaacacaaagtccatgaatttaatccttatccgtttgctgagccaagcatgtgcatctgcagtgggtggcccaggctggcagcacagataccaccatttcccttttctttgctcagggcatggcctgtttatctcgttgcaccagatgangggttggaaggatgatggtggtggttgtttcagatctactgacagcaatgagaaatcaatgacagttgacaggaagagaggacccntccacaggcaaaagaggaatgcccagcaatcttggtccttgcngtgcaatactggccttgaggccaagtcagcaggggattcgtaagtcactaacttctaactgaggcagggaaagtaccatgttctggaaaangtnccaagaaacnnggaatngangcagtgtancaagaagcagattttggtgcccaatagatttgaatcctggttctgcttcttnctttgtagagtatgatattgggtcttttnctnccaaagctnttnttaaagacttaatatgtncnccaaatcttttnggatgtctgacttttnaatgcttnacaataggnatttgctggnattatta

SEQ ID NO: 3608 - DNA, 763 bp, Homo sapiens
  misc_feature (1)...(763): n = A,T,C or G
tnttcnaanttccnngctcttgtcttttgcaggattcctcgattcgaattcggcacgagcttggaggctgtttccagctagagaaagacctgcttatttctcactgaataaggttccaacaggctgccaaatcctgtgtatgcctgtacccaaatggaaggagtgcctttcctcaattcataaaaaagacaaagacagtggtagggatcagctattatgtcagtacatgaaaggaaccccctatctcaatcaaaatggtaaaggaagcttgtctcaaataacagcaaagaaactcagtttaccagactataaaagttctttggtcaagaagataaagagctctncagaataagaatacctatacatgtatggatgtgtggaaagtcgacaaaatgtgtncaagcaagttgaattctggaaactttgagtttagcaaataggagggtaagaaggctgttaccgtatttgaggaaccagatcttgaagggttcatattccataataagtataatatgaatattaattttgnaatagaacagtttctacctgtataaaaaggaagccttaaagagatngaagttagagatttactcatangggggatgattggtaactacttacttatttccggaatntcaaaagaccctantggaatngggggattntanggggaaaaaaatngacctcttttctcaaagatgaaactgnaaatttttttaccttaagaccnttgnaanaatggaaattacctttttaaccttgg

SEQ ID NO: 3609 - DNA, 730 bp, Homo sapiens
  misc_feature (1)...(730): n = A,T,C or G
cgtnttcaaattttnaactcttgtcttttgcaggatccctcgattcgttggtgtgtaaataaaactttagaaagggtctattgaactttggacaggcaagctccatgagctctccctcactctttgaggcaggttaaagggtacggccatgaccaccaccttaatccttcagggactatttacaaaagattgaaaaatgtgcccagggcccgtacctgcccctctgtggaactagcccaactcaagtgggctggcaggcaagcctggctttcatggggacagaagagagagtttgcggggagcttggcatttttcaacacatgctttttggcttctcctactgnattgnaatttccatgatatttggtgggaaaaatggacacccggnctcttttgctttttgnctgctgcttttcagctattggggattctgcgccttgggataatgaagcangctgtcatttncttcccctaaataatgcattacaaagtggaaatgcaaatttcctgtgcaagctctaaataccaggtggtatttccttaatatattgnttttgacctttggggaaattggtattacnagctgactttggaaattaaaatacatcaaggncctcattttaaataaaacaatcgatatcttaatttttaaatcagactngattcnattccnggaaaagacatncatatttgctttatgnggtnaaagtttggaattcaggaggacaat

SEQ ID NO: 3610 - DNA, 706 bp, Homo sapiens
  misc_feature (1)...(706): n = A,T,C or G
ntttgaaatttcgntantncttttntttttgcaggattcatcgattcgaattcggcacgagatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaaagtgttggggcttcatgaactangatgaaaggagcccctgaccatgacaaggggcacatccaggatttncgccaccctgaatttagtaganctaatangccctggttgttactnttgggcaaggaatgccgtnaacctttganggtncgcacccacttgtgtgttgccctcttgtnctgncggggaaacatncaccccttgtcttaaccaccaaactttgcttgtgtnntcancaanggttgncctttcccaangacttactgnatgtacccngaccctaagccttgcctttcacatattnggagcttttggattcatntgactttgaccccntctgctntcacttgnggcctgaactgttgatcaatgttggcanaatnaaccnccttntnnanctaaagctactttaccatccatataatgggattnaaaaaaaaaaaaaaaat

SEQ ID NO: 3611 - DNA, 885 bp, Homo sapiens
  misc_feature (1)...(885): n = A,T,C or G
ttnttcnaantttcggantnctcnttctattgcaggatttnatcgtccttaatttcggcacgaggcaagctggagagctgcagaggctggtagcgtggctcagtccaagcacagaggcctcntnaccatggaagctgatggtataactcagtctgaggatgaaggcttcagaacctgggggactacaggtgcaagttctggagaccgaatgctggagaaccttgagttctgatgtccaagagaaggagaaaaaggacttcccagctccagaagagggaaaaagcaaatttggctttcctctgtcttcttgntctatctgggtcctctgctgantggatggtncccaaaacttttgggtgaaggtagggctttcttaccctgntcatggattcaaatgccaatctctttttggaaacactttttccagnacatacccccttnaaataaaaatnttttanccttgtatcttcttnttaaaaantaataaaaaaatttttaatattnntatnttncnntnttnnnnnnccntgttnaanntntatttttnntnanngactnaantcnntacnntnnctcttcnntannatnnaantntcnanttnancttnnantnnatcttttntanntnanntanatcnnttntannncnttnnatantnactatnntctttgtttantntcacanttatctnntctctntnntatgttntaattctactntnnntatttaaaatgtcnatntntatctntnanaccatnttnncncanantntttatctanttctanancctttatnntnttntcnttatttnntgtcttgtntntatcnattttnttatntncnnntantnctntanttnttannattnantananntntnccn

SEQ ID NO: 3612 - DNA, 793 bp, Homo sapiens
  misc_feature (1)...(793): n = A,T,C or G
gnnnttttaaatccagctcttgtcttttgcggaccctcgttcgaattcggcacgagaattgataataattagacaaactgaactaaatttttttaacagatacctgagtgccaagcttaacagatacctgagtgccaagcataataaacaggaaatatacacttcaaaaaagaaaaagaaaaatgaatgcatacttatcaaatacttgctgtaagagcattaagtactttacataagtcaaatcatttaatcctcatgaccctaagaagttattttaaagatcttttgagaatgagaaaaaaggatgagtaagggtaggtgatctatgtaaaacaaataaattctagtnactggcaaagctgagatttgacctaaatcaatctgccagaagttctgagttattttccatgtgcctcacatagcagaaagggagatggcataagcacatntcaggcctagaggtaacatatactctggcaaaagcntaaaaggtctatgaaattttacagcaaggaaaggctatttctaacagggaggactcagaggaaaggaagccaccntttaaagtttgggtacctggaatnaatttcttaagacntttccccagatnggaggacccggggaaagaaagaaanccttcccaggaagggccaanccnggagccatggtggtcaatggtggtggtttaangggccngaaaaaaattnggtggggaaaccccnacccccaggnccngggaaaaaaaannnnnnannnnnnnnnnnnnnnnnnnnnnnnnnnnnanaaaancctc

SEQ ID NO: 3613 - DNA, 870 bp, Homo sapiens
  misc_feature (1)...(870): n = A,T,C or G
ntttnnnnnntttagngggccnttgcgntngntctttctgcaggatccctcgattcgaattcggcacgagcaacagtcccaaccagtcgaattagacccatttggtgctgctccntttccttctaaacagtagatacttctgatggattctcggcattaactcctgtttcaaaaaagtgtgaacagttttatgaatttgaaagaaaatttgggtagctctttatagcattcattcttaaagatcagtccagaatanggtgattctaaataaacccaatngaagaatgaagtatctctacagggtagtaacttggattcctcttcagggagaaaaagggagccttaaatttgcaagcctcttaacctaaaggggtttcttggntncctngccttttccaaccccccnnaaatggcnaagttgttgggggccctttncccattgnnnaaaagccccctttggggaccnttttttaangggnggngttanncccncnttttntaaaagggnccccntnggaaacccggtgganttttttggatattcncnaaaagnggcaatttttttattggngcnntnttccccttcaaaaanttangggggnaattttctaccataccncttaagtttncacccttnnggaaaattttttttttaaangggccccntttttaaaatttcccagacaaggttaaaaaccnatnttanttattntttnaaagccntttnnaaaaggtattatttttngnnnaagggcnntaaanttttnagtccttannccctttttttcncaaaanctanccnnnaattaaccgcntttttggggcctaaaanaactnggncatttttttaaanaaaagggccntnttaat

SEQ ID NO: 3614 - DNA, 1046 bp, Homo sapiens
  misc_feature (1)...(1046): n = A,T,C or G
ggcgggtcctccgnggaaaaaccccttttngggaaattcggggtagnngaaaacnctttggggnaaacctccgncgcnnaaaangcgcngagnnnngnggaacggngnnccacnngcannnnnntnnggnggancccnnggnacgggtttnccncctttnnancgngacnngngggcacgggggancngngcacnagnancanaangcacggagccggccnnaangnganagtaanncncctaangaangtagangannnaaacatggntncnccacaaggcangagcagcaccttggggctgctggnaagcccnnnatnatgggggncnncttggacnangtncnggcanaaagggggcgggggcatncnaanccnnncccctcnncatnngcaancnncnnancggggnaacccaaccagngcgaaatanccancggngccntnaatgcgcnaaaccanggggcancacggagggncctnngcgcggnnacaaggcncacccctngnacacgngngnggggnacnncacncccanacgagcnggcancgnanccccnnncatnangggacccctacnnnnnnggggcgnnannntnngcgnngggggcacantaccannanacaccgcgngcganacanncnttccaaaccacggacgaaannaccncgggagnatantaanaccnacnnccaaannggnncangcacaatcggcaacccntgggnnnntncntnangggagcccgganccccccacccagnntccnngananncaatgnncnccnntcnannaccncnccnntaanccnggggcncagngggnaanggnngangcccccnnnacgggggncnttanagnccctaaanantnaccccnngnntncacaaacnncaanaagnggcnannncccctcggnganncaaaagnncgcgancgcnnnnancnccnnnangntcntcngnncncnccacnnggncntccgcnccgggagnncannggnnnncccctncnctnccnaaaagcngngcntcnnncaacccnc

SEQ ID NO: 3615 - DNA, 743 bp, Homo sapiens
  misc_feature (1)...(743): n = A,T,C or G
agggctgctcttgttctttttgcaggatcccatcgattcgaattcggcacgagaaaaggagccagaacttgatgattttgaaaattctcagcctttctggttggcagagggtgatgaaattgagacacggcaaagatcaattcaagagccactccggggagaatggcggtctaaagataaagccaagactgtgcctttaaagcctgctgttaagacctganaaggtagtgccttagcatcctcttcagtcacactcaaggcctctccgtcaaacaatagggcttctacctttttagcaggagcccaaggtagaggtanaagagttcctcttggagagatctatgggtatagcttttgnctattgcngtgagatatgcnngaaatccactgtagctaggactgacnngaaaagaacngtncnaaatgaaaagagctgtcggcacccctagcattctgctggcaggaaccagctgagaaagtgctcangactacacatgcccctttcatcaaaagggaaagatgactcanaagttggaagcangagcctaganatgaaggccaaaagtcatgggagaattctttttccaatggttgagancctaattcanggaactttcaagnggtttgnccctggctnggaattcannaagtccagtattgggatcaatggactctttttgnngccccccccaantttcctgggcctttcnttttggtangaaaaaagggtttttncccctttt

SEQ ID NO: 3616 - DNA, 906 bp, Homo sapiens
  misc_feature (1)...(906): n = A,T,C or G
gnnttnntttttctaagggcttgctccttntntttctgcaggatcccatcgattcgaattcggcacgagcccacacntgccatattgaaccgtttctgcactaatcttctncacgggcacngcgtggagggaacgtctaggggaaangggagagcttgacctccatctaggttacttttatctggnnaaaaangaacactttttggacttantgtaatngctntngnccctgtaaaaggcaangctanccncttaactttcccanntnnaccttttnagccagggaaccaaatgnaaagggttaatggtntnncatggaacaggactactttgcttcccctttggnggacaaantttccctagaaacaancttacccttnaaaacacccaaaaacnttcccaanccccancntggnttgggcattagngaagcatggtnggtncccaaactttacccaaaaggggacnttggggagcccaccctttntgacttcttgtgggaaattactttntannngaggaacctggacttggccttggantanaaaaaccccttgtaaatttnccctnnaanttanccnnattccccttaaaagacnttttntnttgggaaaganttcatttngccttgntacntatttccctttttttgnggtggcattaaaattaattttatttaaaccttggtttcaaactggaccaacatttgggttttcttnccaacttangggaaatttttggaanttcnaaaactgnttcgccttttgaaagancttngctttttttttggnaaaanngtnttnggaatttgggctgttaaccnaantttccnttntttggaatcccnnnagganggggcnanatatcttggggcaaaaaaaatnnctnggtacccctttttggntt

SEQ ID NO: 3617 - DNA, 1235 bp, Homo sapiens
  misc_feature (1)...(1235): n = A,T,C or G
ctaatnctgtaacctanntttcttgacgccnncntcgcnctaaactacnntgnctnnggnnctccncccttacnccacccctcacccccntcctttnnntctccgnngcctnccccccccctcccnnctnnntgcccnncnccctanccnccccncnncttcnncctcgncnntcnctctccnttcccncctcncccccttcctcncnntctnnccccctcccccccctctccgcacctctctntccccctcncctgtctcccccnccctncccttcccnttcctctnccccnntacttccnctcctcccncactccctcctctcnnccnctncctntnctnccnctcancccccctctcccctctcacccnccttcccccnnnncccctcccccctctctnnntctcctcnncccncnnctcctccttctccctnncannccccctcncnccctctaccctnctcccctnntcctccctncctacctcnaccttccctcnnnccntccnacncnanncctctcntctnctccntnctctcnctncttccctcctncctatnccnncnttctccccntttctccnnctcctcctccctccnnctcctcctctcnttnnatccctctcttcccnncncntctcngcnntctntcntctctcttcatcatctctctcacatctctctctctctctctcnctctccactctcttctcntnttctaccctctctcnctctntcactctctccctccctctanccttnctctctcctcncccttntntcctncctctctcntccctcntccttccccnntcctcctctctcctccntctctctccnacctcctcctcccccttcacttcctcccctctcctcttccttccccncctncctctccncccctncnccttcnngncatcccccctcttctctcncctcttccnnncccttccttctcctcanctcaccctnctncctcctcctcttcccctcctctcnatccccccccttctctctcccctctatccntctccantcctcncctctcnctcnncttactacacnctccctctccccccntntcctnccncctcctatccctctcnattcctccncttctccttntcncctcnttcccttctcntnctcctctccccttctntcctnctccctccttccntctncncctcctctcntctncttcttnctcnctctcccccnntctcctcnccct

SEQ ID NO: 3618 - DNA, 999 bp, Homo sapiens
  misc_feature (1)...(999): n = A,T,C or G
ggntatttnaanttttctaaaagcttngctactttganctccgtnggatcccatcgattcgaattcggcacgagcccaaccccaggtgtgccgcgtgctgcccttgagagccctgccccncgctgtgaccccggagatgcncgccctggtggtagactggctggtccangtgcacgtaggagtacctgggtctggctggtgacacactttatctggcggttcacctgcttgattcctacctgagcgctggcccgngtgcgtntacatngtctgcaactgctgggcgtgggcttgcctgtttgtggcgtgcaaaatgggaaaagtgcgtgctttccngagacccnacttnctnttgnntcttgnnngcggannntctttttttanngggngggaactttattgnnctncccaaacnntngcanttcntnnnnccnccnctngaatttttcgggcttnantaccaaannccngnnccganngnttgtanccttncggacttttttggnncncntccttttncaangganatnaaatccccccaagttgaaatntttancattgtgncanncntaaatttncttgggaancttggtanttttgacttgganagncnccnaatngccnnnccngggattttggaaaaccccgggttnnctnatnngcnnggtttttgngnnatttttttnnacccttngggngnccaannnnnnattttggntttctaaaatnggggggcctnggggcttttcaatnggggttttcatagcncccannnaaaantntttttaacaatataccccctnanngngtaaantttgngggnanaaccccctttttnataagncccctnttntnaaaaaatttttnttaaaatggnnanatcnnntntatttttanacctntanganaaatttctcacntnaacatttttgtnatatannnggatnnncanaatatttggtnanccaaaaaatattttatgttggacnccnaaaaann

SEQ ID NO: 3619 - DNA, 879 bp, Homo sapiens
  misc_feature (1)...(879): n = A,T,C or G
cnaaatacnggtacntatcttcncaaaggnnnctanntngccctaaananaatngngtnngggggttangnccattttgatgttacaggatacttgtaagtgactttttgccattctcttttgttacccatggcctttgtcacccccttgaatatctcttttactcagttctcactttctgttgttgacatacttgttgacatgtnccaccantccatgaaatgaaataccatatcttccttgtgtngatatnacttttgtgagtatttaagacatatatnntnaacnaatgtaaaacttnnnaaatngattctcttctcatnaaaaaacatttaaagggaacattnanaatatnctnnnnacntttctctgaagaccttacnatttctattacttcaaaactcccnntanatcanccttctactacnagagtgaanggaanaccctaacanatctnccctngtganttttacctttgatctacaangcnctcctttcacnnttcnnggtcnttcttacgntanccgnatcctntttcctctntttccccanccatccttccccnataattgccccntcntcnanttaaccctcnctctttgcnttgnaacccctcgcccccctccntcgcnnccctttncttnangatnctccccctngccatccnnacccttcgcnntaacccccancccctctnctaccttttcntccaaaaacgtncctnccatcccctantcggnnantctngnccctcnannnatncntacctctcaanctcnccantcaaaccnccacattcncccanannacaaanncngnnnaccnnnntantccatntntacactctccnnanctcactnctcnccnnntacnctacct

SEQ ID NO: 3620 - DNA, 959 bp, Homo sapiens
  misc_feature (1)...(959): n = A,T,C or G
nngttntttnaattttcnnaagncctncgctttcaaaccttggatcccatcgattcgcttggggtgagtctcatcttcaccctttcaccaactgtcctggtaacaatctcccttccatttccttgttcttacagcataccccatagaatcaagcctcgttattgccagggctgaactgacttttttgtttttgtttttgntttaagcagtaccattgngcaccttgggaaaattcctgtgttgatctaattttaccatattcttcactccactgaccactccaattaggatactcctggcactcttggntttagagaggcttagatatgtggctatttatccttttggncttnancactnggnttttgncttttanctaaaccngganttttcctgggganccaaaaacttgnnaaatngtttnttttcccnaggaagtcttcaaattnngggaaaaccccccaangccttgtgnggggtttttggccanncnaagggcgttantattntngnnctnataatttttcggggttggaaaaacccaactctggttgggnttgggggaatggnnccttttnaaaattttggcnggggngnatntttcttggaataggccnccttgggaaaacccccaaaatncttggaacagcccgcaaataaanatttggggnccttcnctgggnncnttctttaaaanaaanggcctttgggnancctttttnggggggaaaaagntgggggccctatttaaatttcggaaaacggaaatacgtntccctcancaacttttnaaaanaanntncataaaggnnaanaaataacctttggggngccccttttaagaaaccccttttaatntngngaccnnnnnattttaacccttngaatatcccaggancntttggtttaaaggaanccnnttttggatcnaaaatttttggggacaaaaaancccccct

SEQ ID NO: 3621 - DNA, 839 bp, Homo sapiens
  misc_feature (1)...(839): n = A,T,C or G
tggnnttttgaaattncnttagggcctgctcttttcnaatcngtnggacccatcgattcgtcctattttacgtggttgttgagaggatccgatggaatgactagctgaaagtgtttgtaaaagtcaggataagtaaagcaatgctgcaggaacaaacaatccccaaatttcagcagcttactacaaaaaaatatgtatttctcactcatgttcatgtccaatgtgtgttagcaaggagatactgtctctcacagtcatgcaagaccccttgctggggaagctgcacctncatatatgcttctaccatcaccagggcagaggagagggagcatggtggatcatcactggctcttaagactttacttgngngacatatgtnacctntactcatggntnatnnggccaaccaattacatgggcatagnctnactttaaaaagggcaggagaagtgcaaacttatcatgggccccaaggagaagagaatcanagtatttctgaacagntttaatttttggccagaccttgaaagtncttaagaaattagcttccaaaaaatattatggaatatttttcaattcttccaaagccagcctggtantttnggattcaccaaccgggaaaggtccctggnaacttcttaaaacttggcnaggggaggccttttaccttggaatggtncaannaaatttanctcnattnaaantttcaaaccaaggggtcaaaaattccaaccgaatgttnanccaantggggncnccaaacctttgaaaccccngnngnncccnctttnacttaagcttacttgnnnnaccngaactgggnnnaaaanntnntcccn

SEQ ID NO: 3622 - DNA, 874 bp, Homo sapiens
  misc_feature (1)...(874): n = A,T,C or G
tnnnnnnnnnaagagnnnnnntttgaanctaatgctgggctacttgttctttttgcaggatcccatcgattcgaattcggcacgaggcggctggcggcaaaacctctcgatgagcccctgcccgatgccgcgggggagaggccgngacgggaccgagaagtgggctgggagcagaggtcgcggatgtggcnagcgaggccggggcccatgcngggaccggaaggggcccnggagtggcnggcacgccagggtcagggtgccggncgaggganggggcccggggttngggaaggggnccnggtgagggaggttaaacagccttgcaggcctnngggnaccgatgttggacggcnccngcngnatgtgcgagggcccgtcccgcatctcggggcccatccccacatacngacgctctgtcctgacaactncatgctgccgactcngctcaagggcgcctcgatggaaaccgctgaactggacttgctgacttccnacgggccctggacacnancgntgccnctnggcccctggcattangtccnggnggccngaaaaggatnctggnagnnccggtncagcgccngcctttcgggngacntnncttnnntgcnaacttcgagggggggatcttaaccttaaggttccctggggngcccttttttttaaaagannggaaaagggacncccttaangggnccccnttgaaaaaaagggatntaaacccttgganggcccggggttncaanngggaaagaaattttcaaaaaaancctcnttttttaaaaaaaaaaacccnngggaaacnctntttanccccnngggnaanncctanggggggnccaantnccccaaaagggnccccccctttgnaaaa

SEQ ID NO: 3623 - DNA, 749 bp, Homo sapiens
  misc_feature (1)...(749): n = A,T,C or G
agagnnttnntntttgactttnatgcttggtctactngttctttttgcangatcccatcgattcgaattcggcacgcaggtnngatcctgcactcnntttanngagcccttgncnnaatgccntgnnggagaggccgngagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagaccgacgctctgtcctgacaactacaggcggccgactcggctcaagggcgcctcgagggaaacgcgctgaactggacttgctgacttncgacgggccctggaaccacgtccccgtggcccctgcatcggtcccggtgccggagagatcctggagcgcggccacgcggccgtcggggacgtgctgttgcaactcaggggggatctncctaggtcctggggcctcttntcaagangaaggacccttaaggaccatgagaaggagaacctgagccggatcaagggagatttaanaaacctttaaaagaacanganccccaacccngggancaagggccaagccaaggccccttna

SEQ ID NO: 3624 - DNA, 740 bp, Homo sapiens
  misc_feature (1)...(740): n = A,T,C or G
agagnnnnnnttgtanctnatgctggnntagcgtnctttttgcaggatcccatcgattcgaattcggcacgaggcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaatgggacgttgccacaatgacaggagtatttaaattttgagaagagtagttcaatctctcgatatggagcctctcaagttgaagatatggggaatataattttagcaatgatttcagancttataatcacaggtttcagatccagagagagtggattncaagtt

SEQ ID NO: 3625 - DNA, 745 bp, Homo sapiens
  misc_feature (1)...(745): n = A,T,C or G
agtnnttnnntnangaatccttgctggnnccgcgtggctttntgcaggtngcccatcgattcgaattcggcacgaggcctcccgaccccttttctccccctccccacctatcgtcatgacggcctctccggattacttggtggtgctttttgggatcactgctggggccaccggggccaagctaggctcggatgagaaggagttgatcctgctgttctggaaagtcgnggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggctnccangaagaatgtactattacctgaatgcttntattccttttttgacttcgaaaagaattcaagaaatgttgccctggttcacctgatattgacaaactgggacgtttgccacaatgacagagtatttaaantttgagaagagtagttcaatctctcganatggagcctttcaagttggaagatatggggnaatntaatttagcaatgatttcaganccttataatccanggtttcagatccngagagagtgnattacaagtt

SEQ ID NO: 3626 - DNA, 735 bp, Homo sapiens
  misc_feature (1)...(735): n = A,T,C or G
agtnnttnnttntgactcnttgctggnnnagcgggctttttgcaggacccatcgattcgaattcggcacgagccccacccattagttntgtgggcctgcccaacaccttcctgggttcacatccggccagacaagaaagaagccaaaaaactttccgtctaccactgcgcctcctcatgcccaccccatcctattagcctaaaatggaacgggctaattagtttatttgtatagggaggggtttcagctgcctggacaaaaccaggagtccactgtccaagcttcttctgttttcctgagctcagaagaaaaaaagtgtgttagactaagataataccgccttttgaatatctcggcttcatatttgcctccatgagtgagagggccaagtgttatctgcaagttgaatcttctatattcaaaaatctccatcccttttttctgccagcgcattcccagatcagccgttcacttgctctaagcctctataatctatgattttctttnctctttaacctgctctttccattggccagtttattcatttctcagctacagcttcagaggggctcaccttcnggcttccgncccaagggcatctggaggcttcagttctgntttctctgctgagtcaggagccagcccacttgatttggctcccgtgtatctttgngtctctgctcantctnctgctagtgtgccttgggtgcctcatcaatctctttccatcctggg

SEQ ID NO: 3627 - DNA, 741 bp, Homo sapiens
  misc_feature (1)...(741): n = A,T,C or G
agagnnnnnnttttngnctaatgctggnntactcgggctttttgcaggtagcccancgattcgaattcggcacgagccccacccattagttaggtgggcctgcccaacaccttcctgggttcacatccggccagacaagaaagaagccaaaaaactttccgtctaccactgcgcctcctcatgcccaccccatcctattagcctaaaatggaacgggctaattagtttatttgtatagggaggggtttcagctgcctggacaaaaccaggagtccactgtccaagcttcttctgttttcctgagctcagaagaaaaaaagtgtgttagactaagataataccgccttttgaatatctcggcttcatatttgcctccatgagtgagagggccaagtgttatctgcaagttgaatcttctatattcaaaaatctccatcccttttttctgccagcgcattcccagatcaagccgttcacttgctctaagcctctataatttattgttttcttttctctttaacctgctctttccattggccagtttattcatttctcagctacagcttcagaggggctcaccttcgggcttcccgccccaagggcatctggaggcttcagttctgntntctctgctgagtcaggagccaggcccagcttgatttggctcccgtgtatctttgngncnctgctcantctctgctantgtgcctngggtgcctcatcaatctcttccatcctgng

SEQ ID NO: 3628 - DNA, 743 bp, Homo sapiens
  misc_feature (1)...(743): n = A,T,C or G
agagnnnnnttntanctaatgctggnatagctgggctttttgcaggatcccatcgattcgaattcggcacgagcttgattaggtctttaggggccgagggactagccagctgcacaggtgactggatgggggaggggcangtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttntttgtnnnnnttttttggagacggantctcgntctgtcacccangctggagtgcagtggcgcgatctcggntcactgcaacctctgcctcctgggttcaaacgattctcctgcctcancctcccaagtagctgggattataggcgcccaccaccatgcctggctagntttttattnttagtananatggggtttcacccntgttggccaggctggtctcgaactcctgacctgctngatctacccacctnggnctcccaagtgctgggattacaggcgtgagctaacatgcctggccaggggattaaaatattcaaacatgttgngtgtacccagatatgctgntaatttangaaaaacagtncaatttctatgaaatgggtggggactatttnctgtantcaatacattngggatat

SEQ ID NO: 3629 - DNA, 749 bp, Homo sapiens
  misc_feature (1)...(749): n = A,T,C or G
agagnnnnnnttgtanctaatgctggtntantctgtnctttttgcaggnatcccatcgattcgaattcggcacgagcttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttnttttttttggagacggagtctcgctctgtcacccaggctggagtgcagtggcgccgatctcggctcactgcaacctctgcctcctgggttcaaacgattctcctgcctcagcctcccaagtagctgggattataggcgcccaccaccatgcctggctagttttttatttttagtagaatggggtttcacccgtgttggccaggctggtctcgaactcctgacctcgtggatctacccacttggcctcccaatgctgggattacaggcgtgagctancatgcctggccagggattaaaaatattcaaacatgttgggtgtacccaaaatatgcctggtaatttaggaaaaacagtccaatttctatgaaatgggttgggactattttctgtagtcaataccaatggggatatct

SEQ ID NO: 3630 - DNA, 750 bp, Homo sapiens
  misc_feature (1)...(750): n = A,T,C or G
agtgtnnnctttgaaaccttatgctcggtatagctgggctttttgcaggatcccatcgattcgaattcggcacgagagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcaatggttacggctgtgaaatttacaatttctgaccattcacaacctattgatccactgttaaagaactgcataggtgatttcctaaaaactttggaagacccagattggaatgtgagaagagtaacccttggtcacatttaattcn

SEQ ID NO: 3631 - DNA, 745 bp, Homo sapiens
  misc_feature (1)...(745): n = A,T,C or G
agngnnnnnnttttanctaatgctggnctactngttctttttgcaggatcccatcgattcgaattcggcacgagagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcangctcatcatatgcccgaagctcaatggttacggctgtgaaatttacaatttctgaccattcacaacctattgatccactgttaaagaactgcatangtgatttcctaaaaactttggaagacccagatttgnatgtgagaagagtaccttggtcacatttaattn

SEQ ID NO: 3632 - DNA, 1304 bp, Homo sapiens
  misc_feature (1)...(1304): n = A,T,C or G
gnnagcgttcncncttntnggaaaccntttcnaantngctggggaacnccgaaatcgcnnnnagggtcgcnatgcgantcgcaaagtcataccaaaacttcacttaagtagtccctatttttactccagtgcttatnncattatctagcagaatgtaccttcattngatccactatttaccantgattaaagtggagcngtcngtggagttatacgnnactnngnagacttntgtctancgaaatacannanacaaccncanaggaccataantttnatgcctatagaacatnnnangaaacaggagcaggatcntngtctataatatancaaacttgnttnnacatacctancnacaacctacaaatgctcttanaaccancctanctnantgctnccnagttttnctnggntnaactccnactnttnggngcaantgcaggntcacntanctncnattcccnantgnanaaactnnnnccccnnananctntnntntagctcannnctctttaacnacntnnnnatncnttntannatcagccaggncaccnacantanttcanttcnttnnccaatcannactgnaatntnncncttnnctntttncncttctnnctaacatcacggctatncgcntaaatnttctacactcacgggtgananactcggnctnacantctncgggagnctatacctntcgcnnnncacagtntgcgntatnncncaataagaanaanatctncnctcnnananantcnccnttcctnaaccannacannntgnntctcatnnacnntncgtaangcnagtacncgcntantcancatactnacatannagtntatcnaactntncncttctntnanctananacgtntcacncttncntatanaactcntattanactcanacnngctcctnngngatngtnctctctatnganannnnnncannnctanngnnnatnactccgacngtacacctatataatagantctntacncctctattcatcagatnnanttctcanaganttnnnnntaacattatncncactanacnatgntcanccctnanattcggnncnctacacntnctacnccatctcnagcntnntacttctcacaannnancctnctntacncnntacanatantatcacanatccncgnaantntntntncntcntagnngtacanactncantctatntctacnnataaatatntcctatcnnctcanatcncncntntantcngntacgnntntcgcanncnctcctcatcntntcngnacncnt

SEQ ID NO: 3633 - DNA, 732 bp, Homo sapiens
  misc_feature (1)...(732): n = A,T,C or G
cnaaatncctgctacttttgatttccngnaggatcccatcgattcgccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggaagtcatttacacatccttatataccatgaggggcaaaagtaagctttcttcctcccaaagcaaaactctttttccttaaggagctggaatgccaccttgaaattctgagttttgagctttcagtcattttttggctggaataggtgggtgaaatttcctaagtctgctctgtgatgtncccctgaagggatgcancatgaaccattggtccctttatgcgatcatgtcccgggctgcactnacanggtttggggcanaaaaaanccaaacatttcacccacaggcaagcttgcttntcggnaacccccnaagctgggtcctgcgacagaatttggtnaaggacccttnaccgnttggtcactggctgcatttgnngccaanacccccccccgcctnattnngaggattttaaaatttggantgggttggctggccttgcacttccgnancttatgcctaaaaaaaattttcct

SEQ ID NO: 3634 - DNA, 1278 bp, Homo sapiens
  misc_feature (1)...(1278): n = A,T,C or G
ctaccgccttatgntatcgnnctttccnnaanananangctnggcgaattcggcacgaggatctatctcttctccctgcccattaaggaatcagagatcattgatttcttcctgggggcctctctcaaggatgaggttttgaagattatgccagtgcagaagtcnnanccnccccccnnccncntcnncacncccctcncncnttcctnnntcccccctcccnnntccnnccnnnnnnctnancancncnctnacncnctcncnnctcnnccncccnccancncccnacnccaaccnnnnccnnncnnncncaccanccctnntnnccccncnnatntnctccnanccntacncncnctnttccntcntctcncnntcnccncnccttnncacnnctctcntacctccncnctncntcccnncnncnncccccntctannacncctanncacccccccnnatacanctcnccnccnccnttcnccccncnntcanntcnntnntccncnctnnnncctccncnnntttnnnantccaancnacnnccnntnccntcttctntatcnctnccttaccctcctccctactcnctctcncctccncctctccctcnncctcntctnncntctcnnnanctctcctcnncccnccncactttccanccttctnnncacacccattccnntacacnnncncnnccctnncctcntcacnnnntctcncnctcctcncnnanncnnnctncannacncncnctccnctctannanncnccnnncnnncnccncctncncncatctctnnctctnctcntntncncatctcnntnttctntcnncncacncacttccactnntcnctcctcctannnncanctcnnttctncccnncacnatnatnnaccncnnnnctncatcnnnntnatcccctctctcnctctcnnttcanncncacnacttccctcccnnntnctatcncantcnttcacnncnctcttccnctntatatntnntacnctcncctctcaccttcacatcatnatacnacnacacntctatnnannctcncnctctancnctnnntacnnccannnncnnctncaccnncntcctttccncctntctctnctnncatctnnnntnantctntcanntctctntcntnctcttnnactctncncnnctnncacnactntctatncnnccacnaatcancatcnctcctctctnnccntctntctnnnctctntactnancacatntntcnctntctctcccct

SEQ ID NO: 3635 - DNA, 762 bp, Homo sapiens
  misc_feature (1)...(762): n = A,T,C or G
gnnnttnnannccnnnttncaaatngctaggctactngttctttttgcaggatcccatcgattcgaattcggcacgaggctgtttcctcaagaaaatgaagagggaaggatggctcanggaaagttaatcagagggaaaatgtcactctgtanagagtaaaanatttangatgatgatacgatctgggaaaaaanggcatagtgaanaccacttaaanacaaactgaancctatgaaggngcatgctatttccccagagctgaaaagataagtgaaatngtgtatgaactcttaagtggaggtgaagcagaatttattagccaccaaccacataagtgattatgaagtaactgagaaacaggtaacattttttcccacatggacaaaactttctctttctagaatattaagtctctatgatgagaaatgaagtagcatctcaagcagtttataaatctaccanaatattagaatcacctgggacctttgaacgtactcatgcccaggtctactntattcatttattnttttgtnnagatggggacttcaactcctggtctcaaatgatcctnccacctcggcctcctaaagtgtgaggattacaggcgtgagccctgtggccagccctactaggtctgctttggaccaattaaatcaatctctgggggtggaacctgggctttaagtatttttaaaaattttcctaggtgggtctaattaatactcggattgagaaccctgctacacatggaatnttattcc

(The sequence listing continues in the following parts.)

We claim:

1. An isolated polynucleotide comprising at least 50 contiguous nucleotides of a sequence selected from SEQ ID NO:253 and the complement thereof.

2. A vector comprising a polynucleotide of claim 1.

3. A host cell comprising the vector of claim 2.

4. An isolated polynucleotide comprising at least 50 contiguous nucleotides of SEQ ID NO:253 and which hybridizes under stringent conditions to a polynucleotide of a sequence selected from SEQ ID NO:253 and the complement thereof.

5. The polynucleotide of claim 4, wherein hybridization is conducted at least 50° C. and using 0.1X SSC (9 mM saline/0.9 mM sodium citrate).

6. A polynucleotide comprising at least 50 contiguous nucleotides of either strand of a nucleotide sequence of an insert contained in a vector deposited as clone number M00001448D:C09 of A.T.C.C. Deposit Number 207032, wherein the insert is a human cDNA and the clone is obtained from a human cDNA library.

7. An isolated polynucleotide comprising at least 50 contiguous nucleotides of SEQ ID NO:253, said polynucleotide obtained by amplifying a fragment of cDNA using at least one polynucleotide primer comprising at least 15 contiguous nucleotides of a nucleotide sequence selected from the group consisting of: SEQ ID NO: 253 and the complement thereof.

8. A vector comprising a polynucleotide of claim 7.

9. A host cell comprising the vector of claim 8.

* * * * *